United States Patent 11,685,924 (GENETIC ELEMENTS DRIVING CIRCULAR RNA TRANSLATION AND METHODS OF USE) - sequence listing, part 2

SEQ ID NO: 9136 - DNA, 203 bp, Homo sapiens
  source 1..203: mol_type = other DNA
ggcgcgccagtcctcggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacacccgactcggaccgatg

SEQ ID NO: 9137 - DNA, 203 bp, Homo sapiens
  source 1..203: mol_type = other DNA
ggcgcgccagtccttgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgcgactcggaccgatg

SEQ ID NO: 9138 - DNA, 203 bp, Homo sapiens
  source 1..203: mol_type = other DNA
ggcgcgccagtccttgcgggagagactggaattcaagagagtcaaatgtgctgggaaagactttctgggcaaaaggaataagcaaaggtgtgcaaaggtaaggaagcaggaaacctttgcacatcttgagaactcgccggccagaggcctgtgaaggagcgcagtggtcaggcaggagaggcagtcggcgactcggaccgatg

SEQ ID NO: 9139 - DNA, 203 bp, Homo sapiens
  source 1..203: mol_type = other DNA
ggcgcgccagtccttataaagccgcgctgcccgggagccgctcggccacgtccaccggagcatcctgcactgcagggccggtctctcgctccagcagagcctgcgcctttctgactgggtccggaacactgaaaccagtcatcactgcatctttttggcaaaccaggagctcagctgcaggaggcaggcgactcggaccgatg

SEQ ID NO: 9140 - DNA, 203 bp, Homo sapiens
  source 1..203: mol_type = other DNA
ggcgcgccagtccttcagaactcacacttcttcctggcaaagaagtgcccaggacgggagctggggagccagggctgatctaggaggctgggagccaggtgacaggatggccccaaagagagttgtgcagctgtccctgaagatgcctacccatgccgtgtgtgtggtgggagtcgaggcacatgtggcgactcggaccgatg

SEQ ID NO: 9141 - DNA, 203 bp, Homo sapiens
  source 1..203: mol_type = other DNA
ggcgcgccagtcctgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 9142 - DNA, 203 bp, Homo sapiens
  source 1..203: mol_type = other DNA
ggcgcgccagtcctatggggctcaataagtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 9143 - DNA, 203 bp, Homo sapiens
  source 1..203: mol_type = other DNA
ggcgcgccagtcctgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgcgactcggaccgatg

SEQ ID NO: 9144 - DNA, 203 bp, Homo sapiens
  source 1..203: mol_type = other DNA
ggcgcgccagtcctgaggcgaggcggggcgcgactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggccgactcggaccgatg

SEQ ID NO: 9145 - DNA, 203 bp, Homo sapiens
  source 1..203: mol_type = other DNA
ggcgcgccagtcctgccccgccccgcccctgcgcggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttcgactcggaccgatg

SEQ ID NO: 9146 - DNA, 203 bp, Homo sapiens
  source 1..203: mol_type = other DNA
ggcgcgccagtcctatctaccttatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 9147 - DNA, 203 bp, Homo sapiens
  source 1..203: mol_type = other DNA
ggcgcgccagtcctgtttgttaggggcagaagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgcccccgactcggaccgatg

SEQ ID NO: 9148 - DNA, 203 bp, Homo sapiens
  source 1..203: mol_type = other DNA
ggcgcgccagtcctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagcccgactcggaccgatg

SEQ ID NO: 9149 - DNA, 203 bp, Homo sapiens
  source 1..203: mol_type = other DNA
ggcgcgccagtcctgaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactcgactcggaccgatg

SEQ ID NO: 9150 - DNA, 203 bp, Homo sapiens
  source 1..203: mol_type = other DNA
ggcgcgccagtcctggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggcgactcggaccgatg

SEQ ID NO: 9151 - DNA, 203 bp, Homo sapiens
  source 1..203: mol_type = other DNA
ggcgcgccagtcctacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactcgactcggaccgatg

SEQ ID NO: 9152 - DNA, 203 bp, Homo sapiens
  source 1..203: mol_type = other DNA
ggcgcgccagtcctaccccgagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatcgactcggaccgatg

SEQ ID NO: 9153 - DNA, 203 bp, Homo sapiens
  source 1..203: mol_type = other DNA
ggcgcgccagtcctctatcaaggaagaaattgccaaaccatgtctttttttctgttttcagagtagttcacaacagatctgagtgttttaattaagcatggaatacagaaaacaacaaaaaacttaagctttaatttcatctggaattccacagaaccttcggctcgcgtgcttctgagctgctgtggcgactcggaccgatg

SEQ ID NO: 9154 - DNA, 203 bp, Homo sapiens
  source 1..203: mol_type = other DNA
ggcgcgccagtccttgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaaacttgtgcacccgactcggaccgatg

SEQ ID NO: 9155 - DNA, 203 bp, Homo sapiens
  source 1..203: mol_type = other DNA
ggcgcgccagtcctcgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaacgactcggaccgatg

SEQ ID NO: 9156 - DNA, 203 bp, Homo sapiens
  source 1..203: mol_type = other DNA
ggcgcgccagtcctacacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggcgactcggaccgatg

SEQ ID NO: 9157 - DNA, 203 bp, Homo sapiens
  source 1..203: mol_type = other DNA
ggcgcgccagtcctactctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggcgactcggaccgatg

SEQ ID NO: 9158 - DNA, 203 bp, Homo sapiens
  source 1..203: mol_type = other DNA
ggcgcgccagtcctgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgacgactcggaccgatg

SEQ ID NO: 9159 - DNA, 203 bp, Homo sapiens
  source 1..203: mol_type = other DNA
ggcgcgccagtcctaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagcgactcggaccgatg

SEQ ID NO: 9160 - DNA, 203 bp, Homo sapiens
  source 1..203: mol_type = other DNA
ggcgcgccagtcctgcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactacgactcggaccgatg

SEQ ID NO: 9161 - DNA, 203 bp, Homo sapiens
  source 1..203: mol_type = other DNA
ggcgcgccagtcctactctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctccgactcggaccgatg

SEQ ID NO: 9162 - DNA, 203 bp, Homo sapiens
  source 1..203: mol_type = other DNA
ggcgcgccagtcctgcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggcgactcggaccgatg

SEQ ID NO: 9163 - DNA, 203 bp, Homo sapiens
  source 1..203: mol_type = other DNA
ggcgcgccagtcctctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaaccgactcggaccgatg

SEQ ID NO: 9164 - DNA, 203 bp, Homo sapiens
  source 1..203: mol_type = other DNA
ggcgcgccagtccttctgccggcgcctgtccggacccgggcccctctccgctttcggccggcctcgggcaccgggcttctggagctcccggagccctgcctgttccctgtccatccaggccagcagctgaaggagcctcacctgcctcccttctctgagtagcacggatttgaggagaagcagcgaagcgactcggaccgatg

SEQ ID NO: 9165 - DNA, 203 bp, Homo sapiens
  source 1..203: mol_type = other DNA
ggcgcgccagtcctccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatccgactcggaccgatg

SEQ ID NO: 9166 - DNA, 203 bp, Homo sapiens
  source 1..203: mol_type = other DNA
ggcgcgccagtccttcttgagcctaggaggtggaggctgcagtgatctgtgattgtacctttgcactccagcctgggtgacagagcatgacgctgtctctaaaagaataataataataagcattccataaaaattatggaatggagaaatcatgaatggggtctcggaggggaccagaggctgcagtgcgactcggaccgatg

SEQ ID NO: 9167 - DNA, 203 bp, Homo sapiens
  source 1..203: mol_type = other DNA
ggcgcgccagtcctacgcctgcagtccccgcgccgtgcccggaatgcgagctgcacgcagggctctcccaagttcccaccgagccgaataaaaagcgtcctcccgcagctctccgccaaagacggacattgactccaggactccacagaatggagcaagaatgagaggaaaaaggccggcagaaaagccgactcggaccgatg

SEQ ID NO: 9168 - DNA, 203 bp, Homo sapiens
  source 1..203: mol_type = other DNA
ggcgcgccagtcctgtcccaggagactacagcaaacgagtgtatcaaggagtgagagtgaagcatacagtcaaagatctcctggcagaaaaacgatccgggcagacaagtaactcaagacttaatggcagcgtcagttcctctcagtctccatttgtgcagatgccaggttcgccggtcacgtcaggtcgactcggaccgatg

SEQ ID NO: 9169 - DNA, 203 bp, Homo sapiens
  source 1..203: mol_type = other DNA
ggcgcgccagtcctagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggcgactcggaccgatg

SEQ ID NO: 9170 - DNA, 203 bp, Homo sapiens
  source 1..203: mol_type = other DNA
ggcgcgccagtccttaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgaccgactcggaccgatg

SEQ ID NO: 9171 - DNA, 203 bp, Homo sapiens
  source 1..203: mol_type = other DNA
ggcgcgccagtcctccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagcgactcggaccgatg

SEQ ID NO: 9172 - DNA, 203 bp, Homo sapiens
  source 1..203: mol_type = other DNA
ggcgcgccagtcctgggttaaaggtcttgtgatatgtcacaatcccaactaagggcaggacccaggcagaaaaggagagtcacttcctttgatgattggtccagagatacattacaatttcccctgaggacagctctcatgcagaagaggaactgaatatactgcatggctcaggtatctgcagatttcgactcggaccgatg

SEQ ID NO: 9173 - DNA, 203 bp, Homo sapiens
  source 1..203: mol_type = other DNA
ggcgcgccagtcctgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttcttcgactcggaccgatg

SEQ ID NO: 9174 - DNA, 203 bp, Homo sapiens
  source 1..203: mol_type = other DNA
ggcgcgccagtcctcccctcggggaccccctgaggaccctcggattccccccaactcccctgccctctaaaaccacttcaattcctcaactcttcccccggcccgcaggaacccccgccatggcccgttcttacggcggccgggtgctggctgcaatgaccctgctgggcatcgcggcggccgtgctgcgactcggaccgatg

SEQ ID NO: 9175 - DNA, 203 bp, Homo sapiens
  source 1..203: mol_type = other DNA
ggcgcgccagtcctgaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgcccgactcggaccgatg

SEQ ID NO: 9176 - DNA, 203 bp, Homo sapiens
  source 1..203: mol_type = other DNA
ggcgcgccagtcctgctccctccttcacctccccctttggcactgcctgtcacctcctttataaagcctggctcttttatcaccgccacttggccctcactgccgccgccagctctgggctccatggactggtcccgtctgaggtgcccctgaccgtccctgccctcaccccaccccggatcccggcacgactcggaccgatg

SEQ ID NO: 9177 - DNA, 203 bp, Homo sapiens
  source 1..203: mol_type = other DNA
ggcgcgccagtccttgctcctctacctgctctactctcaatccgccagaatcatgggctgctgtggctgttctggaggctgtggctctggctgtgggggctgtggctccggcagtgggggctgtggctctggctgtgggggctgtggctccagctgctgtgtgcccatttgctgctgcaagcctgtgtcgactcggaccgatg

SEQ ID NO: 9178 - DNA, 203 bp, Homo sapiens
  source 1..203: mol_type = other DNA
ggcgcgccagtcctatggagaatagcacagaagtgacagagtttatcctcttgggattaacagatgaccccaatcttcagatacccctcctcctggcatttttattcatctacctcatcaccctgcttgggaatgggggaatgatggtgatcatccactcagactcccatctccacactccaatgtaccgactcggaccgatg

SEQ ID NO: 9179 - DNA, 203 bp, Homo sapiens
  source 1..203: mol_type = other DNA
ggcgcgccagtcctagctctttccactacggctgtattgcactggtgagtccgggcccatggatgagaaattgatgcgaggatcaatacaagcttaatttgaattaataaaaggaaatattttctccctttgaacttatctccgtaaagccattgtgcctcctcttgggggtcacgtgttcacaatcacgactcggaccgatg

SEQ ID NO: 9180 - DNA, 203 bp, Homo sapiens
  source 1..203: mol_type = other DNA
ggcgcgccagtcctagttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaacgactcggaccgatg

SEQ ID NO: 9181 - DNA, 203 bp, Homo sapiens
  source 1..203: mol_type = other DNA
ggcgcgccagtcctatgtggcagaagaatcagacctctctggcagacttcatccttgaggggctcttcgatgactcccttacccaccttttccttttctccttgaccatggtggtcttccttattgcggtgagtggcaacaccctcaccattctcctcatctgcattgatccccagcttcatacaccacgactcggaccgatg

SEQ ID NO: 9182 - DNA, 203 bp, Homo sapiens
  source 1..203: mol_type = other DNA
ggcgcgccagtcctatggcctcccgcagcgcgggcaccctactgaccgagttcaatgccgcctacgtgccccctggactcatgcccgggtaccagggccacgtccccactgtggccttctcctttggcgctccctacggcaccaccaccctcaagtacttccaggaccaccgcaacagagccatggagcgactcggaccgatg

SEQ ID NO: 9183 - DNA, 203 bp, Homo sapiens
  source 1..203: mol_type = other DNA
ggcgcgccagtcctcaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtccgactcggaccgatg

SEQ ID NO: 9184 - DNA, 203 bp, Homo sapiens
  source 1..203: mol_type = other DNA
ggcgcgccagtcctcaatccatctaaatccttctcaattgctgccaccatgactcgttacttctgctgtggaagctacttcccaggataccctatctatgggaccaacttccatgggaccttcagagccacccccttgaactgtgttgtgcctctgggctctcccctgaactatggctgtggatgcaacgactcggaccgatg

SEQ ID NO: 9185 - DNA, 203 bp, Homo sapiens
  source 1..203: mol_type = other DNA
ggcgcgccagtcctggggatctcatttctccccagggggctctaggctgtggatgtgagaaggggagcaagggaggcagatggcgacaaggaacagccccatgcccctgggcacggctcagggtgaccctggagaggcaggaacacggcccggccctgacgccagcctccgggacacaggtgcggccacgactcggaccgatg

SEQ ID NO: 9186 - DNA, 203 bp, Homo sapiens
  source 1..203: mol_type = other DNA
ggcgcgccagtccttgccagcccatggccgagcctgccctcctccccgccgcccagatggagaggctggccccagggcccctagcctcaccgtgtcctcggatcccgcgggcccgcattgccaggcgctgcgcccagcgctgggccgacctgggctgcagctctggcccctcctcaggccgaatggatcgactcggaccgatg

SEQ ID NO: 9187 - DNA, 203 bp, Homo sapiens
  source 1..203: mol_type = other DNA
ggcgcgccagtcctccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcacgactcggaccgatg

SEQ ID NO: 9188 - DNA, 203 bp, Homo sapiens
  source 1..203: mol_type = other DNA
ggcgcgccagtcctatggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgccgactcggaccgatg

SEQ ID NO: 9189 - DNA, 203 bp, Homo sapiens
  source 1..203: mol_type = other DNA
ggcgcgccagtcctagttctgtttctttcctgcgttgatcttggacagtaactgtactatgtaaggaattgtcggtggctggcgacggtatcttagctggttttcagaaaccctcattcctcccttgactgattcaccacttgaacctcatatgacgtagaagaagcctacctatgtccccttcacatcgactcggaccgatg

SEQ ID NO: 9190 - DNA, 203 bp, Homo sapiens
  source 1..203: mol_type = other DNA
ggcgcgccagtcctatggacaacccacaggctctgccactcttcctactcctggcctccttggtagggatcctcaccctcagagcctcttctggacttcagcaaaccaacttctcctctgccttctcttcagactcaaagagctcttcccaggggctgggtgtggaagttccctccatcaaacctccccgactcggaccgatg

SEQ ID NO: 9191 - DNA, 203 bp, Homo sapiens
  source 1..203: mol_type = other DNA
ggcgcgccagtccttcactcactcacacacctcccccagctcacctcctccccactccagcatggccgcctccaccatgtccatctgctccagcgcctgcaccaactcctggcaggtggacgactgcccagagagctgctgtgagctcccctgcggcacccccagctgctgtgccccagccccctgcccgactcggaccgatg

SEQ ID NO: 9192 - DNA, 203 bp, Homo sapiens
  source 1..203: mol_type = other DNA
ggcgcgccagtcctcactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcacgactcggaccgatg

SEQ ID NO: 9193 - DNA, 203 bp, Homo sapiens
  source 1..203: mol_type = other DNA
ggcgcgccagtcctcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtccgactcggaccgatg

SEQ ID NO: 9194 - DNA, 203 bp, Homo sapiens
  source 1..203: mol_type = other DNA
ggcgcgccagtcctagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctcgactcggaccgatg

SEQ ID NO: 9195 - DNA, 203 bp, Homo sapiens
  source 1..203: mol_type = other DNA
ggcgcgccagtcctgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggcccgactcggaccgatg

SEQ ID NO: 9196 - DNA, 203 bp, Homo sapiens
  source 1..203: mol_type = other DNA
ggcgcgccagtcctggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 9197 - DNA, 203 bp, Homo sapiens
  source 1..203: mol_type = other DNA
ggcgcgccagtcctcggactgggaggcagggctctggctcacgcttgtaatcccaacattttgggaggacgaagccagcctcatcgcttaagcacaggagttcgaggactgggaggtggaggttgtggtgcctgtatcacctgcccttctgctgacactcctgcctgctgttcctgactacagccatccgactcggaccgatg

SEQ ID NO: 9198 - DNA, 203 bp, Homo sapiens
  source 1..203: mol_type = other DNA
ggcgcgccagtcctgagattttggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 9199 - DNA, 203 bp, Homo sapiens
  source 1..203: mol_type = other DNA
ggcgcgccagtccttgtattggggctgacaggggggcgggttattagggctgaggatgggaggatgctcagggtattggggtcagggtggcattagcccagctcaagccgggccgggctgactcagcatcctgccccagccagcttccatccctgacacctctgcactcccttgggcagagatgggagcgactcggaccgatg

SEQ ID NO: 9200 - DNA, 203 bp, Homo sapiens
  source 1..203: mol_type = other DNA
ggcgcgccagtcctcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaaccgactcggaccgatg

SEQ ID NO: 9201 - DNA, 203 bp, Homo sapiens
  source 1..203: mol_type = other DNA
ggcgcgccagtcctcgctctgattgtttcgattcttccaaaatcagagacagagtgctcccggtgccatgaacggagacgatgcctttgtacggagacctagggttggttctcaaataccagagaagatgcaaaaggccttcgatgatattgccaaatacttctctgagaaagagtgggaaaagatgacgactcggaccgatg

SEQ ID NO: 9202 - DNA, 203 bp, Homo sapiens
  source 1..203: mol_type = other DNA
ggcgcgccagtcctgactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcagtggcagctcccaagccaggcggcacccgactcggaccgatg

SEQ ID NO: 9203 - DNA, 203 bp, Homo sapiens
  source 1..203: mol_type = other DNA
ggcgcgccagtcctgctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactcgactcggaccgatg

SEQ ID NO: 9204 - DNA, 203 bp, Homo sapiens
  source 1..203: mol_type = other DNA
ggcgcgccagtcctgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctcgactcggaccgatg

SEQ ID NO: 9205 - DNA, 203 bp, Homo sapiens
  source 1..203: mol_type = other DNA
ggcgcgccagtcctggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccgactcggaccgatg

SEQ ID NO: 9206 - DNA, 203 bp, Homo sapiens
  source 1..203: mol_type = other DNA
ggcgcgccagtcctggccgcagtggaaggagcaggcgcttgagctcgagcgacggcgctggcggagacgccggctgctcctcccctccccgccgcttttcctaaaaggattgtacaccttagaagtgcttaaggaagagtgatgaagctctgaatcgtgtcctgcagcagattcgagtgccacccaagcgactcggaccgatg

SEQ ID NO: 9207 - DNA, 203 bp, Homo sapiens
  source 1..203: mol_type = other DNA
ggcgcgccagtcctttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcacccgactcggaccgatg

SEQ ID NO: 9208 - DNA, 203 bp, Homo sapiens
  source 1..203: mol_type = other DNA
ggcgcgccagtcctggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatcgactcggaccgatg

SEQ ID NO: 9209 - DNA, 203 bp, Homo sapiens
  source 1..203: mol_type = other DNA
ggcgcgccagtcctgtcagccggcgctggggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacacgactcggaccgatg

SEQ ID NO: 9210 - DNA, 203 bp, Homo sapiens
  source 1..203: mol_type = other DNA
ggcgcgccagtcctgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagcgactcggaccgatg

SEQ ID NO: 9211 - DNA, 203 bp, Homo sapiens
  source 1..203: mol_type = other DNA
ggcgcgccagtcctacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaacgactcggaccgatg

SEQ ID NO: 9212 - DNA, 203 bp, Homo sapiens
  source 1..203: mol_type = other DNA
ggcgcgccagtcctcagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaacgactcggaccgatg

SEQ ID NO: 9213 - DNA, 203 bp, Homo sapiens
  source 1..203: mol_type = other DNA
ggcgcgccagtcctgggatgagagggagagacaacgtgtgtcttacacatctcccaacagccgacttagatgtgatccgttctcccagagggagcaggtttctttgaacttttcctttttatgtacagcatagtgctgagcagatcactgcactgtgcaggagttttaacgacagtcaggccaacggccgactcggaccgatg

SEQ ID NO: 9214 - DNA, 203 bp, Homo sapiens
  source 1..203: mol_type = other DNA
ggcgcgccagtcctgccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggccgactcggaccgatg

SEQ ID NO: 9215 - DNA, 203 bp, Homo sapiens
  source 1..203: mol_type = other DNA
ggcgcgccagtcctagcatcgcgacccgccccgtcccgtccagtctggcctgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcacgactcggaccgatg

SEQ ID NO: 9216 - DNA, 203 bp, Homo sapiens
  source 1..203: mol_type = other DNA
ggcgcgccagtcctctgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 9217 - DNA, 203 bp, Homo sapiens
  source 1..203: mol_type = other DNA
ggcgcgccagtcctcacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagcgactcggaccgatg

SEQ ID NO: 9218 - DNA, 203 bp, Homo sapiens
  source 1..203: mol_type = other DNA
ggcgcgccagtcctcaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgatccataatgagcgactcggaccgatg

SEQ ID NO: 9219 - DNA, 203 bp, Homo sapiens
  source 1..203: mol_type = other DNA
ggcgcgccagtcctcctactgtagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 9220 - DNA, 203 bp, Homo sapiens
  source 1..203: mol_type = other DNA
ggcgcgccagtccttgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgcgactcggaccgatg

SEQ ID NO: 9221 - DNA, 203 bp, Homo sapiens
  source 1..203: mol_type = other DNA
ggcgcgccagtcctgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggccgactcggaccgatg

SEQ ID NO: 9222 - DNA, 203 bp, Homo sapiens
  source 1..203: mol_type = other DNA
ggcgcgccagtcctttatctcacccgggaggctgtaaaaatctccgtccttaacagtaacaccatcaggtcctatcagttaagagctgcttgttatttgcatgcattcttataattaaatctcctaacaaccctgtaagcaaaattctgtggcatctctggaatactacctgagaatttttgtgtgcccgactcggaccgatg

SEQ ID NO: 9223 - DNA, 203 bp, Homo sapiens
  source 1..203: mol_type = other DNA
ggcgcgccagtcctggacttgccatgaggtgttgaagccttgtttcactgagttggagagactggacctaaatggcgcagcatgactttgctccagcctggcttaatttccctactccaccatcatcaacaaaggtcctgaccagcagtttgaaatcgtcattgaattttgagaagcattctgaaaaccgactcggaccgatg

SEQ ID NO: 9224 - DNA, 203 bp, Homo sapiens
  source 1..203: mol_type = other DNA
ggcgcgccagtcctcactcttcagggagagaatgtggactttagcatttgaactgaatatttgagattgaagatttctgaataatcccccttagcacctctggtactgtaccgtaccttgcctttctgtccaggtttggtggaattgacctatatataaatggtataaagaggggaggtgggaatgaacgactcggaccgatg

SEQ ID NO: 9225 - DNA, 203 bp, Homo sapiens
  source 1..203: mol_type = other DNA
ggcgcgccagtcctgggttatatgatctctttggctttagggaattactccataccagctctgagatttccagctcagcgatgcccccaggtccctgggagagctgcttctgggtggggggcctcattttgtggctcagcgttggaagttcaggggatgcacctcctaccccacagccaaagtgcgctcgactcggaccgatg

SEQ ID NO: 9226 - DNA, 203 bp, Homo sapiens
  source 1..203: mol_type = other DNA
ggcgcgccagtcctagtcccgccctccttgctgtcacaggtgcagcctgtcctctccttcccctgaccagcccagcatccacatagtctacacagagctccccttgctgcccagacaagctgaaggaccacaggaaaagccatggagacttcagcatcctcctcccagcctcaggacaacagtcaagtcgactcggaccgatg

SEQ ID NO: 9227 - DNA, 203 bp, Homo sapiens
  source 1..203: mol_type = other DNA
ggcgcgccagtccttttgtctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcccgactcggaccgatg

SEQ ID NO: 9228 - DNA, 203 bp, Homo sapiens
  source 1..203: mol_type = other DNA
ggcgcgccagtcctttttgcacacacacgaatacaaagagccatacgaccttcggaccctacagcttggggcctgggctcctctgaccatcctcattgagaaaggaaagtgagtccagagaagttgatgcttcctacctgttggagcggcccagcagtgtaagcgtggttgttactgccccatccgcccgactcggaccgatg

SEQ ID NO: 9229 - DNA, 203 bp, Homo sapiens
  source 1..203: mol_type = other DNA
ggcgcgccagtcctgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagccgactcggaccgatg

SEQ ID NO: 9230 - DNA, 203 bp, Homo sapiens
  source 1..203: mol_type = other DNA
ggcgcgccagtcctcccgcaatcctgctccaagagatcttaagctggaggcaccaggtctgaattccagactcctccccaccacccacacttcacctccaactggagcatgaccacagacccattcagggaggctggcggactcttcatcctggacagtcccttactgtatgtcaagtagagctgagacgactcggaccgatg

SEQ ID NO: 9231 - DNA, 203 bp, Homo sapiens
  source 1..203: mol_type = other DNA
ggcgcgccagtcctcctgaagaccccggaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgcgactcggaccgatg

SEQ ID NO: 9232 - DNA, 203 bp, Homo sapiens
  source 1..203: mol_type = other DNA
ggcgcgccagtcctatccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctccgactcggaccgatg

SEQ ID NO: 9233 - DNA, 203 bp, Homo sapiens
  source 1..203: mol_type = other DNA
ggcgcgccagtcctgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtgcgattaaagtgaagaaacaatgcgactcggaccgatg

SEQ ID NO: 9234 - DNA, 203 bp, Homo sapiens
  source 1..203: mol_type = other DNA
ggcgcgccagtcctgagcagcctccggccgccgccgcgcagagctgccagagtggactgcactgcttctcccagcggggcaggatggcggtttcatgtctggttggataaggccttgcctgcggaaaccagctccatccccaggccctagcagaggctcgcgtgtccccgtccccaggtcaggtcaggcgactcggaccgatg

SEQ ID NO: 9235 - DNA, 203 bp, Homo sapiens
  source 1..203: mol_type = other DNA
ggcgcgccagtcctgggacaaggcgtcggttctcgcctgagggccaaaccttgcccctgcccaccttcctcacccccgccatttccaggactcacatccaaaggcgacagcaccaggatttgctcccgcctttggcacagaggaggacgggtccctctctcagcctggccagtctttcccagggcttgcgactcggaccgatg

SEQ ID NO: 9236 - DNA, 203 bp, Homo sapiens
  source 1..203: mol_type = other DNA
ggcgcgccagtcctacatttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctggcgactcggaccgatg

SEQ ID NO: 9237 - DNA, 203 bp, Homo sapiens
  source 1..203: mol_type = other DNA
ggcgcgccagtcctgcctgccccagcagcggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggcgactcggaccgatg

SEQ ID NO: 9238 - DNA, 203 bp, Homo sapiens
  source 1..203: mol_type = other DNA
ggcgcgccagtcctcaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttccccgactcggaccgatg

SEQ ID NO: 9239 - DNA, 203 bp, Homo sapiens
  source 1..203: mol_type = other DNA
ggcgcgccagtcctgagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctccgactcggaccgatg

SEQ ID NO: 9240 - DNA, 203 bp, Homo sapiens
  source 1..203: mol_type = other DNA
ggcgcgccagtcctcgcctcggcctttgagccccgcccccgccgtgcaaaaacaaccagaggctgctctgcttgagggtgaagccgcctcccagttttccctccccctctacccccacccccatagttctctccaccaggtccagtgacaattggatgatgcagccttgataatcatccgattccagacgactcggaccgatg

SEQ ID NO: 9241 - DNA, 203 bp, Homo sapiens
  source 1..203: mol_type = other DNA
ggcgcgccagtcctctcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagaccgactcggaccgatg

SEQ ID NO: 9242 - DNA, 203 bp, Homo sapiens
  source 1..203: mol_type = other DNA
ggcgcgccagtcctaatgttcggggtggcaccagcccactgccacagccccagtccaccatgccacccatgctgtggctgctgctccactttgctgccccggcactggggttctacttttccatcagctgccccagtggtaagcagtgccaacaggccctactctcaggcaatgatattctcctgtatcgactcggaccgatg

SEQ ID NO: 9243 - DNA, 203 bp, Homo sapiens
  source 1..203: mol_type = other DNA
ggcgcgccagtcctcgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagaccgactcggaccgatg

SEQ ID NO: 9244 - DNA, 203 bp, Homo sapiens
  source 1..203: mol_type = other DNA
ggcgcgccagtcctccaaacaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctcgactcggaccgatg

SEQ ID NO: 9245 - DNA, 203 bp, Homo sapiens
  source 1..203: mol_type = other DNA
ggcgcgccagtcctagcaagtccgcggtaagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 9246 - DNA, 203 bp, Homo sapiens
  source 1..203: mol_type = other DNA
ggcgcgccagtccttacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggagggtgggtttctccccagtgtagagggtggcggcggccgactcggaccgatg

SEQ ID NO: 9247 - DNA, 203 bp, Homo sapiens
  source 1..203: mol_type = other DNA
ggcgcgccagtcctccgtctcctggcaaccagatgcaggggccatggcactcttaacaccccagggagtgaaagaagtcttccaatttcagagaccacaaggtcgggagcgcctgcggaggcttctgaactgggaggagtttgacgaacagagagactcccggaggagcatcctgctggacaccctctcgactcggaccgatg

SEQ ID NO: 9248 - DNA, 203 bp, Homo sapiens
  source 1..203: mol_type = other DNA
ggcgcgccagtccttagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccacgactcggaccgatg

SEQ ID NO: 9249 - DNA, 203 bp, Homo sapiens
  source 1..203: mol_type = other DNA
ggcgcgccagtcctctcaagtgactgaagcaggcgccgctgccggggaggaaccgatgggagagaaaggccaggctgggccctgacaccgccaggactccccctccaggaaccagggggcttctcctggaagcttaaaggaaaaaatacttaaattatggtaataagaatgcacctggagctcaagatcgactcggaccgatg

SEQ ID NO: 9250 - DNA, 203 bp, Homo sapiens
  source 1..203: mol_type = other DNA
ggcgcgccagtcctggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctcccgactcggaccgatg

SEQ ID NO: 9251 - DNA, 203 bp, Homo sapiens
  source 1..203: mol_type = other DNA
ggcgcgccagtcctacctgtccaggttctgccggccccagccggaagcttactccgcggattgtgcacagttcttgaaggacttgtgccctggggctgcctggcatctgggggcctcctcagagccagggctctttctggttgaggctgagactcactggtgtcatcaggcccctccatgaatgagaccgactcggaccgatg

SEQ ID NO: 9252 - DNA, 203 bp, Homo sapiens
  source 1..203: mol_type = other DNA
ggcgcgccagtcctggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactcgactcggaccgatg

SEQ ID NO: 9253 - DNA, 203 bp, Homo sapiens
  source 1..203: mol_type = other DNA
ggcgcgccagtcctccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgcgactcggaccgatg

SEQ ID NO: 9254 - DNA, 203 bp, Homo sapiens
  source 1..203: mol_type = other DNA
ggcgcgccagtcctgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacagttgcaaccaaggcacgactcggaccgatg

SEQ ID NO: 9255 - DNA, 203 bp, Homo sapiens
  source 1..203: mol_type = other DNA
ggcgcgccagtcctgccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgcgactcggaccgatg

SEQ ID NO: 9256 - DNA, 203 bp, Homo sapiens
  source 1..203: mol_type = other DNA
ggcgcgccagtcctgccccgtggccacggccccaatcctggccaggcggagattctgcggacattcagggatcggcttcgtcactgagacctcaggcctctgccagccactccccctccccatacccctagtcatcctcggcaggtctcagtcccggctccatctgtgccctcgccccagccgcagctcgactcggaccgatg

SEQ ID NO: 9257 - DNA, 203 bp, Homo sapiens
  source 1..203: mol_type = other DNA
ggcgcgccagtcctaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgcgactcggaccgatg

SEQ ID NO: 9258 - DNA, 203 bp, Homo sapiens
  source 1..203: mol_type = other DNA
ggcgcgccagtcctgggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagcgactcggaccgatg

SEQ ID NO: 9259 - DNA, 203 bp, Homo sapiens
  source 1..203: mol_type = other DNA
ggcgcgccagtcctgcgctggccgctcgcggagggagaggctgcagagcgagggcaggaggactacttccagcaacccagtctcctgccatgtccgaccccatcacgctgaacgtcggggggaagctctatacaacctcactggcgaccctgaccagcttccctgactccatgctaggcgccatgttccgactcggaccgatg

SEQ ID NO: 9260 - DNA, 203 bp, Homo sapiens
  source 1..203: mol_type = other DNA
ggcgcgccagtcctgccaggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccgactcggaccgatg

SEQ ID NO: 9261 - DNA, 203 bp, Homo sapiens
  source 1..203: mol_type = other DNA
ggcgcgccagtcctcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggcgactcggaccgatg

SEQ ID NO: 9262 - DNA, 203 bp, Homo sapiens
  source 1..203: mol_type = other DNA
ggcgcgccagtcctatcttgtctccctctccttacctgcgtcctcgggggcgtgcgcaccaccccccctcccgcctaggaggggggagggccccctcttggccaccgccttcgcggcctttaaactcccctggagactgcggctactgccaccgccttgcctccactgcctcttcgcgcagcacacagcgactcggaccgatg

SEQ ID NO: 9263 - DNA, 203 bp, Homo sapiens
  source 1..203: mol_type = other DNA
ggcgcgccagtcctgttggcagccattttgtgaagagacgaagactgagctgttttggctgcatttctggcctcgagccgcagtcagcttctccccgtagaacccggcagtaggagacttagaatcgaatctcttctccctcccgcctcctgtttttggctttttgagaaaccttatcatccaacacacgactcggaccgatg

SEQ ID NO: 9264 - DNA, 203 bp, Homo sapiens
  source 1..203: mol_type = other DNA
ggcgcgccagtcctagacttcctgcccctgctctgcactctcaggtattccctgctcttactccaaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 9265 - DNA, 203 bp, Homo sapiens
  source 1..203: mol_type = other DNA
ggcgcgccagtcctggctcccatggccctcgggcccagcgtggtgaccccgggggatggagccgttcctcaggaggcggctggccttcctgtccttcttctgggacaagatctggccggcgggcggcgagccggaccatggcacccccgggtccctggaccccaacactgacccagtgcccacgctcccgactcggaccgatg

SEQ ID NO: 9266 - DNA, 203 bp, Homo sapiens
  source 1..203: mol_type = other DNA
ggcgcgccagtcctccaggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgactcggaccgatg

SEQ ID NO: 9267 - DNA, 203 bp, Homo sapiens
  source 1..203: mol_type = other DNA
ggcgcgccagtcctagagtgtctggtgatccctaataaaccagactgtggcctttttaacgagcagacgcccccacgaaggcaggaacctgggcaagtctggcctgcgggtctcctgcctgggacttggaacatgggtgaccttcggaggccagatcaccgatgagatggcagagcagctcatgacctcgactcggaccgatg

SEQ ID NO: 9268 - DNA, 203 bp, Homo sapiens
  source 1..203: mol_type = other DNA
ggcgcgccagtcctggctcaagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggacccgactcggaccgatg

SEQ ID NO: 9269 - DNA, 203 bp, Homo sapiens
  source 1..203: mol_type = other DNA
ggcgcgccagtcctaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactccgactcggaccgatg

SEQ ID NO: 9270 - DNA, 203 bp, Homo sapiens
  source 1..203: mol_type = other DNA
ggcgcgccagtccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggcgactcggaccgatg

SEQ ID NO: 9271 - DNA, 203 bp, Homo sapiens
  source 1..203: mol_type = other DNA
ggcgcgccagtcctcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcgactcggaccgatg

SEQ ID NO: 9272 - DNA, 203 bp, Homo sapiens
  source 1..203: mol_type = other DNA
ggcgcgccagtcctcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtccgactcggaccgatg

SEQ ID NO: 9273 - DNA, 203 bp, Homo sapiens
  source 1..203: mol_type = other DNA
ggcgcgccagtcctgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgcgactcggaccgatg

SEQ ID NO: 9274 - DNA, 203 bp, Homo sapiens
  source 1..203: mol_type = other DNA
ggcgcgccagtcctctcccccagctgccgacgtggggcgggcagccgccggcggctgggagccgaggcgtcggtgcagacctggagacgggcatgggggggctgcggctgctggctgtggccctcacgtgctgctggtggccgcagggcagccagggtaagaccctgcggggcagcttcagcagcacccgactcggaccgatg

SEQ ID NO: 9275 - DNA, 203 bp, Homo sapiens
  source 1..203: mol_type = other DNA
ggcgcgccagtcctggctgcaggcggggccggcgggggcgcagcggcccgggaggaagcagtaccttgaagagaaattggagagggagtcaattcctaggatagcagagagatggacaacagacagaatagatggagtttcacaatggtggccatgtgtctggaattggtgggttcttggtctcactgcgactcggaccgatg

SEQ ID NO: 9276 - DNA, 203 bp, Homo sapiens
  source 1..203: mol_type = other DNA
ggcgcgccagtcctgcaggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcccgactcggaccgatg

SEQ ID NO: 9277 - DNA, 203 bp, Homo sapiens
  source 1..203: mol_type = other DNA
ggcgcgccagtcctggcatttcattgcttcccctgtccttcctttagctgtaactccggcgggcgtgttgggtgtgtcgttttaggctctgtgacccaggagcaagacgcaataagcgggtgcagtggaggtagaaacgggaaatgcagtaccctttccggaagctactccgcccctcgacagagtctcgactcggaccgatg

SEQ ID NO: 9278 - DNA, 203 bp, Homo sapiens
  source 1..203: mol_type = other DNA
ggcgcgccagtcctcctgatcggaggagtgcgggccggagggtgatgggaccatctagcccctaaccatgggcccagaagagaagaccatcatgacagaaaggtctgcagctgttttcatccaggcctggtggcggggcatgctggtgcgacgcacactgctgcatgcagccctcagggcttggatcacgactcggaccgatg

SEQ ID NO: 9279 - DNA, 203 bp, Homo sapiens
  source 1..203: mol_type = other DNA
ggcgcgccagtcctccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggcgactcggaccgatg

SEQ ID NO: 9280 - DNA, 203 bp, Homo sapiens
  source 1..203: mol_type = other DNA
ggcgcgccagtcctcccggcaactttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaacccgactcggaccgatg

SEQ ID NO: 9281 - DNA, 203 bp, Homo sapiens
  source 1..203: mol_type = other DNA
ggcgcgccagtcctggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccggcgactcggaccgatg

SEQ ID NO: 9282 - DNA, 203 bp, Homo sapiens
  source 1..203: mol_type = other DNA
ggcgcgccagtcctcgcacgcgcggttagtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgtcgactcggaccgatg

SEQ ID NO: 9283 - DNA, 203 bp, Homo sapiens
  source 1..203: mol_type = other DNA
ggcgcgccagtcctcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacacccgactcggaccgatg

SEQ ID NO: 9284 - DNA, 203 bp, Homo sapiens
  source 1..203: mol_type = other DNA
ggcgcgccagtcctttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagccgactcggaccgatg

SEQ ID NO: 9285 - DNA, 203 bp, Homo sapiens
  source 1..203: mol_type = other DNA
ggcgcgccagtcctgctgccttccctgtggcatcatgaagtttcgcgccaagatcaccggcaaaggctgtctagagctgttcattcacgtcagcggcaccgtcgcgaggctagcgaaggtctgcgtgctccgcgtgcgccctgacagcctgtgcttcggccccgcgggttccggcggcctccacgaggcgactcggaccgatg

SEQ ID NO: 9286 - DNA, 203 bp, Homo sapiens
  source 1..203: mol_type = other DNA
ggcgcgccagtcctccctagctctgggccgcgcctcacatccctcccagagccgcaacaccccacccggcgggacgccctcgagcagccgctcgttgcgggcctgaagcgcagagcgcctattggccagagcggccgagggcgggaaaagtggccaacggctgcctcggccctcgggctgctgaggagcgactcggaccgatg

SEQ ID NO: 9287 - DNA, 203 bp, Homo sapiens
  source 1..203: mol_type = other DNA
ggcgcgccagtcctgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtggagagatggaaccgccatgatcagcgactcggaccgatg

SEQ ID NO: 9288 - DNA, 203 bp, Homo sapiens
  source 1..203: mol_type = other DNA
ggcgcgccagtcctgacgcggagcccggcgctgagccctgcgcgcgcgcctgcgggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagcgactcggaccgatg

SEQ ID NO: 9289 - DNA, 203 bp, Homo sapiens
  source 1..203: mol_type = other DNA
ggcgcgccagtcctagatgggacagcttggcctacagcccggcgggcatcagctcccttgacccagtggatatcggtggccccgttattcgtccaggtgcccagggaggaggacccgcctgcagcatgaacctgtggctcctggcctgcctggtggccggcttcctgggagcctgggcccccgctgtccgactcggaccgatg

SEQ ID NO: 9290 - DNA, 203 bp, Homo sapiens
  source 1..203: mol_type = other DNA
ggcgcgccagtcctggaagctggggacagccactcgctcgggagcagcctgagcgtttcctctccgcgtactcgagggaactctctccacgcgttcgagggaacccggaaggggccaggcgggtgagtgcggagggaagcccttgtgccatctgggagtagagccgccgagtcaggagttttagggcccgactcggaccgatg

SEQ ID NO: 9291 - DNA, 203 bp, Homo sapiens
  source 1..203: mol_type = other DNA
ggcgcgccagtcctgtgggggcgggctcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgcgactcggaccgatg

SEQ ID NO: 9292 - DNA, 203 bp, Homo sapiens
  source 1..203: mol_type = other DNA
ggcgcgccagtcctgcattggtccagtctgggttgaccccgacccgaagtggccctttccttcgcgtcctgaacttcgcttctccgtcggtgtctggtctcttcccgccggcgggctctgcggtggcgggaggagctgtactactcgtgccttagcgcacccttactttcccaggccagaaacgcgaacgactcggaccgatg

SEQ ID NO: 9293 - DNA, 203 bp, Homo sapiens
  source 1..203: mol_type = other DNA
ggcgcgccagtccttggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccacccgactcggaccgatg

SEQ ID NO: 9294 - DNA, 203 bp, Homo sapiens
  source 1..203: mol_type = other DNA
ggcgcgccagtcctaggatccgggctggaagcctctcggagtgctgcctccagccaaggggcggccggcgagtcccagtgagagcggagggtgccagaggtagggggccgagaaacaaagttcccggggcttcctccggggccgcggtcggggctgcgcgtttgaccgcccccctcctcgcgaaggcacgactcggaccgatg

SEQ ID NO: 9295 - DNA, 203 bp, Homo sapiens
  source 1..203: mol_type = other DNA
ggcgcgccagtcctcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagcgactcggaccgatg

SEQ ID NO: 9296 - DNA, 203 bp, Homo sapiens
  source 1..203: mol_type = other DNA
ggcgcgccagtcctcgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggcgactcggaccgatg

SEQ ID NO: 9297 - DNA, 203 bp, Homo sapiens
  source 1..203: mol_type = other DNA
ggcgcgccagtccttgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtccgactcggaccgatg

SEQ ID NO: 9298 - DNA, 203 bp, Homo sapiens
  source 1..203: mol_type = other DNA
ggcgcgccagtcctgcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctcgactcggaccgatg

SEQ ID NO: 9299 - DNA, 203 bp, Homo sapiens
  source 1..203: mol_type = other DNA
ggcgcgccagtcctaagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtcgactcggaccgatg

SEQ ID NO: 9300 - DNA, 203 bp, Homo sapiens
  source 1..203: mol_type = other DNA
ggcgcgccagtcctggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgccgactcggaccgatg

SEQ ID NO: 9301 - DNA, 203 bp, Homo sapiens
  source 1..203: mol_type = other DNA
ggcgcgccagtcctaaaaccttgaggtgattcatcttccaggctctccttccatcaagtctctcctccctagcgctctgggtccttaatggcagcagccgccgctaccaagatccttctgtgcctcccgcttctgctcctgctgtccggctggtcccgggctgggcgagccgaccctcactctctttgcgactcggaccgatg

SEQ ID NO: 9302 - DNA, 203 bp, Homo sapiens
  source 1..203: mol_type = other DNA
ggcgcgccagtcctttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgcgactcggaccgatg

SEQ ID NO: 9303 - DNA, 203 bp, Homo sapiens
  source 1..203: mol_type = other DNA
ggcgcgccagtcctcctacgcggaactctctcgcggtaattcgaagtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagacgactcggaccgatg

SEQ ID NO: 9304 - DNA, 203 bp, Homo sapiens
  source 1..203: mol_type = other DNA
ggcgcgccagtcctcggctctcccacgtctacacccatcacctccagcctgagggcgcaactgagaggaactgagacccaagcagctcagtaaaggccccgcggcgagggcatcggctctcgccggcggatgacgagctgtatcagcggacgcgcatctctctgctgcaacgcgaggccgctcaggcacgactcggaccgatg

SEQ ID NO: 9305 - DNA, 203 bp, Homo sapiens
  source 1..203: mol_type = other DNA
ggcgcgccagtcctgccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatcgactcggaccgatg

SEQ ID NO: 9306 - DNA, 203 bp, Homo sapiens
  source 1..203: mol_type = other DNA
ggcgcgccagtcctcgggggcgggacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggcgactcggaccgatg

SEQ ID NO: 9307 - DNA, 203 bp, Homo sapiens
  source 1..203: mol_type = other DNA
ggcgcgccagtcctaccattagtacctaggaggcagggatcagaggaagtagattcagaggtaaggagaattttggggctatactttcaagaaagtcgtgttcgggacccaggaggtatgggtcagaaggaaaggagcacagcagatactctgccggatctggaggaatggaagtcagcggcgggtctcgactcggaccgatg

SEQ ID NO: 9308 - DNA, 203 bp, Homo sapiens
  source 1..203: mol_type = other DNA
ggcgcgccagtcctgagcctgagggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctgcgactcggaccgatg

SEQ ID NO: 9309 - DNA, 203 bp, Homo sapiens
  source 1..203: mol_type = other DNA
ggcgcgccagtcctggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccacgactcggaccgatg

SEQ ID NO: 9310 - DNA, 203 bp, Homo sapiens
  source 1..203: mol_type = other DNA
ggcgcgccagtcctgtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaacgactcggaccgatg

SEQ ID NO: 9311 - DNA, 203 bp, Homo sapiens
  source 1..203: mol_type = other DNA
ggcgcgccagtcctgcggggaagtggcggctgaagcgccgccggcggggctcactgtggtggtgtgagtgggaggcggcggcgctggtggctgcagctggggtgaggcgcgaggcggcgcactcgacggctgactggagcagcggatataagtcaaagagtacagcagaaaatgtctactgaagggaccgactcggaccgatg

SEQ ID NO: 9312 - DNA, 203 bp, Homo sapiens
  source 1..203: mol_type = other DNA
ggcgcgccagtcctgctctcctttcccgaacctcccggggtgcagcctagagccctcccgcgcggctgactccagagtagaggaagggaggcggcctccggctggtcccccgaagccctcgctgccccgcagatgcggatggccagccagtagcgggcggtggccccgcgtcccgggagcgcacagcacgactcggaccgatg

SEQ ID NO: 9313 - DNA, 203 bp, Homo sapiens
  source 1..203: mol_type = other DNA
ggcgcgccagtcctcgagcgtgtcgctcccagtgcgcaagtgcagcaggtggctgcacggggggcgcgggaggaggaggaggaggaggaggaggctggggtggggccggcggcaagtgctgtgatgcggttccggggaggggccgtcgggtagaggctgaataccagtttccgagcggcaaggcagcgcgactcggaccgatg

SEQ ID NO: 9314 - DNA, 203 bp, Homo sapiens
  source 1..203: mol_type = other DNA
ggcgcgccagtcctgacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagcgactcggaccgatg

SEQ ID NO: 9315 - DNA, 203 bp, Homo sapiens
  source 1..203: mol_type = other DNA
ggcgcgccagtcctctgggaaccggcgggagggcgcctcctcctcccccgccctctctgctgaggatggaagtgacgaaagcagccgaggaggtcacttcctgctggggtggatgaggaggagccggagacgccgcggaggagacgggaccgaagagggaccgtgccgggaagagcaggcgggtgaaacgactcggaccgatg

SEQ ID NO: 9316 - DNA, 203 bp, Homo sapiens
  source 1..203: mol_type = other DNA
ggcgcgccagtcctgcgcacgcacgcccaggggagttggggttcgcagggggttgttttcggctctgaagaggtccccgcccaaccttcaaaattctgtccaaaagcagacaagaggatcgccccgcgctgagccggctggtgggcagcaggaggcgcctgatcgccgccggggcgctgggggtggtgcgactcggaccgatg

SEQ ID NO: 9317 - DNA, 203 bp, Homo sapiens
  source 1..203: mol_type = other DNA
ggcgcgccagtcctgtctggtccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttccgactcggaccgatg

SEQ ID NO: 9318 - DNA, 203 bp, Homo sapiens
  source 1..203: mol_type = other DNA
ggcgcgccagtcctaagtaagatggcggcgaacgcacttccggcgtgtgtccttacgggtgcgtccgggcggctgcttgcaggtgccacccagcgggttccagcttgtttgctgcatagattacaacggtgatggcgggcaaggggtccggctggagccgggcggctctcctccagctccttctcggccgactcggaccgatg

SEQ ID NO: 9319 - DNA, 203 bp, Homo sapiens
  source 1..203: mol_type = other DNA
ggcgcgccagtcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgcgactcggaccgatg

SEQ ID NO: 9320 - DNA, 203 bp, Homo sapiens
  source 1..203: mol_type = other DNA
ggcgcgccagtcctatgtggccggccggcgcgggcaccaagctgccctgtccccgagactctgcgctccggcgggcggctttctctgggaacctcacggccctgccctctcacctcgtgcccgccggccgcagcgtccgggtcttcatcagcgccaaccctgaagatacgggagcagaaagacaggcgcgactcggaccgatg

SEQ ID NO: 9321 - DNA, 203 bp, Homo sapiens
  source 1..203: mol_type = other DNA
ggcgcgccagtcctggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagcgactcggaccgatg

SEQ ID NO: 9322 - DNA, 203 bp, Homo sapiens
  source 1..203: mol_type = other DNA
ggcgcgccagtcctcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagcccgactcggaccgatg

SEQ ID NO: 9323 - DNA, 203 bp, Homo sapiens
  source 1..203: mol_type = other DNA
ggcgcgccagtcctgtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggcccgactcggaccgatg

SEQ ID NO: 9324 - DNA, 203 bp, Homo sapiens
  source 1..203: mol_type = other DNA
ggcgcgccagtcctatggcatgggagaatcagaccttcaactctgacttcatcctcctgggaatcttcaatcacagccccacccacaccttcctcttctttctggtcctggccatcttttcagtggccttcatgggaaactctgtcatggttctcctcatctacctggacacccagctccacaccccccgactcggaccgatg

SEQ ID NO: 9325 - DNA, 203 bp, Homo sapiens
  source 1..203: mol_type = other DNA
ggcgcgccagtccttgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagacgactcggaccgatg

SEQ ID NO: 9326 - DNA, 203 bp, Homo sapiens
  source 1..203: mol_type = other DNA
ggcgcgccagtcctggggtctacggcctaggggccggggaagtttgcgccgccgcgaccagtgctgcgatcccgagccgggctccagccccgaggaccaggggtcgggcgggcctgcctacggaaccccgcgggccagcagcagtcgtctcgcgtcctcctgcttggaaaagtgtttaagcttctaaacgactcggaccgatg

SEQ ID NO: 9327 - DNA, 203 bp, Homo sapiens
  source 1..203: mol_type = other DNA
ggcgcgccagtccttcagccgaggggctgttggggaactctctgcaggcacagggcacctggtgactgggaagcttctgtttgtgtggacttcttgggaacagcgtcctggtgtgggccaggaggagaggactggagcaccccaggctctgacttcgtgctcctgggatcgtggtgcattgcctggcccgactcggaccgatg

SEQ ID NO: 9328 - DNA, 203 bp, Homo sapiens
  source 1..203: mol_type = other DNA
ggcgcgccagtccttcagggcttcccctttcttggtcatcgatccctagagctctggctctttctcttcttggggaactgcttaacgtctacagcaaggcctaataggggacctgagggcacagtcctcaggatgtttcggggagaataggagccagaacctgagcccctaagccattcccctcaccacgactcggaccgatg

SEQ ID NO: 9329 - DNA, 203 bp, Homo sapiens
  source 1..203: mol_type = other DNA
ggcgcgccagtcctgggaccccatttctgtgctcatctgcctccttggcaatataaagagcaagcactgaggccccgcctcagagcaccccaaacttgacgccatgaagatcccggtccttcctgccgtggtgctcctctccctcctggtgctccactctgcccagggagccaccctgggtggtcctgcgactcggaccgatg

SEQ ID NO: 9330 - DNA, 203 bp, Homo sapiens
  source 1..203: mol_type = other DNA
ggcgcgccagtcctcaggtcttggaagaggctgggggtcccggccttgtgccttacctgcgcccggaggtcgcctccttcttgggagaggatggggacgtggcatagccacccacgcgccgcgggggtcccgagccattaaggggcgtcctggtgggaaggcctttcaagagctgacacactggagggcgactcggaccgatg

SEQ ID NO: 9331 - DNA, 203 bp, Homo sapiens
  source 1..203: mol_type = other DNA
ggcgcgccagtccttcgtgaagatagagatggggtttcaccatgttgcccaggctggtcttgaactcagggtccaaacgatccacctaccttggcctcccaacgtgccaggattacaggcatgagccaccacacctggtccatcttgataatttcatactctggcttggcaaagactgaagggaagcccgactcggaccgatg

SEQ ID NO: 9332 - DNA, 203 bp, Homo sapiens
  source 1..203: mol_type = other DNA
ggcgcgccagtcctatttgtcaaactgaagaaacccctgaagaagcagtggtgggcaggcgccgacgctgcggcttccagagcattttggcaaatcaaagccagggaccgttgctgggcctcatttccgcaacttttcggctccgaactgcttctttgacttagaagatatcttatcctgccgttgtacgactcggaccgatg

SEQ ID NO: 9333 - DNA, 203 bp, Homo sapiens
  source 1..203: mol_type = other DNA
ggcgcgccagtccttcccggggctacgaggcggaagcgaaggcagacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgactcggaccgatg

SEQ ID NO: 9334 - DNA, 203 bp, Homo sapiens
  source 1..203: mol_type = other DNA
ggcgcgccagtcctctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactccgactcggaccgatg

SEQ ID NO: 9335 - DNA, 203 bp, Homo sapiens
  source 1..203: mol_type = other DNA
ggcgcgccagtcctatgcgctccgagggtgcggcccccgggccggcggcgccgctgtgcggggcgctgagcctgctgctgggcgcgctgctgggcaaagtgatagagggtcacggggtcacagacaacatacagagattctcctcactgccaccttacctacctgtgagctaccacatcctcagagcacgactcggaccgatg

SEQ ID NO: 9336 - DNA, 203 bp, Homo sapiens
  source 1..203: mol_type = other DNA
ggcgcgccagtcctttattctggacagttactcttaagaaagttgtcagaagaaacgcatctgcctttttttccaggtgaactgccgtgagttgtccagcatgatagtgtttattttcttggctatggggttaagcttggaaaatgaatacacttcccaaaccaataattgcacatatttaagagagccgactcggaccgatg

SEQ ID NO: 9337 - DNA, 203 bp, Homo sapiens
  source 1..203: mol_type = other DNA
ggcgcgccagtccttggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtatcgactcggaccgatg

SEQ ID NO: 9338 - DNA, 203 bp, Homo sapiens
  source 1..203: mol_type = other DNA
ggcgcgccagtcctaactccggctacgggggcccgaagggaccgtgaggcgcagatttgagccgctgttgagatgattcctttccgttcgcggaagagatggggaaactgagggccgcccagtatgcttgctctcttcttggccatgcgctgcagaggcatggagccagtcctgagttacagaaacagcgactcggaccgatg

SEQ ID NO: 9339 - DNA, 203 bp, Homo sapiens
  source 1..203: mol_type = other DNA
ggcgcgccagtcctagttgaaacatcctcctacactggagctttataaatattttaaagacaaggattggattagatttgacattagaaatgtaccataatacagaaggcaatggacacctaaagaacagaatgaaaaccttcttaggaaatgaagcttgacacttcacccaccaggccaccacaagacgactcggaccgatg

SEQ ID NO: 9340 - DNA, 203 bp, Homo sapiens
  source 1..203: mol_type = other DNA
ggcgcgccagtcctgatgctgcgggctggtacattccccacttgcaaaactctgtggggctgggttcctctcttttctttccaaatatcccaggaagtggatggttttatccaaattcagcagacgagtaaaaagagtcttcgggaggtgcaatagctttctaggaatgaggatattcttcaaggaaacgactcggaccgatg

SEQ ID NO: 9341 - DNA, 203 bp, Homo sapiens
  source 1..203: mol_type = other DNA
ggcgcgccagtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggcccgactcggaccgatg

SEQ ID NO: 9342 - DNA, 203 bp, Homo sapiens
  source 1..203: mol_type = other DNA
ggcgcgccagtcctcacgcggggcccagctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggaccgactcggaccgatg

SEQ ID NO: 9343 - DNA, 203 bp, Homo sapiens
  source 1..203: mol_type = other DNA
ggcgcgccagtcctgcctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtcgactcggaccgatg

SEQ ID NO: 9344 - DNA, 203 bp, Homo sapiens
  source 1..203: mol_type = other DNA
ggcgcgccagtcctgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcagcgactcggaccgatg

SEQ ID NO: 9345 - DNA, 203 bp, Homo sapiens
  source 1..203: mol_type = other DNA
ggcgcgccagtcctatataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtggccaatggcatcgaggtctaccgactcggaccgatg

SEQ ID NO: 9346 - DNA, 203 bp, Homo sapiens
  source 1..203: mol_type = other DNA
ggcgcgccagtcctgctggtcctatcccactgggaccgtcgctgccactcagccagagagccagcatcttggcaagggctgggcctggagtgaagctggaagggctagcatggagagcctgtcacctgggggaccacctggccacccttaccagggggaggcctctacctgctggcagctcacagtgacgactcggaccgatg

SEQ ID NO: 9347 - DNA, 203 bp, Homo sapiens
  source 1..203: mol_type = other DNA
ggcgcgccagtcctattgcagaagcctatgagttgattaattctaacaactggatactgtggtttagggcttggaagatgaaaaggaggcctctgagaatgaaacagacatggaagaccccagagaaatccagactgattcttggcgtaaacggggagagagcgaggaaccgtcatctcctcagtccccgactcggaccgatg

SEQ ID NO: 9348 - DNA, 203 bp, Homo sapiens
  source 1..203: mol_type = other DNA
ggcgcgccagtcctatggttgagcccttcttgggaacctggaagctggtctccagtgaaaactttgaggattacatgaaagaactgggagtgaatttcgcagcccggaacatggcagggttagtgaaaccgacagtaactattagtgttgatgggaaaatgatgaccataagaacagaaagttctttccgactcggaccgatg

SEQ ID NO: 9349 - DNA, 203 bp, Homo sapiens
  source 1..203: mol_type = other DNA
ggcgcgccagtcctgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagacgactcggaccgatg

SEQ ID NO: 9350 - DNA, 203 bp, Homo sapiens
  source 1..203: mol_type = other DNA
ggcgcgccagtcctgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgacgactcggaccgatg

SEQ ID NO: 9351 - DNA, 203 bp, Homo sapiens
  source 1..203: mol_type = other DNA
ggcgcgccagtcctgactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggacgactcggaccgatg

SEQ ID NO: 9352 - DNA, 203 bp, Homo sapiens
  source 1..203: mol_type = other DNA
ggcgcgccagtcctgggaatatgagtgatggtgcctcaaagcagtaactttttgcttagagcttgagagtcaaagttaaggacccacatgtatacttcggctctagcgagtctaaggatgataatatggatacaaaatctattctagaagaacttcttctcaaaagatcacagcaaaagaagaaaatgcgactcggaccgatg

SEQ ID NO: 9353 - DNA, 203 bp, Homo sapiens
  source 1..203: mol_type = other DNA
ggcgcgccagtcctccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgactcggaccgatg

SEQ ID NO: 9354 - DNA, 203 bp, Homo sapiens
  source 1..203: mol_type = other DNA
ggcgcgccagtcctctgtgggtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctcgactcggaccgatg

SEQ ID NO: 9355 - DNA, 203 bp, Homo sapiens
  source 1..203: mol_type = other DNA
ggcgcgccagtcctcagaggagaaggggaggaacaggaagcctccagctagtcgtttggaatctggcaaccatttctgtcagctttctcattcctagattgatgcagattgcttaattccttgagcttaaccagctcgaaaaagcagtggaagcagctcacacatttttcgtggctaaccctgagcaccgactcggaccgatg

SEQ ID NO: 9356 - DNA, 203 bp, Homo sapiens
  source 1..203: mol_type = other DNA
ggcgcgccagtcctatcctcagtctcccagttcaagctaatcattgacagagctttacaatcacaagcttttactgaagctttgataagacagtccagcagttggtggcaaatgaagccaggctgtgcggcaggatctccagggaatgaatggattttcttcagcactgatgaaataaccacacgctacgactcggaccgatg

SEQ ID NO: 9357 - DNA, 203 bp, Homo sapiens
  source 1..203: mol_type = other DNA
ggcgcgccagtcctgacaaagacctgcgccggcgcgcgggactctgcgtgaggcgagcgccggggctcccggagcggatccctacctgtttcaaggacctgccagtctgagaagcttcttgtcataaggccatccaggggccacgcacccctaccttgccagcctccagcatgcaggataccgtaacgcgactcggaccgatg

SEQ ID NO: 9358 - DNA, 203 bp, Homo sapiens
  source 1..203: mol_type = other DNA
ggcgcgccagtcctcctgtgagctccacctgccccagttctcctggctttaacccctccttggccaaggccagggttgcctgcgggagccaggtgtccgctctccacacctttcacagccccagccctcagagcaacctcagcccagcccagcccagctccagctccagctccagcccgggccccatccgactcggaccgatg

SEQ ID NO: 9359 - DNA, 203 bp, Homo sapiens
  source 1..203: mol_type = other DNA
ggcgcgccagtcctaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagaccccgactcggaccgatg

SEQ ID NO: 9360 - DNA, 203 bp, Homo sapiens
  source 1..203: mol_type = other DNA
ggcgcgccagtcctagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccaccgactcggaccgatg

SEQ ID NO: 9361 - DNA, 203 bp, Homo sapiens
  source 1..203: mol_type = other DNA
ggcgcgccagtcctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggccgactcggaccgatg

SEQ ID NO: 9362 - DNA, 203 bp, Homo sapiens
  source 1..203: mol_type = other DNA
ggcgcgccagtcctagcctcagccttgcctctccccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggcccgactcggaccgatg

SEQ ID NO: 9363 - DNA, 203 bp, Homo sapiens
  source 1..203: mol_type = other DNA
ggcgcgccagtccttagagaggaggttcacaaacacccacgtagctgcagccacttatcactgcacctcttgccaaagtgcggtccacatacgtgcaatgagaaaggattaaagggacttgtttgataacacacgcaaaactatatttcctttggcttcaaagctctctcaccatattttgggaagttcgactcggaccgatg

SEQ ID NO: 9364 - DNA, 203 bp, Homo sapiens
  source 1..203: mol_type = other DNA
ggcgcgccagtcctatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaaccgactcggaccgatg

SEQ ID NO: 9365 - DNA, 203 bp, Homo sapiens
  source 1..203: mol_type = other DNA
ggcgcgccagtcctagccgcgggtacccctcgctggtccgctgggctgccgtccagcgggagagacaaaagtcgcaagggaaggggaaaaacgaactgagtttgtgtcactgtcttggtggacttttcgagctaacctgtatttgagaaaaacttcagtctcttgggaaaggagaggcagtgacaaaacgactcggaccgatg

SEQ ID NO: 9366 - DNA, 203 bp, Homo sapiens
  source 1..203: mol_type = other DNA
ggcgcgccagtcctgtacttcatagactttatcatacttcgtagcatccagtatgttttctttgctaagattattgattttgtattgaagggtcccatgtccatcgttttcaatgctttatctccagggttggagcatgcctgctgtggcagaggtaaaacttcgagatgatcaatatacactggaaccgactcggaccgatg

SEQ ID NO: 9367 - DNA, 203 bp, Homo sapiens
  source 1..203: mol_type = other DNA
ggcgcgccagtcctcctgaagaggggggaaaggcatttctgtgctcttcctggtaaagtgtttgaaaatgaacattcagaagaaaacctaaagcacctgaaatgcacaggggacgagaatgagagctgaacaaaaggttcatcctcagttttctccatgcccatgggaagctgtttacccggattgggcgactcggaccgatg

SEQ ID NO: 9368 - DNA, 203 bp, Homo sapiens
  source 1..203: mol_type = other DNA
ggcgcgccagtcctatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttcgactcggaccgatg

SEQ ID NO: 9369 - DNA, 203 bp, Homo sapiens
  source 1..203: mol_type = other DNA
ggcgcgccagtcctttcatggtgactgggacgagtaggtttcactgtttctcataggagacttgacagcttaaagtaaaaacaaattattttcgtcaaagtttttttttttctcttaactgatttttagcaaacctcagactgagacacaggactcaacggtgtattcctggaaggcaaggtgctatacgactcggaccgatg

SEQ ID NO: 9370 - DNA, 203 bp, Homo sapiens
  source 1..203: mol_type = other DNA
ggcgcgccagtcctaatgaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagccgactcggaccgatg

SEQ ID NO: 9371 - DNA, 203 bp, Homo sapiens
  source 1..203: mol_type = other DNA
ggcgcgccagtcctagcctgtgcaagtgatttgggagaggaaggggagatgatgtaactggttcggcatgttcccgtcttggccaacatgccttgaattggaacgctacctacagacggagccccggaggatctcagagacctttggtgaggacttggactgtttcctccacgcttcccctcccccgtcgactcggaccgatg

SEQ ID NO: 9372 - DNA, 203 bp, Homo sapiens
  source 1..203: mol_type = other DNA
ggcgcgccagtcctgacttctgccctctaaagactaaggcctaattccactggtttctttgaattccgtggtcctaagtccattttcagacaaagtttctgtggaaagacctacggacaaagacatctctccttggcagagtgagctaggattaccagctcttcagccgcagctgaaggcgggagtcccgactcggaccgatg

SEQ ID NO: 9373 - DNA, 203 bp, Homo sapiens
  source 1..203: mol_type = other DNA
ggcgcgccagtcctcaccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactcgactcggaccgatg

SEQ ID NO: 9374 - DNA, 203 bp, Homo sapiens
  source 1..203: mol_type = other DNA
ggcgcgccagtcctatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagccgactcggaccgatg

SEQ ID NO: 9375 - DNA, 203 bp, Homo sapiens
  source 1..203: mol_type = other DNA
ggcgcgccagtcctacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagcccgactcggaccgatg

SEQ ID NO: 9376 - DNA, 203 bp, Homo sapiens
  source 1..203: mol_type = other DNA
ggcgcgccagtcctcagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaaccgactcggaccgatg

SEQ ID NO: 9377 - DNA, 203 bp, Homo sapiens
  source 1..203: mol_type = other DNA
ggcgcgccagtcctatgcctggtcagaactacagaaccatatctgaatttatcctctctggcttctcagccttcccccagcagctcctgcctgtcttgttcctgctgtacctcctgatgttcctgttcacattgcttggcaaccttcttatcatggccacagtttggattgaacgcagactccacacacgactcggaccgatg

SEQ ID NO: 9378 - DNA, 203 bp, Homo sapiens
  source 1..203: mol_type = other DNA
ggcgcgccagtcctatgccccaaattcttatattcacatacctgaatatgttttacttctttccccctttgcagatcttggcagaaaacctcaccatggtcaccgaattcctgttgctgggtttttccagccttggtgaaattcagctggccctctttgtagtttttctttttctgtatctagtcattcgactcggaccgatg

SEQ ID NO: 9379 - DNA, 203 bp, Homo sapiens
  source 1..203: mol_type = other DNA
ggcgcgccagtcctatgggggatgtgaatcagtcggtggcctcagacttcattctggtgggcctcttcagtcactcaggatcacgccagctcctcttctccctggtggctgtcatgtttgtcataggccttctgggcaacaccgttcttctcttcttgatccgtgtggactcccggctccatacaccccgactcggaccgatg

SEQ ID NO: 9380 - DNA, 203 bp, Homo sapiens
  source 1..203: mol_type = other DNA
ggcgcgccagtcctatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtaccgactcggaccgatg

SEQ ID NO: 9381 - DNA, 203 bp, Homo sapiens
  source 1..203: mol_type = other DNA
ggcgcgccagtcctatgttcctttacctttgcttcatttttcagaggacatgcagtgaggagatggaagaggaaaatgcaacattgctgacagagtttgttctcacaggatttttacatcaacctgactgtaaaataccgctcttcctggcattcttggtaatatatctcatcaccatcatggggaatcgactcggaccgatg

SEQ ID NO: 9382 - DNA, 203 bp, Homo sapiens
  source 1..203: mol_type = other DNA
ggcgcgccagtcctactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcgactcggaccgatg

SEQ ID NO: 9383 - DNA, 203 bp, Homo sapiens
  source 1..203: mol_type = other DNA
ggcgcgccagtcctatgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgccgactcggaccgatg

SEQ ID NO: 9384 - DNA, 203 bp, Homo sapiens
  source 1..203: mol_type = other DNA
ggcgcgccagtcctgcagacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagagcgactcggaccgatg

SEQ ID NO: 9385 - DNA, 203 bp, Homo sapiens
  source 1..203: mol_type = other DNA
ggcgcgccagtcctcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccacccgactcggaccgatg

SEQ ID NO: 9386 - DNA, 203 bp, Homo sapiens
  source 1..203: mol_type = other DNA
ggcgcgccagtccttcaatcgccttttatctctggccctgggacctttgcctattttctgattgataggctttgttttgtctttacctccttctttctggggaaaacttcagttttatcgcacgttccccttttccatatcttcatcttccctctacccagattgtgaagatggaaagggtccaaccccgactcggaccgatg

SEQ ID NO: 9387 - DNA, 203 bp, Homo sapiens
  source 1..203: mol_type = other DNA
ggcgcgccagtccttaggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgcgactcggaccgatg

SEQ ID NO: 9388 - DNA, 203 bp, Homo sapiens
  source 1..203: mol_type = other DNA
ggcgcgccagtcctaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagggccgactcggaccgatg

SEQ ID NO: 9389 - DNA, 203 bp, Homo sapiens
  source 1..203: mol_type = other DNA
ggcgcgccagtcctgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggcgactcggaccgatg

SEQ ID NO: 9390 - DNA, 203 bp, Homo sapiens
  source 1..203: mol_type = other DNA
ggcgcgccagtcctcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatccgactcggaccgatg

SEQ ID NO: 9391 - DNA, 203 bp, Homo sapiens
  source 1..203: mol_type = other DNA
ggcgcgccagtccttggtcatctcagttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaaccgactcggaccgatg

SEQ ID NO: 9392 - DNA, 203 bp, Homo sapiens
  source 1..203: mol_type = other DNA
ggcgcgccagtcctgagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgacccgactcggaccgatg

SEQ ID NO: 9393 - DNA, 203 bp, Homo sapiens
  source 1..203: mol_type = other DNA
ggcgcgccagtcctaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagcccgactcggaccgatg

SEQ ID NO: 9394 - DNA, 203 bp, Homo sapiens
  source 1..203: mol_type = other DNA
ggcgcgccagtcctgagtctagtctttgttcggggctgtccaaaggacgctagctgttgcacctgttcctccctgcgcgtaagatagaggataaatctcctggcaaagcccagaatgaccacagccctggaacctgaggaccaaaaaggacttctgataattaaggcagaggaccattactggggacacgactcggaccgatg

SEQ ID NO: 9395 - DNA, 203 bp, Homo sapiens
  source 1..203: mol_type = other DNA
ggcgcgccagtcctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggcgactcggaccgatg

SEQ ID NO: 9396 - DNA, 203 bp, Homo sapiens
  source 1..203: mol_type = other DNA
ggcgcgccagtcctgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagaccgactcggaccgatg

SEQ ID NO: 9397 - DNA, 203 bp, Homo sapiens
  source 1..203: mol_type = other DNA
ggcgcgccagtcctcgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgcgactcggaccgatg

SEQ ID NO: 9398 - DNA, 203 bp, Homo sapiens
  source 1..203: mol_type = other DNA
ggcgcgccagtcctggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctcgactcggaccgatg

SEQ ID NO: 9399 - DNA, 203 bp, Homo sapiens
  source 1..203: mol_type = other DNA
ggcgcgccagtcctctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataacgactcggaccgatg

SEQ ID NO: 9400 - DNA, 203 bp, Homo sapiens
  source 1..203: mol_type = other DNA
ggcgcgccagtcctactgcctccgccccttcaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacacgactcggaccgatg

SEQ ID NO: 9401 - DNA, 203 bp, Homo sapiens
  source 1..203: mol_type = other DNA
ggcgcgccagtcctagcaaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctgcgactcggaccgatg

SEQ ID NO: 9402 - DNA, 203 bp, Homo sapiens
  source 1..203: mol_type = other DNA
ggcgcgccagtcctctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaacgactcggaccgatg

SEQ ID NO: 9403 - DNA, 203 bp, Homo sapiens
  source 1..203: mol_type = other DNA
ggcgcgccagtcctgagccaggcttggcggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaccacgactcggaccgatg

SEQ ID NO: 9404 - DNA, 203 bp, Homo sapiens
  source 1..203: mol_type = other DNA
ggcgcgccagtcctacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggcgactcggaccgatg

SEQ ID NO: 9405 - DNA, 203 bp, Homo sapiens
  source 1..203: mol_type = other DNA
ggcgcgccagtccttgcgcggcggggctgaggcggccgcggggcccgagcgcagggagtggagcttggtttcgggatctcggtgctgcagacggcgagacctcctgcacagggtgtacagcaagctgtgattcctgggaaaactaaaaaagctctctgaacaacggggcccagagctgatggcagacacgactcggaccgatg

SEQ ID NO: 9406 - DNA, 203 bp, Homo sapiens
  source 1..203: mol_type = other DNA
ggcgcgccagtcctatggctactctgatctacgttgataaggaaattggagaaccaggcacccgtgtggctgccaaggatgtgctgaagctggagtctagaccttcaatcaaagcattagatgggatatctcaagttttaacacgacgttttggcaaaacatacgatgctccatcagccttacctaaacgactcggaccgatg

SEQ ID NO: 9407 - DNA, 203 bp, Homo sapiens
  source 1..203: mol_type = other DNA
ggcgcgccagtcctaggtctccggattactgcatgcttgcagtgggaggaaaggcctgtctaccatgttctctgcctccccttcatgttctgtgaggagaggggccttgtctggcatgttcaccgaggcattcctgaccactagaactgtgcttggcacagagtaggcacttaataaactcctgctgccgactcggaccgatg

SEQ ID NO: 9408 - DNA, 203 bp, Homo sapiens
  source 1..203: mol_type = other DNA
ggcgcgccagtcctttctcgcccaaggacagacctgaatctctagctgcctagaggctgactcaactgaaatcatggcgtttgacagcacttggaaggtagaccggagtgaaaactatgacaagttcatggaaaaaatgggtgttaatatagtgaaaaggaagcttgcagctcatgacaatttgaagccgactcggaccgatg

SEQ ID NO: 9409 - DNA, 203 bp, Homo sapiens
  source 1..203: mol_type = other DNA
ggcgcgccagtcctctcctcctcctgctttcctccagtaagtgcatacccgctagtggtctgtacaggcggcacggtttgatggcagagatattttctttccaaactgttcaaaatgatgaacgaagatgcagctcagaaaagcgacagtggagagaagttcaacggcagtagtcagaggagaaaaagcgactcggaccgatg

SEQ ID NO: 9410 - DNA, 203 bp, Homo sapiens
  source 1..203: mol_type = other DNA
ggcgcgccagtcctttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagcgactcggaccgatg

SEQ ID NO: 9411 - DNA, 203 bp, Homo sapiens
  source 1..203: mol_type = other DNA
ggcgcgccagtcctggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaacgactcggaccgatg

SEQ ID NO: 9412 - DNA, 203 bp, Homo sapiens
  source 1..203: mol_type = other DNA
ggcgcgccagtcctgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaaggtgagcgactcggaccgatg

SEQ ID NO: 9413 - DNA, 203 bp, Homo sapiens
  source 1..203: mol_type = other DNA
ggcgcgccagtcctggggaatgcgctaacaagacaatgtaactttcttacaaattcgttagcaccctttagcgtttacccagaggtgtatctcctgggggcagatttgtaaaactagcatcaacaaccccttacttaaaccagcagccacatttgagggcaacatctacagtaataaattagccgttgcgactcggaccgatg

SEQ ID NO: 9414 - DNA, 203 bp, Homo sapiens
  source 1..203: mol_type = other DNA
ggcgcgccagtcctaatcgcagacatgtgtgagcacctgacaatcttggcacaaacgagagatccaatgaaagtccgagtgcagaatacactacaaaccccatttgggcgaaattttagttggcggtagtggcacccagaagccgtggatagaagctatgagcatcggcaacacggcattgagtgtatcgactcggaccgatg

SEQ ID NO: 9415 - DNA, 203 bp, Homo sapiens
  source 1..203: mol_type = other DNA
ggcgcgccagtcctccgaataaatggatacagggaaacaataataacatctcacgctaatacaacaaatagcaagatagagacgtagagatcaacattatatacacccataccaagactcaacgataaaaatcgtatgaacaataattgacaagcacactaagacgaatgaattgataatatcaagtacgactcggaccgatg

SEQ ID NO: 9416 - DNA, 203 bp, Homo sapiens
  source 1..203: mol_type = other DNA
ggcgcgccagtccttcccaaggcgacgcattcccgcctccagtcccacgtgagtactcggcctataaacatcagccacaccatttgtacgacacactacgcgaacccgaacgccgtgcctgggaccgaagcacttacattcgggcccaccgtatgcgccgcgtgcaggccaggtgctatgcctcccaccgactcggaccgatg

SEQ ID NO: 9417 - DNA, 203 bp, Homo sapiens
  source 1..203: mol_type = other DNA
ggcgcgccagtccttcccttcaaccactgcccgctgcaccggacaattcctgaacgcatctgagccagccacgcaccaccgcactacaatgacccgccgctcatgcgtggaacggtctctccaggtgcgcaaatagcgcaccaccctcgcgccgaccctctctgaagaccccaagatccgtagacctccgactcggaccgatg

SEQ ID NO: 9418 - DNA, 203 bp, Homo sapiens
  source 1..203: mol_type = other DNA
ggcgcgccagtcctctcagccccatgtcctcccccgctgtcgccattaggccggtagtagatggattacacggtctactagtgctgaatgcgatggtaggtgacgtggtgtgcccccctaccggttataacccacactttctcccgtagatggccccccgccccggggcccactcccctccaggttgacgactcggaccgatg

SEQ ID NO: 9419 - DNA, 203 bp, Homo sapiens
  source 1..203: mol_type = other DNA
ggcgcgccagtcctcgtccgcactgcacctgggacagacttccccttccgtgattcggtgtaccccccccggtgttacagcaccgctacgggcaggctggataggttgccctttcttatgccgacaccaacctcttcgtctacctcaccccgtactgcgcctcctcctcacgacgtgaggcacgcttacgactcggaccgatg

SEQ ID NO: 9420 - DNA, 203 bp, Homo sapiens
  source 1..203: mol_type = other DNA
ggcgcgccagtcctcgcacctgtgccagcgactatatgctagtaggttaggtagcacgcgcggtctctgcggaatcagcacgtaaacacccgaccccatgccctggctcttacgggttacgtaccaatcggagccgttgggtacgattgtgctacagccccgccttgcagagcagcgtcgcccactaccgactcggaccgatg

SEQ ID NO: 9421 - DNA, 203 bp, Homo sapiens
  source 1..203: mol_type = other DNA
ggcgcgccagtccttatccgatgtcctttacaccccgtactctcaggcagtagggcacatggcggccaatctgtcgtgtgctgtatcattaattctccggttcttattgatagttcgaatcggcacgggccacgtttctttaatcggagttctatccgcgtgggaatggacgcccatgagataatctacgactcggaccgatg

SEQ ID NO: 9422 - DNA, 203 bp, Homo sapiens
  source 1..203: mol_type = other DNA
ggcgcgccagtcctgggagccgaatcgctcccactgctagcgcacgggcccgccagagccgcaatgctggagccaacgcgaggaccgtatgggcgataagggcgaggggttgccggaatcgatggaaccgtggggcagggcggctcgggcgcgtgcatcgcgggtgaacaacagggagccgttgcgcacgactcggaccgatg

SEQ ID NO: 9423 - DNA, 203 bp, Homo sapiens
  source 1..203: mol_type = other DNA
ggcgcgccagtcctggtcccgccgggcacctggttagtgcccacacgcacgacgaggccccatggagaaaggtcccggtctggccagccgaccggcacaggcgaagcaacggcagaccagccctgtcagagccgtccgccccagggcgggaagggataaccgggcgagggaaggttgccgcctgctggcgactcggaccgatg

SEQ ID NO: 9424 - DNA, 203 bp, Homo sapiens
  source 1..203: mol_type = other DNA
ggcgcgccagtcctgttttttttcctgcgcgccgtcgcagggtctctccccgagcgaggggatcgcccctgaagcctagagttacccgggccccgcagtagggcgccctgtagtcttccacgggcgagtgggcttgtcgcgaataaccctcgctgttcttcggcggttttcagcgcggtgggctagcccgactcggaccgatg

SEQ ID NO: 9425 - DNA, 203 bp, Homo sapiens
  source 1..203: mol_type = other DNA
ggcgcgccagtccttcagccgcatcgacgagcggctgtgagaggccgtggattccatggccggtcacactaaatcggaggatattcagttctgggggaccggcctcgaggcgccacttcctctgtcctccctatttgctctccccccagttggcggaggtgcggcatggtgtggggcggagagctcatcgactcggaccgatg

SEQ ID NO: 9426 - DNA, 203 bp, Homo sapiens
  source 1..203: mol_type = other DNA
ggcgcgccagtcctcgggtaaggttgtcttcaatcattatctgaggggcgggccaccattaatcctgcgacctgataggaaacgtttacaagcgcccctctagatcactacagagccgatgccacggcgaacgagacaccacgaaacaatcaggtaagggcaccatcctgccggacacctccgcgccgcgactcggaccgatg

SEQ ID NO: 9427 - DNA, 203 bp, Homo sapiens
  source 1..203: mol_type = other DNA
ggcgcgccagtcctcatgcccggcaggtggaccgggcggaacgcccggggcggccgacaagaggtgggcgacctagaccagagacgagcgggcctccgtcagccggacccgtcacccaaacacgcacgtaaggatcgggacgggcgaccgacaaacacatgcggcagggcggcccacagcgcgggcaccgactcggaccgatg

SEQ ID NO: 9428 - DNA, 203 bp, Homo sapiens
  source 1..203: mol_type = other DNA
ggcgcgccagtcctcgtgctataatgcacctaaattctgccctcatgaggggtacctaaattacccaccccccgtgcgccggcgaactatgggcttactccctgtcgcctgacccgcccctgtttaccgtgtggctagaacgcagccggccgtacacgtggcagtgccatggacaagaggctgtggagcgactcggaccgatg

SEQ ID NO: 9429 - DNA, 203 bp, Homo sapiens
  source 1..203: mol_type = other DNA
ggcgcgccagtcctttgcacctacccgaccaggtacttgttcagtattcccacctcgcccccttgtgtctttaccggctccgccatcaaccttgagcgttcctagttagcctcttatgcagtgtctcggccttggcggcaaagctcctctgcttcgctattaccctccttctgtcaaacagccttgtacgactcggaccgatg

SEQ ID NO: 9430 - DNA, 203 bp, Homo sapiens
  source 1..203: mol_type = other DNA
ggcgcgccagtccttatattgtgtgttcacctctgttactctttccgtctcgctccacttggcatccctccccttcggtacccggccctctcctctccgataccagtcttcctgtataagtccctgccttctgttcctttccgtctgcaccctttcgccgccacaccgcccccggctataagcgtttacgactcggaccgatg

SEQ ID NO: 9431 - DNA, 203 bp, Homo sapiens
  source 1..203: mol_type = other DNA
ggcgcgccagtcctctaaagtaaaatacagctacccgctcgcttttaggcaacgattccggcgcctgcgaagcaccagacgatctagagcccatcgactttccaaagttctacccacccccctcaagcgtcgaaacgaacctcatcagccggcgagttattaggccaacaccaagaacgctgctatcccgactcggaccgatg

SEQ ID NO: 9432 - DNA, 203 bp, Homo sapiens
  source 1..203: mol_type = other DNA
ggcgcgccagtcctgctccacgtacagtgctccaccgccgactatgaaaggagaatcgcacgactagggatgggggcccttaggttcggcttccgcggagcctcccaacatcgcgatatcaaatcggatggcgtaggcgccagaagacaacgacttctgtactctacagaaagaaagccgactccctccgactcggaccgatg

SEQ ID NO: 9433 - DNA, 203 bp, Homo sapiens
  source 1..203: mol_type = other DNA
ggcgcgccagtcctccctggataagtttcaccagagtcacgacgcgactgatgcgggggtgcagcctcagaatgtgagacataacacccgtttcccgactcaccaaaccacctatatgtcgcgatggaagatgtgggcgaattccaatgattgggcagtgccccaggcccaggcgtatccccagaaatcgactcggaccgatg

SEQ ID NO: 9434 - DNA, 203 bp, Homo sapiens
  source 1..203: mol_type = other DNA
ggcgcgccagtcctctcgactgtacactaacttcgtaccttatattaagactttatcacatggttgtagtattactttttttgttgtgaatagacaatgtcattctctttaatttggtttaaactgaagtaaattcacagtgcttaagtgttgtgcatgtaacagcgtctataattttagtcagctctcgactcggaccgatg

SEQ ID NO: 9435 - DNA, 203 bp, Homo sapiens
  source 1..203: mol_type = other DNA
ggcgcgccagtccttctttaatagtttaactgtcgagcgtgtaatctcgaagtccagggtgtatacgttagttctgctatattttgaatatatttaattatgtggtctaaaggggactcatccactgtaggtctaaggtagctaggattgttatgtaatttagcattttgagcgttattcacctggaccgactcggaccgatg

SEQ ID NO: 9436 - DNA, 203 bp, Homo sapiens
  source 1..203: mol_type = other DNA
ggcgcgccagtccttacatggggcggcgctcgctagcagccagcttgggcactgccgcacgcggcatctgccttcacacgagagtagtcatgcaggggtaaagtcccccgggcagtcccctctccggtggtccgagtagctagcagtaatctgttgacgcccgatccggagtctcagctgggcaccaccgactcggaccgatg

SEQ ID NO: 9437 - DNA, 203 bp, Homo sapiens
  source 1..203: mol_type = other DNA
ggcgcgccagtcctgctatcgccgatggacatggtatcatatggctcggctagtgcccccgatttgacgggcagtcgcggctgcgcccacgcgcaaccagcgtcgccttgcgtcccgcagggccctgccctgccctcggcgtacgcgcttctgcttccagttcgcgcgagtgccatacccactagcctcgactcggaccgatg

SEQ ID NO: 9438 - DNA, 203 bp, Homo sapiens
  source 1..203: mol_type = other DNA
ggcgcgccagtccttttatcggtctggagggcgtgatacggcggccgtggtccttagttctcctcccaggctagaacccaggcgcacagaggccgcggccgcgaccacagatgccggtctggccctctccggagcacgcagcgcgggtacggtgacccgtccgttccccatgggcatgtgcacagtttcgactcggaccgatg

SEQ ID NO: 9439 - DNA, 203 bp, Homo sapiens
  source 1..203: mol_type = other DNA
ggcgcgccagtcctcttccctcccgtagcacgtgcgccccgcagcgctccgttgctcgaccccaaatcccctgtttgtgttgccgcgccgcgccaggggcgccgggttgcgcggcgtcctccttgcctctcagcgccccctggcctggggtccgcgccctcccccctccgtgacggaccaactgctctcgactcggaccgatg

SEQ ID NO: 9440 - DNA, 203 bp, Homo sapiens
  source 1..203: mol_type = other DNA
ggcgcgccagtcctgtgatgccttagatcgcttcgccagcgtaatcttcgttgcccgccacctgtgtccgtgtctctaccttcagttccccgttgagtcttccattcctacggacgtaggatcccggccccccgttccggtcccgtctcgacatcttcctgccgacttgaggtctacttaagtcgctgcgactcggaccgatg

SEQ ID NO: 9441 - DNA, 203 bp, Homo sapiens
  source 1..203: mol_type = other DNA
ggcgcgccagtcctctccctagtcccgtgtcgtcaccccctagacgggaaggctccgtcacgccgaccagcgatgggctgcggcgtagttcgacgcctccgggggccccatcctagagacgccgatgattacaaccgttccctcgctgtttcactcccgggatctcgggtgtgtccagacactctatccgactcggaccgatg

SEQ ID NO: 9442 - DNA, 203 bp, Homo sapiens
  source 1..203: mol_type = other DNA
ggcgcgccagtcctaatggatcggaacgccccgggcctagtgccgcgcacagccatccgctcgtcagcccaccgcagcacaccacatcacggtctccggcagttgccccgtttcggtcccgtcctgttggacctctaacggtgcttcggagacatcctgccctcggtaccacgttgaacctcggtcctcgactcggaccgatg

SEQ ID NO: 9443 - DNA, 203 bp, Homo sapiens
  source 1..203: mol_type = other DNA
ggcgcgccagtcctcctgccccgcacgccgcgctccgtaatctcttcgcccccaacgtcgggccccccttagtcggccccgcctagtattcgcgaggaagtgccacagacgcacgcgcagccgccaccacactcggctcgcaatcgccccctcgcgcctcggacgccccgcgcgatggcatgacgcggcgactcggaccgatg

SEQ ID NO: 9444 - DNA, 203 bp, Homo sapiens
  source 1..203: mol_type = other DNA
ggcgcgccagtcctcccacccggtcaccctggtcggcctcggccaccctcccctcggtgtgctgtctggtcccaccccagcccgccccaccccttactgcccagcggaggctcaaacgagcgcctgatcggacccccccaccacggaccaccctgtggagcgaaccggatccgcgcccgcgccgcacacgactcggaccgatg

SEQ ID NO: 9445 - DNA, 203 bp, Homo sapiens
  source 1..203: mol_type = other DNA
ggcgcgccagtcctttagcgtttttcgatcggctaataccaatcatacgtcctacgtgtaccccggtgcaccctcccccgtaccaatatgcgatagctcatagggtactgacacgtcactacatctgcgggatacgccttcctggcaaagagacgggtcggatcccgcggtttccgcgagctcctcttcgactcggaccgatg

SEQ ID NO: 9446 - DNA, 203 bp, Homo sapiens
  source 1..203: mol_type = other DNA
ggcgcgccagtcctgccgtcccgtcgggcggcgaggctcgctctttgcgctgcgccgcttgactaccaccaggttcggaggggggctcggttccgggccgtgacccggtcgaccatcggtgccgcggcggtgcgctacctaaccgactgcccggcaacccacccctgcgctgcgcagcgctagcggcgcgactcggaccgatg

SEQ ID NO: 9447 - DNA, 203 bp, Homo sapiens
  source 1..203: mol_type = other DNA
ggcgcgccagtcctccacccgggcgctaggaccatgccggggtcgagacgccggctctgctaaccgcaacgccggcggggagcccgagggggcccactgcacgagccgcgcctcgggagcgaccgtgccggactcttccaccaggcgtgcctccgtgaatcgtccgccctccggcggcagccgtccctcgactcggaccgatg

SEQ ID NO: 9448 - DNA, 203 bp, Homo sapiens
  source 1..203: mol_type = other DNA
ggcgcgccagtcctatccacttgatgcttccgccggtcccggtgcgctaactttccacgttcccccagaagcgagtgacgtttccatttgcggtttaaaaagcatagcattactcttactatacgcaacgatggctcatgccctcgctctctccttagcaccgggttgccgtccctctccccagtcatcgactcggaccgatg

SEQ ID NO: 9449 - DNA, 203 bp, Homo sapiens
  source 1..203: mol_type = other DNA
ggcgcgccagtcctaaggtagttcccactgcgacttaactcatgtcaagtcagtccacgcttccgccgcagggcgatctatgaatgagactggccccttaggtcgtagacaaccagtttatgcatcttacagtagtaatcggaggtgtcgcgttggggttgactacagcgtattctccattaatcggacgactcggaccgatg

SEQ ID NO: 9450 - DNA, 203 bp, Homo sapiens
  source 1..203: mol_type = other DNA
ggcgcgccagtcctatccttggggacgcatcgcgcaagattttgcgaggctctaaccgcgaagagacgggaaataaaaacccgttgtagggatggaatggcctcctttctctgtacgtccttagaaaacatctagttgcgtcttgtggctgtcttactgaacgaccatcgtccccaactcccatactgcgactcggaccgatg

SEQ ID NO: 9451 - DNA, 203 bp, Homo sapiens
  source 1..203: mol_type = other DNA
ggcgcgccagtcctagatacatcaatattatctattagtatacatttcggtcgatgtgtttatactacgagtatctaatcaatttttcgttggttcagaaatcaagtgcctgtgaagtgcttcttcacaaaatacttgaacgttgtttactataaagccggctaatacactacattcagtcatttgcccgactcggaccgatg

SEQ ID NO: 9452 - DNA, 203 bp, Homo sapiens
  source 1..203: mol_type = other DNA
ggcgcgccagtcctccgtggcctcatgtctaccacaaccttgcaggattcccgcagcgctaagcgctcgtgccccgagcgatccccactagacggcttcggagccttcccgctgtgtctagacgatctagtgcatcgtagagttggttcgaaccgacgaaactgctcgccgattgcgccatcgttgcgcgactcggaccgatg

SEQ ID NO: 9453 - DNA, 203 bp, Homo sapiens
  source 1..203: mol_type = other DNA
ggcgcgccagtcctatgaaaatatctgtacttgtactgaaacgccagtggtgcttgctttcctagtaacaatggaagatgaatttgacgtggaaaattgaataaagtgcttgcaataatatgaggtagacctaactaaattttgatattttatcatacattctacaaaagaacatgtgatgtagctgccgactcggaccgatg

SEQ ID NO: 9454 - DNA, 203 bp, Homo sapiens
  source 1..203: mol_type = other DNA
ggcgcgccagtcctttttgataggtttttagatgccgataagttcatgcctaggagtccactcatagaatatctctgatattcttatcggaatgtatattgctgttccgtaccgggttttgaggctcttagattttgtacaattttaactctaattgctgaaactaaggcatgtatatatcgactgggcgactcggaccgatg

SEQ ID NO: 9455 - DNA, 203 bp, Homo sapiens
  source 1..203: mol_type = other DNA
ggcgcgccagtccttcgagatcgataacacattgcaagcaccgaagcgtcagcttgaaatgggacctcctgcagccttggactgtccgcacccgaggtagcgggtcaatttcttccggcgcattttcatatttcgaagacacacactagttggaaagtatttgggtcattccagggcttgtgggagaacgactcggaccgatg

SEQ ID NO: 9456 - DNA, 203 bp, Homo sapiens
  source 1..203: mol_type = other DNA
ggcgcgccagtcctacggtacctgagagcatacgccgctaatttgaagtacgcggagatatgcgataactaagtaacattgtcagcgtgacgccttgtgggaacccaccctgtctgagaaccgggttatgcgcgataatcactacgacccgattggtgtacaggatccacagtgaaacattcaagcgacgactcggaccgatg

SEQ ID NO: 9457 - DNA, 203 bp, Homo sapiens
  source 1..203: mol_type = other DNA
ggcgcgccagtcctccggtcgggcctagggctggtaggtcttcgtcggtgggctgtccctgctcgagtgtcgggcgggctgcttcggaaccttgctaacccgtggactttttatttggtcctccgtcgtgctacctcgagcaaggatagaaagcgacgttgactttttacttctaattcacctccggccgactcggaccgatg

SEQ ID NO: 9458 - DNA, 203 bp, Homo sapiens
  source 1..203: mol_type = other DNA
ggcgcgccagtcctaccgggcgagtgacgtagtatcagttctcgtgagggcaagggttggcgcgtgggtccgggtcccgtcgcccgaaccgtctgaaattactagtgttccctgataccgtgttgcacgccggttggacactccttcctattcttacctcaggccatccgatgtcaggttaacacactcgactcggaccgatg

SEQ ID NO: 9459 - DNA, 203 bp, Homo sapiens
  source 1..203: mol_type = other DNA
ggcgcgccagtcctcatgcggtaagcctataagatacgcccaaatcgaagcgcacggggtctggcactagtcacgggtcgatgtgcgcgtgccctattcggtagcgctactcccccaacctgagttgtggtttcgcagtactcgtggcatgggaaccaccttggcaagggaaggccacgaagataagacgactcggaccgatg

SEQ ID NO: 9460 - DNA, 203 bp, Homo sapiens
  source 1..203: mol_type = other DNA
ggcgcgccagtcctttgtcgaagactatgcaagactatcttgactgtcgtgagtttatacgaacccactttattgggcatgcaatccatactagtttgatgtggtaaccgctactgatgcggtgttctaaaccgccttatgtagatcttagtactatcccacacagatacaaggttttgtgctgtcgacgactcggaccgatg

SEQ ID NO: 9461 - DNA, 203 bp, Homo sapiens
  source 1..203: mol_type = other DNA
ggcgcgccagtcctgcaccgctttacaaagttcgtacatccacataccgtttttgacaggagtgcggactttgacgccaataagcgcgtttgtgacctgaggtctgcctggctggtgtcgtagtgtagactgtttacccataagaatgatgtgttcaagacattttcccgtaggttggcgcgaattcgcgactcggaccgatg

SEQ ID NO: 9462 - DNA, 203 bp, Homo sapiens
  source 1..203: mol_type = other DNA
ggcgcgccagtcctgacttctccctctctcggagatgatagtcggggtcccatgtgataataattaccctgtcttaattttcaggctctgtccaactcgagcctggatacggatgggatggccctaggagaagcgttctgtacataggtcacgccgcagataggtccgttcaggctggtcccgttcatcgactcggaccgatg

SEQ ID NO: 9463 - DNA, 203 bp, Homo sapiens
  source 1..203: mol_type = other DNA
ggcgcgccagtcctctgaacaatacttttgttgattcggtttaaaacggatgtctgtcgtagcgtaaaacccgcgatacactgcatttaagataggtgtagaagtggctagtaatttaaagacatgtaaatggtcttccgtgctatcctattagacagctcgatgcactgaaccaactataaacggtgcgactcggaccgatg

SEQ ID NO: 9464 - DNA, 203 bp, Homo sapiens
  source 1..203: mol_type = other DNA
ggcgcgccagtcctaagtagctaaacagtttctaaaaatctcggccttaagttaagagaagccgtaaacgaagtgctgtaatactaattcggacgctcatgggcggcagtttatacgtgtatgtagaagagtaggatcaccattttgatgttaatctctctcctccaaccatagcgctccgatgacaccgactcggaccgatg

SEQ ID NO: 9465 - DNA, 203 bp, Homo sapiens
  source 1..203: mol_type = other DNA
ggcgcgccagtccttaagcttttttcaaattactcgttactattgagttgttcattatgtttaacttcacgaaacgggttatgcataagatactttggactgttcaggtgtaagaacaaagtaccaacgagatttaggtgagccctcagttgcctagtcgtggattctttccaataggaataaaccctcgactcggaccgatg

SEQ ID NO: 9466 - DNA, 203 bp, Homo sapiens
  source 1..203: mol_type = other DNA
ggcgcgccagtcctaacattacatatacttaggattaccttgctgggtttccttggtaatagagttatatattttggcattaaagtatcctctatgtggatgatcctgacgcgtgattcttccctcgattatttgaatctagataaaaggagggaccataattttttgaatgattaattgctaccgctcgactcggaccgatg

SEQ ID NO: 9467 - DNA, 203 bp, Homo sapiens
  source 1..203: mol_type = other DNA
ggcgcgccagtcctaaattgcagtagcatcattcatcgttccgccaaaattagatacatcataccagaatcacctatgctacggtagacattgaatagacagaaggaacgacgacacaggaaagatctcctccaacccccggaacatcataaagacgtacagtagcaatacttgatcgcaccgagtaacgactcggaccgatg

SEQ ID NO: 9468 - DNA, 203 bp, Homo sapiens
  source 1..203: mol_type = other DNA
ggcgcgccagtcctacacgagttcattaaagtacctaccaatactggaatctccgccacgattttggctttggtacggtctgttagtaaaaatcgaagtattggtgcggctagtactattgctgcatctaccgatacaagtatagtagtcgcggaaatgagagggggcccagcgatggtaactattttcgactcggaccgatg

SEQ ID NO: 9469 - DNA, 203 bp, Homo sapiens
  source 1..203: mol_type = other DNA
ggcgcgccagtcctcatcgagatttgctgtcgtttataatcgaaatgggcatgagataaggacaaagagcataccgcggcccgccgattcgcggattaagagtgaatgcggaaccaacaagcgtttacgaaatgactgatcatgtagttgccttgcatccggtctttacgtacttttagaaaattgtccgactcggaccgatg

SEQ ID NO: 9470 - DNA, 203 bp, Homo sapiens
  source 1..203: mol_type = other DNA
ggcgcgccagtcctttcttactctttagtgaaccgactaataaagtttgaaggtgcgtgctaagataggtaagagactctggtcgagagtttcatgtcgtgcttttggctttggggagtgatgtaggggtttcacttactcttaaccgtgagggttactttcttccctggaagtctgaatataatttacgactcggaccgatg

SEQ ID NO: 9471 - DNA, 203 bp, Homo sapiens
  source 1..203: mol_type = other DNA
ggcgcgccagtccttaagagggtccgcgttggaaagactcgtgggtcggaatggctttgcaccggtgtcgttgttgccggttttaggcagtaaattcaggcgtgcctacgtaccttagttgctccggctagcctatattgaatttggtgcccatactgacattcctaacactatatgatgttgggaatcgactcggaccgatg

SEQ ID NO: 9472 - DNA, 203 bp, Homo sapiens
  source 1..203: mol_type = other DNA
ggcgcgccagtcctctggacctagcaagggattctgtaacactcgtggggatcactacgcgggtttctggcgaatgtttggaccggccagggtgatcacatggaatcacatgtatactgtatgtgggccccgtaagctgtcgtgtgtcctgaccgtgctcttcacaatcttttaagtttgtgtcatggcgactcggaccgatg

SEQ ID NO: 9473 - DNA, 203 bp, Homo sapiens
  source 1..203: mol_type = other DNA
ggcgcgccagtcctgccatatgctcaaacgtctcgggacgccatatacgagagaccatggattgggtggcccactatcacctggagacagtcggggctgggttgtaagccatggaaggacagagacagtgacgttatttggagtccataaacacgcgtcttagcgcagtgggcgcgcacgtcataagtcgactcggaccgatg

SEQ ID NO: 9474 - DNA, 203 bp, Homo sapiens
  source 1..203: mol_type = other DNA
ggcgcgccagtcctttcaatcaggtgccgcatctacgcaggctgcatcgcggtccaagcgcgcagcagggatccgtcccgtgatgctagggcgtcaagaaggtagcgcgggaaccagatcatcaggaatgtctccgagaggaggatcggggtaactcgggtagcactatgtaaaacgaatgccttcgccgactcggaccgatg

SEQ ID NO: 9475 - DNA, 203 bp, Homo sapiens
  source 1..203: mol_type = other DNA
ggcgcgccagtcctctgtcgcggttttcgtagatcaccagcaatgtctccgagggaaagtgtggtggtatacgtgctcttattctcaagtacgcgatactgggtgatttcactttagagcgatgcctcagaaaaatggtactggccaaagagtggggctcattacgccagcggattacaagttgctgccgactcggaccgatg

SEQ ID NO: 9476 - DNA, 203 bp, Homo sapiens
  source 1..203: mol_type = other DNA
ggcgcgccagtccttgtgttgaggagctctgtcgtacgccatgtaagtagctcaacccccagctctgggggcgacccctaatgacaggattacgaggctcacggctagacaacaggtaacggtggatgcattctctatcgtgtgacgttggggtcgtcctgtgtggcctcacgtgagcccactagatgcgactcggaccgatg

SEQ ID NO: 9477 - DNA, 203 bp, Homo sapiens
  source 1..203: mol_type = other DNA
ggcgcgccagtccttgtccatctctggtctaaaggtcgtgcccgtatgccggaaaagttcggtgaggttgtacttctactctgaagagaaccgcagcgcgcccgcatggcgagtgggggaccgtatatatacaagatttagaccagccaaggaaaatagacttctgtatgacacggttgctctcccgtcgactcggaccgatg

SEQ ID NO: 9478 - DNA, 203 bp, Homo sapiens
  source 1..203: mol_type = other DNA
ggcgcgccagtcctgccggaatatagcacattgggaaggcatagcgtctgccgtgtatctagatgatcaagagggctactgctacatagggtgcctgtccaagccctgcggactagccgcacacctcgtccctactcgaaatcttttagaatcgcgaatcgatggtacctgtgcgaggcatacgggttcgactcggaccgatg

SEQ ID NO: 9479 - DNA, 203 bp, Homo sapiens
  source 1..203: mol_type = other DNA
ggcgcgccagtcctcgtcatgtgcgttggccggagggcttactacccttcacgttagttctagcgaaatcctgaatgtacctttcttgccactccccgcttcacactgagtgttactgtcgaattgcttggccacttgtctcttaagcctgtcgctactatgtcttcctcaaagtgccaggtaagtttcgactcggaccgatg

SEQ ID NO: 9480 - DNA, 203 bp, Homo sapiens
  source 1..203: mol_type = other DNA
ggcgcgccagtcctccgggagtaagcataatacctgtccaactgagatgatgcaaactaacagactcaaacaagtcaggtcaacaataaaaattaaggtaaggagcgaccgggatgcagacgggtgccttggtaaagggaatacgaatccgcagctaccggctcgaagtctccaattgacccacgcaacgactcggaccgatg

SEQ ID NO: 9481 - DNA, 203 bp, Homo sapiens
  source 1..203: mol_type = other DNA
ggcgcgccagtcctctgtgaaggcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9482 - DNA, 203 bp, Homo sapiens
  source 1..203: mol_type = other DNA
ggcgcgccagtccttatcggatgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9483 - DNA, 203 bp, Homo sapiens
  source 1..203: mol_type = other DNA
ggcgcgccagtcctgcagtcgagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9484 - DNA, 203 bp, Homo sapiens
  source 1..203: mol_type = other DNA
ggcgcgccagtcctattcacccgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9485 - DNA, 203 bp, Homo sapiens
  source 1..203: mol_type = other DNA
ggcgcgccagtccttgaggtgggcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9486 - DNA, 203 bp, Homo sapiens
  source 1..203: mol_type = other DNA
ggcgcgccagtcctaacttgtcgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9487 - DNA, 203 bp, Homo sapiens
  source 1..203: mol_type = other DNA
ggcgcgccagtcctcttccactgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9488 - DNA, 203 bp, Homo sapiens
  source 1..203: mol_type = other DNA
ggcgcgccagtcctgtcctacagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9489 - DNA, 203 bp, Homo sapiens
  source 1..203: mol_type = other DNA
ggcgcgccagtcctaatttcatgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9490 - DNA, 203 bp, Homo sapiens
  source 1..203: mol_type = other DNA
ggcgcgccagtccttcgttatatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 9491 - DNA, 203 bp, Homo sapiens
  source 1..203: mol_type = other DNA
ggcgcgccagtcctgcagtcgatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 9492 - DNA, 203 bp, Homo sapiens
  source 1..203: mol_type = other DNA
ggcgcgccagtcctaacttgtcatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagacgactcggaccgatg

SEQ ID NO: 9493 - DNA, 203 bp, Homo sapiens
  source 1..203: mol_type = other DNA
ggcgcgccagtcctctgtgaagcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9494 - DNA, 203 bp, Homo sapiens
  source 1..203: mol_type = other DNA
ggcgcgccagtccttcgttatacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9495 - DNA, 203 bp, Homo sapiens
  source 1..203: mol_type = other DNA
ggcgcgccagtcctagtgctgccagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9496 - DNA, 203 bp, Homo sapiens
  source 1..203: mol_type = other DNA
ggcgcgccagtccttgaggtggcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9497 - DNA, 203 bp, Homo sapiens
  source 1..203: mol_type = other DNA
ggcgcgccagtcctaggtattgcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9498 - DNA, 203 bp, Homo sapiens
  source 1..203: mol_type = other DNA
ggcgcgccagtcctgtcctacacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9499 - DNA, 203 bp, Homo sapiens
  source 1..203: mol_type = other DNA
ggcgcgccagtcctgaaaccctcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9500 - DNA, 203 bp, Homo sapiens
  source 1..203: mol_type = other DNA
ggcgcgccagtcctctgtgaagggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9501 - DNA, 203 bp, Homo sapiens
  source 1..203: mol_type = other DNA
ggcgcgccagtcctgcagtcgaggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9502 - DNA, 203 bp, Homo sapiens
  source 1..203: mol_type = other DNA
ggcgcgccagtcctcttccactggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9503 - DNA, 203 bp, Homo sapiens
  source 1..203: mol_type = other DNA
ggcgcgccagtcctttgcgctcggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9504 - DNA, 203 bp, Homo sapiens
  source 1..203: mol_type = other DNA
ggcgcgccagtcctgaaaccctggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9505 - DNA, 203 bp, Homo sapiens
  source 1..203: mol_type = other DNA
ggcgcgccagtcctctctctcggcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaacgactcggaccgatg

SEQ ID NO: 9506 - DNA, 203 bp, Homo sapiens
  source 1..203: mol_type = other DNA
ggcgcgccagtcctagtgctgcaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagcgactcggaccgatg

SEQ ID NO: 9507 - DNA, 203 bp, Homo sapiens
  source 1..203: mol_type = other DNA
ggcgcgccagtcctctgtgaagccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 9508 - DNA, 203 bp, Homo sapiens
  source 1..203: mol_type = other DNA
ggcgcgccagtcctaacttgtcccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 9509 - DNA, 203 bp, Homo sapiens
  source 1..203: mol_type = other DNA
ggcgcgccagtcctaggtattgccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 9510 - DNA, 203 bp, Homo sapiens
  source 1..203: mol_type = other DNA
ggcgcgccagtccttatcggatgtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 9511 - DNA, 203 bp, Homo sapiens
  source 1..203: mol_type = other DNA
ggcgcgccagtcctgcagtcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 9512 - DNA, 203 bp, Homo sapiens
  source 1..203: mol_type = other DNA
ggcgcgccagtcctaatttcatgtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 9513 - DNA, 203 bp, Homo sapiens
  source 1..203: mol_type = other DNA
ggcgcgccagtcctgcagtcgacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 9514 - DNA, 203 bp, Homo sapiens
  source 1..203: mol_type = other DNA
ggcgcgccagtcctgcagtcgacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9515 - DNA, 203 bp, Homo sapiens
  source 1..203: mol_type = other DNA
ggcgcgccagtccttgaggtggcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9516 - DNA, 203 bp, Homo sapiens
  source 1..203: mol_type = other DNA
ggcgcgccagtcctcttccactcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9517 - DNA, 203 bp, Homo sapiens
  source 1..203: mol_type = other DNA
ggcgcgccagtcctaggtattgcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9518 - DNA, 203 bp, Homo sapiens
  source 1..203: mol_type = other DNA
ggcgcgccagtcctgtcctacacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9519 - DNA, 203 bp, Homo sapiens
  source 1..203: mol_type = other DNA
ggcgcgccagtcctgaaaccctcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9520 - DNA, 203 bp, Homo sapiens
  source 1..203: mol_type = other DNA
ggcgcgccagtcctaatttcatcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9521 - DNA, 203 bp, Homo sapiens
  source 1..203: mol_type = other DNA
ggcgcgccagtccttgaggtgggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 9522 - DNA, 203 bp, Homo sapiens
  source 1..203: mol_type = other DNA
ggcgcgccagtcctaatttcatgagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 9523 - DNA, 203 bp, Homo sapiens
  source 1..203: mol_type = other DNA
ggcgcgccagtcctgcagtcgacctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 9524 - DNA, 203 bp, Homo sapiens
  source 1..203: mol_type = other DNA
ggcgcgccagtcctattcaccccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 9525 - DNA, 203 bp, Homo sapiens
  source 1..203: mol_type = other DNA
ggcgcgccagtcctcttccactcctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 9526 - DNA, 203 bp, Homo sapiens
  source 1..203: mol_type = other DNA
ggcgcgccagtccttatcggatttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9527 - DNA, 203 bp, Homo sapiens
  source 1..203: mol_type = other DNA
ggcgcgccagtccttgaggtggttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9528 - DNA, 203 bp, Homo sapiens
  source 1..203: mol_type = other DNA
ggcgcgccagtcctaacttgtcttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9529 - DNA, 203 bp, Homo sapiens
  source 1..203: mol_type = other DNA
ggcgcgccagtcctaggtattgttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9530 - DNA, 203 bp, Homo sapiens
  source 1..203: mol_type = other DNA
ggcgcgccagtcctctgtgaagttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9531 - DNA, 203 bp, Homo sapiens
  source 1..203: mol_type = other DNA
ggcgcgccagtccttcgttatattcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9532 - DNA, 203 bp, Homo sapiens
  source 1..203: mol_type = other DNA
ggcgcgccagtcctagtgctgcttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9533 - DNA, 203 bp, Homo sapiens
  source 1..203: mol_type = other DNA
ggcgcgccagtcctaacttgtcttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9534 - DNA, 203 bp, Homo sapiens
  source 1..203: mol_type = other DNA
ggcgcgccagtcctaggtattgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9535 - DNA, 203 bp, Homo sapiens
  source 1..203: mol_type = other DNA
ggcgcgccagtcctgtcctacattcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9536 - DNA, 203 bp, Homo sapiens
  source 1..203: mol_type = other DNA
ggcgcgccagtcctaggtattgccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9537 - DNA, 203 bp, Homo sapiens
  source 1..203: mol_type = other DNA
ggcgcgccagtcctgtcctacaccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9538 - DNA, 203 bp, Homo sapiens
  source 1..203: mol_type = other DNA
ggcgcgccagtcctctctctcgccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9539 - DNA, 203 bp, Homo sapiens
  source 1..203: mol_type = other DNA
ggcgcgccagtcctaatttcatccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9540 - DNA, 203 bp, Homo sapiens
  source 1..203: mol_type = other DNA
ggcgcgccagtcctctgtgaagccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9541 - DNA, 203 bp, Homo sapiens
  source 1..203: mol_type = other DNA
ggcgcgccagtccttcgttataccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9542 - DNA, 203 bp, Homo sapiens
  source 1..203: mol_type = other DNA
ggcgcgccagtcctgcagtcgaccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9543 - DNA, 203 bp, Homo sapiens
  source 1..203: mol_type = other DNA
ggcgcgccagtcctaacttgtcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9544 - DNA, 203 bp, Homo sapiens
  source 1..203: mol_type = other DNA
ggcgcgccagtcctgtcctacaccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9545 - DNA, 203 bp, Homo sapiens
  source 1..203: mol_type = other DNA
ggcgcgccagtcctctctctcgccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9546 - DNA, 203 bp, Homo sapiens
  source 1..203: mol_type = other DNA
ggcgcgccagtcctgcagtcgaaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9547 - DNA, 203 bp, Homo sapiens
  source 1..203: mol_type = other DNA
ggcgcgccagtcctagtgctgcaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9548 - DNA, 203 bp, Homo sapiens
  source 1..203: mol_type = other DNA
ggcgcgccagtcctgaaaccctaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9549 - DNA, 203 bp, Homo sapiens
  source 1..203: mol_type = other DNA
ggcgcgccagtcctctctctcgaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9550 - DNA, 203 bp, Homo sapiens
  source 1..203: mol_type = other DNA
ggcgcgccagtccttatcggatagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9551 - DNA, 203 bp, Homo sapiens
  source 1..203: mol_type = other DNA
ggcgcgccagtcctgcagtcgaagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9552 - DNA, 203 bp, Homo sapiens
  source 1..203: mol_type = other DNA
ggcgcgccagtcctagtgctgcagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9553 - DNA, 203 bp, Homo sapiens
  source 1..203: mol_type = other DNA
ggcgcgccagtccttgaggtggagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9554 - DNA, 203 bp, Homo sapiens
  source 1..203: mol_type = other DNA
ggcgcgccagtcctaggtattgagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9555 - DNA, 203 bp, Homo sapiens
  source 1..203: mol_type = other DNA
ggcgcgccagtcctctgtgaaggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9556 - DNA, 203 bp, Homo sapiens
  source 1..203: mol_type = other DNA
ggcgcgccagtccttatcggatgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9557 - DNA, 203 bp, Homo sapiens
  source 1..203: mol_type = other DNA
ggcgcgccagtcctgcagtcgagcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9558 - DNA, 203 bp, Homo sapiens
  source 1..203: mol_type = other DNA
ggcgcgccagtcctagtgctgcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9559 - DNA, 203 bp, Homo sapiens
  source 1..203: mol_type = other DNA
ggcgcgccagtcctaacttgtcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9560 - DNA, 203 bp, Homo sapiens
  source 1..203: mol_type = other DNA
ggcgcgccagtcctcttccactgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9561 - DNA, 203 bp, Homo sapiens
  source 1..203: mol_type = other DNA
ggcgcgccagtcctaggtattggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9562 - DNA, 203 bp, Homo sapiens
  source 1..203: mol_type = other DNA
ggcgcgccagtcctttgcgctcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9563 - DNA, 203 bp, Homo sapiens
  source 1..203: mol_type = other DNA
ggcgcgccagtcctgaaaccctgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9564 - DNA, 203 bp, Homo sapiens
  source 1..203: mol_type = other DNA
ggcgcgccagtcctctctctcggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9565 - DNA, 203 bp, Homo sapiens
  source 1..203: mol_type = other DNA
ggcgcgccagtcctaatttcatgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9566 - DNA, 203 bp, Homo sapiens
  source 1..203: mol_type = other DNA
ggcgcgccagtccttatcggatttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggccgactcggaccgatg

SEQ ID NO: 9567 - DNA, 203 bp, Homo sapiens
  source 1..203: mol_type = other DNA
ggcgcgccagtccttgaggtggttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggccgactcggaccgatg

SEQ ID NO: 9568 - DNA, 203 bp, Homo sapiens
  source 1..203: mol_type = other DNA
ggcgcgccagtcctctgtgaagctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9569 - DNA, 203 bp, Homo sapiens
  source 1..203: mol_type = other DNA
ggcgcgccagtccttcgttatactgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9570 - DNA, 203 bp, Homo sapiens
  source 1..203: mol_type = other DNA
ggcgcgccagtccttatcggatctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9571 - DNA, 203 bp, Homo sapiens
  source 1..203: mol_type = other DNA
ggcgcgccagtcctagtgctgcctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9572 - DNA, 203 bp, Homo sapiens
  source 1..203: mol_type = other DNA
ggcgcgccagtcctaacttgtcctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9573 - DNA, 203 bp, Homo sapiens
  source 1..203: mol_type = other DNA
ggcgcgccagtcctaggtattgctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9574 - DNA, 203 bp, Homo sapiens
  source 1..203: mol_type = other DNA
ggcgcgccagtcctttgcgctcctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9575 - DNA, 203 bp, Homo sapiens
  source 1..203: mol_type = other DNA
ggcgcgccagtcctgtcctacactgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9576 - DNA, 203 bp, Homo sapiens
  source 1..203: mol_type = other DNA
ggcgcgccagtcctgaaaccctctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9577 - DNA, 203 bp, Homo sapiens
  source 1..203: mol_type = other DNA
ggcgcgccagtccttcgttataccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 9578 - DNA, 203 bp, Homo sapiens
  source 1..203: mol_type = other DNA
ggcgcgccagtcctcttccactccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 9579 - DNA, 203 bp, Homo sapiens
  source 1..203: mol_type = other DNA
ggcgcgccagtcctctctctcgccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 9580 - DNA, 203 bp, Homo sapiens
  source 1..203: mol_type = other DNA
ggcgcgccagtcctctgtgaaggcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9581 - DNA, 203 bp, Homo sapiens
  source 1..203: mol_type = other DNA
ggcgcgccagtccttatcggatgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9582 - DNA, 203 bp, Homo sapiens
  source 1..203: mol_type = other DNA
ggcgcgccagtcctgcagtcgagcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9583 - DNA, 203 bp, Homo sapiens
  source 1..203: mol_type = other DNA
ggcgcgccagtcctagtgctgcgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9584 - DNA, 203 bp, Homo sapiens
  source 1..203: mol_type = other DNA
ggcgcgccagtcctaacttgtcgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9585 - DNA, 203 bp, Homo sapiens
  source 1..203: mol_type = other DNA
ggcgcgccagtcctaggtattggcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9586 - DNA, 203 bp, Homo sapiens
  source 1..203: mol_type = other DNA
ggcgcgccagtcctttgcgctcgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9587 - DNA, 203 bp, Homo sapiens
  source 1..203: mol_type = other DNA
ggcgcgccagtcctgtcctacagcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9588 - DNA, 203 bp, Homo sapiens
  source 1..203: mol_type = other DNA
ggcgcgccagtcctaatttcatgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9589 - DNA, 203 bp, Homo sapiens
  source 1..203: mol_type = other DNA
ggcgcgccagtcctctgtgaagaaaaaaccaggatcatcacgcgtgagttggataaggctctggatggtgtactgacacacaagcaaggctgcctccattgtctcagcaccgatttctaggcagcaccctctttaataggtgcaaggggggtgcggtgttggtgagtcacactttcgttgcagacaaacgactcggaccgatg

SEQ ID NO: 9590 - DNA, 203 bp, Homo sapiens
  source 1..203: mol_type = other DNA
ggcgcgccagtccttatcggataaaacaatttcccataacaccccaataccccaaggacatttaaagctaaattcatctgtaatcaacagagctctacacaatgaccatcgtagtgtttgcgactgaatacgatgccgccaacgtaatttttagtatcctatgtagaagtcccagtgaacatttaatccgactcggaccgatg

SEQ ID NO: 9591 - DNA, 203 bp, Homo sapiens
  source 1..203: mol_type = other DNA
ggcgcgccagtcctgcagtcgaaaaacttctgtgaaggtcacatccctagttggattacgccgcttttgaaaaatctagaagttgtttggaaaagagatatctggttcgtatgaataggatgctcttgaagaaagggccttcgggccaaacatctggtcggccatcgaccagaccgccggacccagcgcgactcggaccgatg

SEQ ID NO: 9592 - DNA, 203 bp, Homo sapiens
  source 1..203: mol_type = other DNA
ggcgcgccagtcctattcacccaaaagtccatttccgtagcggccgcaaaaacaagaatgtaaaagagccagagactgacatataagcgttgccttgcgcctttcttacaactcatcttaagtgttattttgaactagtcttcgcgtcgacgtgattaacagcagacagccctctgtcacctggaaaacgactcggaccgatg

SEQ ID NO: 9593 - DNA, 203 bp, Homo sapiens
  source 1..203: mol_type = other DNA
ggcgcgccagtcctgtcctacaaaacggaagttcagggagggcgaggccgtgccccacatccaggcagcgcaggccgcgggccgctcccctagccaggaagagccgccgtccgcaccgggaccggagaggaagcggaggtctgaagggggacaggtgaggcggaaccaaccctcctggccatgggaggcgactcggaccgatg

SEQ ID NO: 9594 - DNA, 203 bp, Homo sapiens
  source 1..203: mol_type = other DNA
ggcgcgccagtcctgaaaccctaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaacgactcggaccgatg

SEQ ID NO: 9595 - DNA, 203 bp, Homo sapiens
  source 1..203: mol_type = other DNA
ggcgcgccagtcctggtgctcaaaagcgctcggtttaaaaagcttctatgcctgaataggtgaccggaggtcggcacctttcctttacaattaatgaccctatgaatacaactgactgttttatcgctgtggtaaacgccatcaaagaggtaatagcacttttcctatcacggactgcaggaaaaatgcgactcggaccgatg

SEQ ID NO: 9596 - DNA, 203 bp, Homo sapiens
  source 1..203: mol_type = other DNA
ggcgcgccagtccttcacatccaacacagtgggggcgatagatgccatctgcgcgatctacaatttgaagtactgcgagatcgtttggaataaaaattaacatgattcttccgtctcttccctctcctctgctgcttgaaacgcaatccagttgcattgcttggttgggatttgcatatgctaccgtgcgactcggaccgatg

SEQ ID NO: 9597 - DNA, 203 bp, Homo sapiens
  source 1..203: mol_type = other DNA
ggcgcgccagtcctcgtagcctaactgtccagtttaaaaagcttctatgcctgaataggtgaccggaggccggcaccttttccttttatccaacacattttatgaagacaactgactgttttgacgttttgctcgagatctttcacaggttccgacacacgttcaagacagacaggaagatggaattccgactcggaccgatg

SEQ ID NO: 9598 - DNA, 203 bp, Homo sapiens
  source 1..203: mol_type = other DNA
ggcgcgccagtcctaccggcagaacttgttaggagacgccctcaatcgtattaaaagccgtgtattcccccgcactaaagaataaatccccagtagacatcatgcgtactgttggtgtatttctggccacctgtcttgtcaccattttcgtcctcccaacatggggcaattgggcatacccatgttgtcgactcggaccgatg

SEQ ID NO: 9599 - DNA, 203 bp, Homo sapiens
  source 1..203: mol_type = other DNA
ggcgcgccagtcctagatcaccaactttcggtgctgttgtttaatcacaatgacaggttttacgagggtcgagctggagaccctgtggcttgtcttgtgatggaaagactgatttttccacctgttcgacaggctactatgatatgacgcttgtttcttttattttgcagactaattcaaaactaacacgactcggaccgatg

SEQ ID NO: 9600 - DNA, 203 bp, Homo sapiens
  source 1..203: mol_type = other DNA
ggcgcgccagtcctcgatgcgcaagacacttttattttgcaaactcaaataaaggtgctaaaaaatcaaaaaacaacgaacctaaaccaagcacctcaaaaatgtctgaaaatgaaattcaagaccaacagccatcagaacctaatgatggccaacgaggagggggaggaggtgcgaccggcagtgtgcgactcggaccgatg

SEQ ID NO: 9601 - DNA, 203 bp, Homo sapiens
  source 1..203: mol_type = other DNA
ggcgcgccagtcctacaagaataagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatctcgactcggaccgatg

SEQ ID NO: 9602 - DNA, 203 bp, Homo sapiens
  source 1..203: mol_type = other DNA
ggcgcgccagtcctcggcgtgaaagcgtgtgattcagtatctgtttttataatacggagagctatcgtgctgagcggaacagagctttggctgtgacgaagatggatgtgtggaagcgtcaacggcttcaagaatgccgtgaattgtgtcctttgcctgtattaatgtcactgtcgaatatgttttcacgactcggaccgatg

SEQ ID NO: 9603 - DNA, 203 bp, Homo sapiens
  source 1..203: mol_type = other DNA
ggcgcgccagtcctggctcctgaaggaaaggaaaagcgcatccaagaatggctccaaaagaatggagagaacaggttgtcagccatggcagtcagcggggatgattgtgtggtgaaaccagcagatgacagattcgccacagcactgcatttcctcaacagcatgtctaaggtgaggaaagatactcacgactcggaccgatg

SEQ ID NO: 9604 - DNA, 203 bp, Homo sapiens
  source 1..203: mol_type = other DNA
ggcgcgccagtcctgcttcttcaagggaccgtagagactggcagagcactaaaacaggtagttggtctatcaacagctgagaatgccctgttagtagccttattcggctacgtaggatatcaggcgctttcaaagaggcatataccagtagtcacagacatatattcaattgaagatcacaggttggacgactcggaccgatg

SEQ ID NO: 9605 - DNA, 203 bp, Homo sapiens
  source 1..203: mol_type = other DNA
ggcgcgccagtcctcagggtgcaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctcccgactcggaccgatg

SEQ ID NO: 9606 - DNA, 203 bp, Homo sapiens
  source 1..203: mol_type = other DNA
ggcgcgccagtcctaacagagcaagttttggagactaagtgaaagacattgtcggtttgcgcttgtcggcatctgttttcttttagccttgtatttttgttatgttctacttaaaaaaactcctacgccagcttctggctccgttgtgtaaacatgggtcgtacacgcatttgcaattgtttgtgatgcgactcggaccgatg

SEQ ID NO: 9607 - DNA, 203 bp, Homo sapiens
  source 1..203: mol_type = other DNA
ggcgcgccagtcctactatgacaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggcgactcggaccgatg

SEQ ID NO: 9608 - DNA, 203 bp, Homo sapiens
  source 1..203: mol_type = other DNA
ggcgcgccagtcctatccgcgtaatgaaatacccaatcactgctgacaaaaggataacagaaatggttccggagagaaatgaacaaggacaaactctatggagtaaaatgagtgatgctggatcagatcgagtgatggtatcacctttggctgtaacatggtggaatagaaatggacccgtggcaagtcgactcggaccgatg

SEQ ID NO: 9609 - DNA, 203 bp, Homo sapiens
  source 1..203: mol_type = other DNA
ggcgcgccagtcctttagttcaaatgaagggagtgtacataaacacagctttgttgaatgcatcctgtgcagccatggatgacttccaactgatcccaatgataagcaaatgcagaaccaaagaaggaagacggaaaactaacctgtatggattccttataaaaggaagatcccatttgagaaatgaccgactcggaccgatg

SEQ ID NO: 9610 - DNA, 203 bp, Homo sapiens
  source 1..203: mol_type = other DNA
ggcgcgccagtcctaatgagaaaatgaagggggtatacattaatactgccttgcttaatgcatcctgtgcagcaatggacgatttccaactaattcccatgataagcaagtgtagaactaaagagggaaggcgaaagaccaatttatatggtttcatcataaaaggaagatctcacttaaggaatgaccgactcggaccgatg

SEQ ID NO: 9611 - DNA, 203 bp, Homo sapiens
  source 1..203: mol_type = other DNA
ggcgcgccagtcctgttcaattaatggaatttgaaccatttcaatctttagtccccaaggccattagaagccaatacagtgggtttgtcagaactctattccaacaaatgagagacgtacttgggacatttgacaccacccagataataaagcttctcccttttgcagccgctccaccaaagcaaagccgactcggaccgatg

SEQ ID NO: 9612 - DNA, 203 bp, Homo sapiens
  source 1..203: mol_type = other DNA
ggcgcgccagtcctcgtcagtaaatgtgctctctgatgcaaggatcaactctcccgaggagatctggagctgctggtgcggcagtaaagggagtcggaacgatggtgatggaactaattcggatgataaagcgagggattaacgatcggaatttctggagaggtgaaaatgggcgaagaacaagaattcgactcggaccgatg

SEQ ID NO: 9613 - DNA, 203 bp, Homo sapiens
  source 1..203: mol_type = other DNA
ggcgcgccagtcctcgggtttgacaaacgattaagaacagctgtcttggctccgactcgggtggtggccgctgaaatagcggaagcactgaaaggacttccaatacggtatctgactccggcagtaaagagggagcataccgggacagagataatagatgtgatgtgtcacgcgactttgacagcgcgcgactcggaccgatg

SEQ ID NO: 9614 - DNA, 203 bp, Homo sapiens
  source 1..203: mol_type = other DNA
ggcgcgccagtcctttgggactacaaacgattaagaacagctgtcttggctccgactcgggtggtggccgctgaaatagcggaagcactgaaaggatttccaatacggtatctgactccggcagtaaagagggagcataccggaacagagataatagatgtgatgtgtcacgcgactttgacagcgcgcgactcggaccgatg

SEQ ID NO: 9615 - DNA, 203 bp, Homo sapiens
  source 1..203: mol_type = other DNA
ggcgcgccagtcctcatcccacacaaagtacacaacaagcgttttgaaccacgttctatagacgaacgtgtcattcttggaggacttcatgattgcgatggtctcagttgagcattcaccttttaaataatttgcaaagggcgtgaccggatgttttaaagggtccagtcctcctcagatctcaaacacgactcggaccgatg

SEQ ID NO: 9616 - DNA, 203 bp, Homo sapiens
  source 1..203: mol_type = other DNA
ggcgcgccagtcctgtatcgcgacactttcgtgatgtagcaagactgaagaaaggtacccccgtcgttggcgtgattaacaacgctgatgttgggagactgattttctctggtgaggcccttacctacaaagacattgtagtgtgcatggacggagacaccatgcccggcctctttgcctacaaagcccgactcggaccgatg

SEQ ID NO: 9617 - DNA, 203 bp, Homo sapiens
  source 1..203: mol_type = other DNA
ggcgcgccagtcctgggctgatacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataacgactcggaccgatg

SEQ ID NO: 9618 - DNA, 203 bp, Homo sapiens
  source 1..203: mol_type = other DNA
ggcgcgccagtcctagttaagaacatttgtccgtgaggcgggcgcgctgcttagacgccactcgatctcgctcctgtccctggagcacaccctgtgtacctatgtatgacaccgacccccatcgccgcggctcccggcccgggccctatcacggcaaggagcgccggcggtcgcgctcctctgcggcccgactcggaccgatg

SEQ ID NO: 9619 - DNA, 203 bp, Homo sapiens
  source 1..203: mol_type = other DNA
ggcgcgccagtcctagaccctgaccacgcctgcttcacgcctcgtttactaatggaatattaataaatatcttcctgttggctctctttgaagtggttgccatggtttcgtttaagcaggtgagggtgccattgtttaccgccatcgcacttgttattgttctactcctggcatactttttgccaccccgactcggaccgatg

SEQ ID NO: 9620 - DNA, 203 bp, Homo sapiens
  source 1..203: mol_type = other DNA
ggcgcgccagtccttttgtataaccactcaccacattggtgtgcacctgggttgatggcgggaccgtcgattccctgacgactacgaacacctaaatgaagcggaaggcttcatttggtgaccccgacgtgatagttagggaatagtggtcggccacagacggcgtggcgatcctgtcctcatccgtccgactcggaccgatg

SEQ ID NO: 9621 - DNA, 203 bp, Homo sapiens
  source 1..203: mol_type = other DNA
ggcgcgccagtcctaagatcacaccattcaccacattggtgtgcacctgggttgatggcgggaccgttgattccctgacgactacgagcacctgcatgaagcagaaggcttcatttggtgaccccgacgtgatagttagggaatagtggtcggccacagacggcgtggcgatcctgtctccatccgtccgactcggaccgatg

SEQ ID NO: 9622 - DNA, 203 bp, Homo sapiens
  source 1..203: mol_type = other DNA
ggcgcgccagtcctgggtttgcaccccggctactcctgctcagcatggctgctttagggactgttctcttcagtgtccggaggctgcactgcagcgtagccgcttgggcgggcggccagtggcgactacagcagggactggctgccaacccctccggctacgggccccttaccgagctcccagactggcgactcggaccgatg

SEQ ID NO: 9623 - DNA, 203 bp, Homo sapiens
  source 1..203: mol_type = other DNA
ggcgcgccagtcctctcgaattacgaaagtgtgactcaccaacaccgcaccccccttgcacctattaaagagggtgctgcctagaaatcggtgctgagacaatggaggcagccttgcttgtgtgtcagtacaccatccagagccttatccaactcacgcgtgatgatcctggttttttcaatgttgagcgactcggaccgatg

SEQ ID NO: 9624 - DNA, 203 bp, Homo sapiens
  source 1..203: mol_type = other DNA
ggcgcgccagtcctaggatagaacgatttatgacagtaatgtaattcgcgtcagtcgtcggaaacgagaagacagtttactaaaaaagatgagattggagtatggaaacgcacttatactatgacaccctgtatcaatatcaaggcggagtgtatccggctcatatttgcctgccgacagatgtgtgtcgactcggaccgatg

SEQ ID NO: 9625 - DNA, 203 bp, Homo sapiens
  source 1..203: mol_type = other DNA
ggcgcgccagtcctccttcctaacggaagtctcgttctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaacgactcggaccgatg

SEQ ID NO: 9626 - DNA, 203 bp, Homo sapiens
  source 1..203: mol_type = other DNA
ggcgcgccagtcctctgtttgaacgggctctcccttgggtgcttagccccgcccccgtcccactctgccctgttgctgtcgcgccgctgctggttgctgtccctggtggggtggaagacaacccgtgagtattacaccttcatgtgggttactttgcccattgacctaaacaacaaatcagctaaacacgactcggaccgatg

SEQ ID NO: 9627 - DNA, 203 bp, Homo sapiens
  source 1..203: mol_type = other DNA
ggcgcgccagtcctcagtacagactgaccaaagctggaaatctttttttcaaaggctttggaagcagttagatctaagtgaccaagaagacgagggggaggatggaggctctgaaccagcgtttcaatgctctagaagaccagctcatggacatatatgaacaagggagtgataaattagaagatcaacgactcggaccgatg

SEQ ID NO: 9628 - DNA, 203 bp, Homo sapiens
  source 1..203: mol_type = other DNA
ggcgcgccagtcctcacatgtaactgactgactcctttggattttgacctcagaatgcctacctgacctcccacttgcctctcccttctcggattgccggtggtgcctggcggaaaaagcacaagtgtgttgcaggctaccaaactcctacccgacaaaggtgcgtgtccgcgtgctgagtaatgggacgactcggaccgatg

SEQ ID NO: 9629 - DNA, 203 bp, Homo sapiens
  source 1..203: mol_type = other DNA
ggcgcgccagtcctttggaatcactggaccctttaaaacatccggtcacgccctttgcaaattatttaaaaggtgaatgctcaactgagaccatcgcaatcatgaagtcctccaagaatgacacgttcgtctatagaacgtggttcaaaacgcttgttgtgtactttgtgatgtttgtcatgtcggcgcgactcggaccgatg

SEQ ID NO: 9630 - DNA, 203 bp, Homo sapiens
  source 1..203: mol_type = other DNA
ggcgcgccagtcctgttcgcgaactggcgtgaattgtgcccaccagagggtgagcccacctgtctgacttggcccccgtgtacataatactcggggtctcggcacccaggcagccttgcgtggtgctatcctgctgcagggcgtttcttaggttctcggtcagacggccgcgctgcgaggcatacagccgactcggaccgatg

SEQ ID NO: 9631 - DNA, 203 bp, Homo sapiens
  source 1..203: mol_type = other DNA
ggcgcgccagtcctgcgatgcaagaaaaaggacattgggctaaagattgccccaagaagccaagaggaccccggggaccgcgaccccaggcctccctcctgaccttagacgattagggaggtcagggtcaggagcccccccctgaacccaggataaccctcaaagtcggggggcaacccgtcaccttccgactcggaccgatg

SEQ ID NO: 9632 - DNA, 203 bp, Homo sapiens
  source 1..203: mol_type = other DNA
ggcgcgccagtcctaggccaagagaagtgcttacgggcaatctccaaacattgaaaataagggtgcatgaggggtacgaggaattcacaatggtggggaaaagggcaacagctatactcagaaaagcaaccaggagattggttcagctgatagtgagtggaagagacgaacagtcaatagccgaagcacgactcggaccgatg

SEQ ID NO: 9633 - DNA, 203 bp, Homo sapiens
  source 1..203: mol_type = other DNA
ggcgcgccagtcctcgttctacagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcgactcggaccgatg

SEQ ID NO: 9634 - DNA, 203 bp, Homo sapiens
  source 1..203: mol_type = other DNA
ggcgcgccagtcctacgaagaaagacttcactaacctattagcacttcaccacttcgatatcgtcgatcccattttcaccgtcaactactacgtttgaagaatgactgtacacaagagccgtattcgacgatcgcgaagcctgtccgtgacacacagaatacaaaaacgacctgatcacagagaaaaacgactcggaccgatg

SEQ ID NO: 9635 - DNA, 203 bp, Homo sapiens
  source 1..203: mol_type = other DNA
ggcgcgccagtcctgcgttctgagagaaaaaaccggatgtacaaatgaggagggatgtaaagacttgcagatgaggttctcatagattgttattagtgattatggtgcctcagggttgtagtttagtatgggtgagtgcattatacgtgtcggtgatagcgtctttgcatattattaacaatgaaaatcgactcggaccgatg

SEQ ID NO: 9636 - DNA, 203 bp, Homo sapiens
  source 1..203: mol_type = other DNA
ggcgcgccagtcctgtctacttagaggggtatgtgattctggtaggggacggaaggctaaaacggtttccgcccccgtctgaatttttgctttcggtttggagccgaagccgcgccgcgtgtcttgtctgctgcagcatcgttctgtgttgtctctgtttgactgtttttctgtatttgtctgaaagccgactcggaccgatg

SEQ ID NO: 9637 - DNA, 203 bp, Homo sapiens
  source 1..203: mol_type = other DNA
ggcgcgccagtcctggcccgctagaggttagtgaaacacagggaacagagaagttgacaataacatattcatcctcaatgatgtgggaaatcaacggtcctgagtcagtgcttgttaacacttatcaatggatcatcaggaattgggagactgtaaagattcaatggtctcaagatcccacaatgctgcgactcggaccgatg

SEQ ID NO: 9638 - DNA, 203 bp, Homo sapiens
  source 1..203: mol_type = other DNA
ggcgcgccagtcctgagtacctagatgaactatgattggagcctttatgaggaggacagtctgatgattacacaattggaaattcttaataatttgttgatatcagatgaactaccaatggcagtaaaaaatataatggccaggactgaccacccagaaccaattcagctggcgtacaacagctacgacgactcggaccgatg

SEQ ID NO: 9639 - DNA, 203 bp, Homo sapiens
  source 1..203: mol_type = other DNA
ggcgcgccagtcctgagcgcacagccatggaagagctggatgcttgttacatcaacgagcaacaccggctctttccccttccccgtccctcccactggtacaattgtctctattgtcaacatccctcggaagacggcgacaccctcatgtcgctggcttgtgagtacgatgaagactgcccctttcaccgactcggaccgatg

SEQ ID NO: 9640 - DNA, 203 bp, Homo sapiens
  source 1..203: mol_type = other DNA
ggcgcgccagtcctacgtcaggagccctcaaccggttggagaagctggcaagaagtacctttttgctcacaccatttccacgagctgcaaatgaaagatggcagaaagattgtggttccatgtcgagaccaggatgaactaattggaagagccaggctctctccagggtctggctggtcactaacagacgactcggaccgatg

SEQ ID NO: 9641 - DNA, 203 bp, Homo sapiens
  source 1..203: mol_type = other DNA
ggcgcgccagtcctcacatacgaggaagattaagaaaaagtgtctgtggggtctttccgtgtagaagggcacacagccataattcttcctctttatacaacatggctacacaacatacgcaatatccagacgcaaggttatcatcacctatagttttagatcagtgtgatcttgtcactcgtgcttgtcgactcggaccgatg

SEQ ID NO: 9642 - DNA, 203 bp, Homo sapiens
  source 1..203: mol_type = other DNA
ggcgcgccagtcctagcttcccaggaccggtttccgtgtcatatggatacacggggttgaaggtatcttcagacggtcttgcgcgcttcatctgcaacaacatgaagatagtgggtgcggatggacaggaacaggaggaaactgacattccatttagattgtggagaaagtttgcagccaggaggaagcgactcggaccgatg

SEQ ID NO: 9643 - DNA, 203 bp, Homo sapiens
  source 1..203: mol_type = other DNA
ggcgcgccagtcctcagattagaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaacgactcggaccgatg

SEQ ID NO: 9644 - DNA, 203 bp, Homo sapiens
  source 1..203: mol_type = other DNA
ggcgcgccagtccttgacttctaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgcgactcggaccgatg

SEQ ID NO: 9645 - DNA, 203 bp, Homo sapiens
  source 1..203: mol_type = other DNA
ggcgcgccagtcctttacaatgaggcgggtgggggacttccactacgtatcgggtatgactactgacaatcttaaatgcccgtgccagatcccatcgcccgaatttttcacagaattggacggggtgcgcctacataggtttgcgcccccttgcaagcccttgctgcgggaggaggtatcattcagagcgactcggaccgatg

SEQ ID NO: 9646 - DNA, 203 bp, Homo sapiens
  source 1..203: mol_type = other DNA
ggcgcgccagtcctttcacataagggagcctccagtgggggctgtatcatcgccgcctgttgctgcatcacgctctcgtaagaaggaggaggaccctccggatacaccaccgctccgcctagcacggctcgtctcctcatcgtactagacacagataacaaaaaagaacgaacgcacgctcggtcgcccgactcggaccgatg

SEQ ID NO: 9647 - DNA, 203 bp, Homo sapiens
  source 1..203: mol_type = other DNA
ggcgcgccagtcctgtaatggaagtaagtattacaccctttgccccacaccccctttcccttactcttccttctctaacgcactttctcctctttccccagtcaccctcctgctcatcgctctctggaatttgcacggacaggcattgtaccttggaattgtgctgttcatcttcgggtgcttacttgcgactcggaccgatg

SEQ ID NO: 9648 - DNA, 203 bp, Homo sapiens
  source 1..203: mol_type = other DNA
ggcgcgccagtccttcgtagccagtcgcggctggccgactcatgggttaaagtcagttgacaagacacatggcttcttcaattctggtttctgactccgtctttgcccccatccttacccacaaactctcccgtcggatccggcgacaccccgtcgcttggcatcctagggagaactcccgactgtctcgactcggaccgatg

SEQ ID NO: 9649 - DNA, 203 bp, Homo sapiens
  source 1..203: mol_type = other DNA
ggcgcgccagtcctgtagaggcagtgagcgacacactctgcgtcctcgcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 9650 - DNA, 203 bp, Homo sapiens
  source 1..203: mol_type = other DNA
ggcgcgccagtcctcgcaagttagttctgcataaaagtgctttgtccctacatgccagcggtcataaaagaattggaaagactgcagctgaaatggggaggtggtttggttagggtgccactctcgcgtaattcgacacatgagatgtactgggtgagcggctcaagtgggaatgtgacaaatagtatcgactcggaccgatg

SEQ ID NO: 9651 - DNA, 203 bp, Homo sapiens
  source 1..203: mol_type = other DNA
ggcgcgccagtcctaaacagtgagtttctgcacttaacaacacaaccaatcccactgcctaccacaagggcccggtgactcgactggctctcccatacaccgcgccacaccgtgtgttggctacggcgtacactggcactacgacctacaccgccagtgcacgcggggattcggctcacctaacgacgcgactcggaccgatg

SEQ ID NO: 9652 - DNA, 203 bp, Homo sapiens
  source 1..203: mol_type = other DNA
ggcgcgccagtcctctgccgggagttttgcataaaagtgctttgtccctacatgccagcggtcataaaagaattggaaagactgcagctgaaatggggaggtggtttggctagggtgccactctcgcgtaattcaacacatgagatgtactgggtgagcggctcaagtgggaatgtgacaaatagtatcgactcggaccgatg

SEQ ID NO: 9653 - DNA, 203 bp, Homo sapiens
  source 1..203: mol_type = other DNA
ggcgcgccagtcctcttataccatagccttcgcctcccgggggaaccatgtttcccccacgcactacgtgccggagagcgatgcagccgcccgcgtcactgccatactcagcagcctcactgtaacccagctcctgaggcgactgcatcagtggataagctcggagtgtaccactccatgctccggttcgactcggaccgatg

SEQ ID NO: 9654 - DNA, 203 bp, Homo sapiens
  source 1..203: mol_type = other DNA
ggcgcgccagtccttaacacgtatattcggtaacaatgatgtctgaagacttaccagaagtttggacagctcaatgacagtgtccatctcgtcgcttgtcagttttctgtgtgggtaaaaaaaagactattaaacattgaatgttggcggaaatgagcagttctgtttttgagtttgttttctaaaatcgactcggaccgatg

SEQ ID NO: 9655 - DNA, 203 bp, Homo sapiens
  source 1..203: mol_type = other DNA
ggcgcgccagtcctggaacgccatccgggagttgttggacgcggcgcttagccagggtccctatcctcctgactatacgcctcacggaggcgtctgaggtcatgttcaacatgaacgtggacgagagcgcctctggcgctctcggctcctcggccattcctgtgcaccccacgccggcctgggtccgacgactcggaccgatg

SEQ ID NO: 9656 - DNA, 203 bp, Homo sapiens
  source 1..203: mol_type = other DNA
ggcgcgccagtccttagatttcatgccagacagggagcagcgagggtgacatcctggctcgggaggcaactcagaactgctgggaagaggttggagggtagaagcaaaacctggtttggcgcttatgccctatcgccttactgtaatgtaacaagcaaaatagggtacatatggtacactaacaactgcgactcggaccgatg

SEQ ID NO: 9657 - DNA, 203 bp, Homo sapiens
  source 1..203: mol_type = other DNA
ggcgcgccagtcctgggtccgaattaggcctcacacgtgtggtcgaagctgctcctatccacgctatcattgctggtaggatgttgcttggtggactcattgagtacatgcaggcaaatcctggcaaacatggtagtgctgttggttgcaacccagacctacactggacaaaatttttctttaaattccgactcggaccgatg

SEQ ID NO: 9658 - DNA, 203 bp, Homo sapiens
  source 1..203: mol_type = other DNA
ggcgcgccagtcctggcgggcaattgaggggattcctaattctaggcagagaggacaaaagatatggacccgcattgagcatcaatgaactgagcaatcttgcaaaaggggagaaggctaatgtattgataatgcaaggagacgtggtgttggtaatgaaacggaaacgggactttagcatacttactcgactcggaccgatg

SEQ ID NO: 9659 - DNA, 203 bp, Homo sapiens
  source 1..203: mol_type = other DNA
ggcgcgccagtcctttactgtcatttattctattgtaagttggggggcaactggacatgtgtgaaaggcgagccagtggtctacacaggggggctagtaaaacaatgtagatggtgtggcttcgacttcgatgggcctgacggactcccgcattaccccataggtaagtgcattttggcaaatgagaccgactcggaccgatg

SEQ ID NO: 9660 - DNA, 203 bp, Homo sapiens
  source 1..203: mol_type = other DNA
ggcgcgccagtcctactgtgcacaaaaagaaagaaggttttttgatctttattgtgtgcgaataactatgaggaagattaataattttcctctcattgacacttacattaagattaagattctcattgatctgttacttactctgaggataataattggtgttcagaagtaccccattccccagtgggcgactcggaccgatg

SEQ ID NO: 9661 - DNA, 203 bp, Homo sapiens
  source 1..203: mol_type = other DNA
ggcgcgccagtcctctgctgaacaaaagttgtcggtgtcatgtgggactatgatgaagtagcagctcacacgccctctaagtctgctaagtcccacatcactggccttcggggcactgatgttcgttctggagcagcccgcaaggctgttctggacttgcagaagtgtgtcgaggcaggtgagatacccgactcggaccgatg

SEQ ID NO: 9662 - DNA, 203 bp, Homo sapiens
  source 1..203: mol_type = other DNA
ggcgcgccagtcctccgtaagacaacctaggggactaggttttctctattttaaaagatgtcaatatgggtgcaaataatagcaaggagagtgtgtccagcaatggcaatcagggtactattgtcaataatttttatgctaactcatattatgcttctattgacgcttctgcctcctcagtcgggggccgactcggaccgatg

SEQ ID NO: 9663 - DNA, 203 bp, Homo sapiens
  source 1..203: mol_type = other DNA
ggcgcgccagtcctggttgacccaactgctgctctagaaacttctcctcccgctcctttgggggctacctgtactacccaggctcctaccccagcagcctggtctacagcactgccctctgctctcccagcacctgccagctgcgttcctctctctacagggactgtcagaagacctgctgggagccccgactcggaccgatg

SEQ ID NO: 9664 - DNA, 203 bp, Homo sapiens
  source 1..203: mol_type = other DNA
ggcgcgccagtcctcgggcgcacaactgttgctctagaaacttctcctcctgctcccacgggggttacttgcactacccaggctcctcctgtggctcttcctaccccagcaacctggtctacagcactgacctctgctctcccagcacctgccagctgggttcctctctctataggggctgtcaggagcgactcggaccgatg

SEQ ID NO: 9665 - DNA, 203 bp, Homo sapiens
  source 1..203: mol_type = other DNA
ggcgcgccagtccttctagttgcaaggatgccaaggaatggctcgacaacacgcgccaagtgtgtttgaagaacgggaacgtccatattgccaacctttgcaaagtggtcgccccagcacccagcaagtcgagacccgagcccgtggtcgtttgcctccgcggcaagtctggccagggcaagagtttccgactcggaccgatg

SEQ ID NO: 9666 - DNA, 203 bp, Homo sapiens
  source 1..203: mol_type = other DNA
ggcgcgccagtccttcgcttcgcaaggcccaacctagagtcaagctgtaactctaggggaaggactagaggttagaggagaccccttgcgagtgaacaccacaagagacagcatattgacacctgggatagactaggagaccctctgtcctaacaacaccaaccacttggcacagatcgccgaaagtgcgactcggaccgatg

SEQ ID NO: 9667 - DNA, 203 bp, Homo sapiens
  source 1..203: mol_type = other DNA
ggcgcgccagtcctcaactgaccaatacagaaatatgttctggcactttagaaatgcttctgattgtgaacgttgtaattactgggacaatgtataccgtatgcacttagctcatgtttcctctcagacagaatcagaagaaataactgacgaggaaatgctttctgctgctgaaagtatggaaacagcgactcggaccgatg

SEQ ID NO: 9668 - DNA, 203 bp, Homo sapiens
  source 1..203: mol_type = other DNA
ggcgcgccagtcctgcctcactcaattctgggacggaaccgactactttggggtgtccgtgtttcttttgttcatattaaactgttttatggtcacaacacaacttggtacgatttgtgattattcactgctcacttgtcacagtaaatatacacaatcatcatgcctgtcgttgtgaactcagtttacgactcggaccgatg

SEQ ID NO: 9669 - DNA, 203 bp, Homo sapiens
  source 1..203: mol_type = other DNA
ggcgcgccagtcctgatcgccgcaattggtccaggagagggtggctaggcctgcatccttgcgaccacgttggcataaaccttccactgttcttgaagtattgaatcctaggactgttgttattttggaccatcttggcaacaacagaactgtaagtattgacaatttaaaacctacttctcatcagacgactcggaccgatg

SEQ ID NO: 9670 - DNA, 203 bp, Homo sapiens
  source 1..203: mol_type = other DNA
ggcgcgccagtcctcaatcattcaccaagaggaactgactgaattacacaagaaacgtggggagctcaactggtgattgacctgaataaccaaatgcagcggaaggacagggagatgcagatgaatgaagcaaaaattgcagaatgtttgcagactatctctgacctggagacggagtgcctagacctcgactcggaccgatg

SEQ ID NO: 9671 - DNA, 203 bp, Homo sapiens
  source 1..203: mol_type = other DNA
ggcgcgccagtcctccacaccacaccggcaagtcacatgagccaccaaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatacgactcggaccgatg

SEQ ID NO: 9672 - DNA, 203 bp, Homo sapiens
  source 1..203: mol_type = other DNA
ggcgcgccagtcctttaaactccacctctgactaaggggattttaggatttgtgttcacgctcaccgtgcccagtgagcgaggactgcagcgtagacgctttgtccaaaatgcccttaatgggaacggggatccaaataacatggacaaagcagttaaactgtataggaagctcaagagggagataaccgactcggaccgatg

SEQ ID NO: 9673 - DNA, 203 bp, Homo sapiens
  source 1..203: mol_type = other DNA
ggcgcgccagtcctctttattgcacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggccagccagctgtcgactcggaccgatg

SEQ ID NO: 9674 - DNA, 203 bp, Homo sapiens
  source 1..203: mol_type = other DNA
ggcgcgccagtccttaatccagcagcatcaggaactccggctttctttgatcttaaaaaccttaaaggctggtcagggctaccgatatttgaggcatcaagtggaagggtagtcggcagggtcaaggtcggtaagaatgaggactctaaaccaaccaagcttatgagtggaatacaaacagtttccaacgactcggaccgatg

SEQ ID NO: 9675 - DNA, 203 bp, Homo sapiens
  source 1..203: mol_type = other DNA
ggcgcgccagtcctacgtaccgcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgcgactcggaccgatg

SEQ ID NO: 9676 - DNA, 203 bp, Homo sapiens
  source 1..203: mol_type = other DNA
ggcgcgccagtcctctcaattacaggaggagcccgtgaatcccaggtgtcattcgcgcgtcatccccgcgcacccccagtcccattaacatagcgggcacaatggtgcaggcaccgtctgtatacgtctgcggctttgtggagcgcccggacgccccacccaaggacgcctgccttcacctggatccccgactcggaccgatg

SEQ ID NO: 9677 - DNA, 203 bp, Homo sapiens
  source 1..203: mol_type = other DNA
ggcgcgccagtccttgtgtgggcagggtgacaaagacataatggattccaacactgtgtcaagctttcaggtagactgctttctttggcatgtccgcaaacgatttgcagaccaagaactgggtgatgccccattccttgaccggcttcgccgagatcagaagtccctaagaggaagaggcagcactccgactcggaccgatg

SEQ ID NO: 9678 - DNA, 203 bp, Homo sapiens
  source 1..203: mol_type = other DNA
ggcgcgccagtcctagttggtacagggttaataatcactcaccgagtgacatcaaaatcatggcgtcccaaggcaccaaacggtcttatgaacagatggaaactgatggggatcgccagaatgcaactgagattagggcatccgtcgggaagatgattgatggaattgggagattctacatccaaatgcgactcggaccgatg

SEQ ID NO: 9679 - DNA, 203 bp, Homo sapiens
  source 1..203: mol_type = other DNA
ggcgcgccagtcctgtgtcgtccaggtactgattcgaaatggaagattttgtgcgacaatgcttcaacccgatgattgtcgaacttgcagaaaaagcaatgaaagagtatggagaggatctgaaaattgaaacaaacaaatttgcagcaatatgcacccacttggaggtatgtttcatgtattcagatcgactcggaccgatg

SEQ ID NO: 9680 - DNA, 203 bp, Homo sapiens
  source 1..203: mol_type = other DNA
ggcgcgccagtcctagcacttgcagtaacgagctcgtgccgcgacagagggccttcagctaggacaacaacagcgagtgggaaactgataacagattggtgctgtaggtcttgcaccaccccaccactgagatttgttacaaaaagtggatgctggtatgggatggaaattcggccaactgctcacggcgactcggaccgatg

SEQ ID NO: 9681 - DNA, 203 bp, Homo sapiens
  source 1..203: mol_type = other DNA
ggcgcgccagtcctgcgcaacgcagtaacgagctcgtgccgcgacagagggccttcagctaggacaacaacagcgagtgggaaactgataacagattggtgttgtaggtcttgcaccaccccaccactgagatttgttacaaaaagtggatgctggtatgggatggaaattcggccaactgctcacggcgactcggaccgatg

SEQ ID NO: 9682 - DNA, 203 bp, Homo sapiens
  source 1..203: mol_type = other DNA
ggcgcgccagtcctaaggcatgcagtgccagttccagacactgcccatacctgcgggcgagcatcgggtcatcgggcatatcggccttgaccgcgttgaacatgctgtatgcctcgcagcgcggccgtctgaccgagaacctaagaaacgccctgcagcaggatagcaccacgcaaggctgcctgggtcgactcggaccgatg

SEQ ID NO: 9683 - DNA, 203 bp, Homo sapiens
  source 1..203: mol_type = other DNA
ggcgcgccagtcctctaaggtacatcgatgctggatttctgagaaaccgcgtggagactctgaggcaggacaggggtgtggccaatatcccagccgagtcgtatttaaaggccagcgatgccccggacctacaaaagccggacaaggcacttcagagcccaccaccggcctccacagacccagacacccgactcggaccgatg

SEQ ID NO: 9684 - DNA, 203 bp, Homo sapiens
  source 1..203: mol_type = other DNA
ggcgcgccagtcctaacactaccatcgcggattacgaaacgccgcggagctgaggcagttccgctggctagtgtgtacgcggcgagcttctcccggcgccgcccgctcggctcccatagcgcccgcgacaggggtccggacgccgcccgaacatggactccgccggccaaggtgtggctgcccggactcgactcggaccgatg

SEQ ID NO: 9685 - DNA, 203 bp, Homo sapiens
  source 1..203: mol_type = other DNA
ggcgcgccagtcctccatacggcatgaaaatctcctggaagagttggggtcagtcaatgatctggagtgtcccggaggccccccgacggtttctggtgggcacagagggaagcagtgagtgtccactggcaaagagaagaacaggtgtcttcacagtggctgaatttggaatgggcttgagaacaaaacgactcggaccgatg

SEQ ID NO: 9686 - DNA, 203 bp, Homo sapiens
  source 1..203: mol_type = other DNA
ggcgcgccagtcctcgtgcagtcattggcgggagctattccagtgaagtactctggaagcaaattggaaatgacctcaggtcatcttaaatgtagggttaaaatgcagggtttgaagctgaaaggaatgacctacccgatgtgtagcaatacattttccctagtgaagaatcctaccgacactgggcacgactcggaccgatg

SEQ ID NO: 9687 - DNA, 203 bp, Homo sapiens
  source 1..203: mol_type = other DNA
ggcgcgccagtccttgcgttagcattggtgcactgcgcaggcgcatgcacctacggatcaacgtggaccgcattgacggcaaacccttcgatcctgtggaggccctcaaaccccttaaccaaccttccaaatatctaacctcccaaactgaactttctctcttcagatcttttaaacttactgttgcccgactcggaccgatg

SEQ ID NO: 9688 - DNA, 203 bp, Homo sapiens
  source 1..203: mol_type = other DNA
ggcgcgccagtcctcgcaaagcccaaagaaggaggacttatgtacgcagacgacacggctggatgggacactagaataaccaaggctgatttggaaaacgaagccatcattttggaaaagatggaaccaatgcacagagctgtcgcagaaccactcattaaatttgcctacatgaacaaggtggtgaacgactcggaccgatg

SEQ ID NO: 9689 - DNA, 203 bp, Homo sapiens
  source 1..203: mol_type = other DNA
ggcgcgccagtcctttatttatccacagcccttcttgccctccccggcaacattgccggcggtgctccttctgcgacggtcaacgccaacaacacttctatctcctctcaagctcttttaccctccgtcaacccttacccttctactcctgctgtctcactccccaaccccgacgcccccactcaagtcgactcggaccgatg

SEQ ID NO: 9690 - DNA, 203 bp, Homo sapiens
  source 1..203: mol_type = other DNA
ggcgcgccagtcctcattgactccaccaaactgccagccccctccatcgaagaggtagtggtaagaaagcgccagttccgggcaagaactggttcgcttaccttgcctccccctccgagatccgtcccaggagtgtcatgtcctgaaagcctgcaacgaagtgacccgttagaaggtccttcaaacctcgactcggaccgatg

SEQ ID NO: 9691 - DNA, 203 bp, Homo sapiens
  source 1..203: mol_type = other DNA
ggcgcgccagtcctctaatgatccaccgcggtaaaggtcgctgggaagaccccgtggatccactactctcgactcaagaaagctcctgacaaccaagaagaatggactgtctcaccaacctccgatccactgagggtaaagttgaccaggcgggcaaaaccctaattcttcttgtggtttggtgggggcgactcggaccgatg

SEQ ID NO: 9692 - DNA, 203 bp, Homo sapiens
  source 1..203: mol_type = other DNA
ggcgcgccagtcctagcgacctccactgcatacacgcagaatgggacactggtctgaactccaagttcacgttttcaatcccgtacatctcggccgctgactacgcgtacaccgcgtcccacaaggctgaaacaacaagtgtacaggggtgggtctgtgtgtaccaaatcactcacggcaaggcagaccgactcggaccgatg

SEQ ID NO: 9693 - DNA, 203 bp, Homo sapiens
  source 1..203: mol_type = other DNA
ggcgcgccagtccttgaggcctccactgctctccaggaagataaggcttttaaagcagcctagcactagaaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 9694 - DNA, 203 bp, Homo sapiens
  source 1..203: mol_type = other DNA
ggcgcgccagtcctgccgcgggccatatttccggtatatgaccttcgtaagctgctcggtgcgcttgtcatttcggaaggtagtgtcaagttcgacatataatgtctttgaaggactatctgagacagtccatttctaaagatttggaggtgagacatcgagattctttaaagattagattaggggagcgactcggaccgatg

SEQ ID NO: 9695 - DNA, 203 bp, Homo sapiens
  source 1..203: mol_type = other DNA
ggcgcgccagtcctagatcgggccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggcgactcggaccgatg

SEQ ID NO: 9696 - DNA, 203 bp, Homo sapiens
  source 1..203: mol_type = other DNA
ggcgcgccagtcctagttagcgcccaaaaactgaccaccgaccgcattccatttctcgatatcttcgacgataggtacaacctagtcagacacgtcgaacgacaattaaactggtacgccgcatatgccgaagcagcgcagcaagatcttattgctcctcttacgttttaacggtcgcgttctaaccccgactcggaccgatg

SEQ ID NO: 9697 - DNA, 203 bp, Homo sapiens
  source 1..203: mol_type = other DNA
ggcgcgccagtcctcgcattaccccaaatgaagtgggagctagaatattgacatcagagtcgcaattgacaataacaaaagagaagaaagaagagctccaggattgtaaaattgctcctttaatggtggcatacatgttggaaagagaactggtccgcaaaaccagatttctaccggtagcaggcggacgactcggaccgatg

SEQ ID NO: 9698 - DNA, 203 bp, Homo sapiens
  source 1..203: mol_type = other DNA
ggcgcgccagtccttcgccaatcccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgccgactcggaccgatg

SEQ ID NO: 9699 - DNA, 203 bp, Homo sapiens
  source 1..203: mol_type = other DNA
ggcgcgccagtcctacgcgcctccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgccgctgtcactctccatagcggacgcccgactcggaccgatg

SEQ ID NO: 9700 - DNA, 203 bp, Homo sapiens
  source 1..203: mol_type = other DNA
ggcgcgccagtcctgaacgagcccccgtctacgggaaggtttacaacccccctcggactgctctgccggggcggttcacaaactacctggatgttgccgaggcttgtcccaccttcctgatgttcgagaacgtaccttacgtctcaacacgaactgacgggcaaaggctactggccaagttcgacgtgcgactcggaccgatg

SEQ ID NO: 9701 - DNA, 203 bp, Homo sapiens
  source 1..203: mol_type = other DNA
ggcgcgccagtcctagagtttacccctgctcttgttcccggggggcttctggctaagcagtttggtgataatatgagagagtttttacaactagaacttaaagaagaacttagagccaagggcatgtcaattgatgttgccattctcaattcgctacaggtgacacaggagcaagatattttgtcattcgactcggaccgatg

SEQ ID NO: 9702 - DNA, 203 bp, Homo sapiens
  source 1..203: mol_type = other DNA
ggcgcgccagtcctaatacccgcccgcctttcataagttttaccgtctgtcccgacgttaaagggaggtaaccacaagcatactgccgccttccccggcgttaacgggatgcaaccgtaagacacaccttcatccggaagtaaaacggctgcgtcacatagttttgcccgttttcacgagaaacgggacgactcggaccgatg

SEQ ID NO: 9703 - DNA, 203 bp, Homo sapiens
  source 1..203: mol_type = other DNA
ggcgcgccagtcctgcccgtgaccctgtagccggagggttattttccaagggttgagtcgcgggacccccggttcgagtctgggaccggccggactgcggcgaacgggggtttgcctccccgtcatgcaagaccccgcttgcaaattcctccggaaacagggacgagccccttttttgcttttcccagcgactcggaccgatg

SEQ ID NO: 9704 - DNA, 203 bp, Homo sapiens
  source 1..203: mol_type = other DNA
ggcgcgccagtccttcctggctccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 9705 - DNA, 203 bp, Homo sapiens
  source 1..203: mol_type = other DNA
ggcgcgccagtccttgccgaccccgatgatggcgcaagtgggagtaaagagaagaagccagataggatcaacaaaggcaaattaaaaatagccccaaaagagcatgagaaggacagcagaactaggccacctgacgctacgatcgtggtggaaggagtaaaataccaggtcaaaaagaaaggtaaagtcgactcggaccgatg

SEQ ID NO: 9706 - DNA, 203 bp, Homo sapiens
  source 1..203: mol_type = other DNA
ggcgcgccagtcctaaacatacccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctcccgactcggaccgatg

SEQ ID NO: 9707 - DNA, 203 bp, Homo sapiens
  source 1..203: mol_type = other DNA
ggcgcgccagtcctgcgtgtaaccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgcgactcggaccgatg

SEQ ID NO: 9708 - DNA, 203 bp, Homo sapiens
  source 1..203: mol_type = other DNA
ggcgcgccagtcctgacaaaccccgcgccgcgcgtcttgtctgctgcagcatcgttctgtgttgtctctgtttgactgtttttctgtatttgtctgaaaacatgggccaggctgttaccacccccttaagtttgactttagaccactggaaggatgtcgaacggacagcccacaacctgtcggtagagcgactcggaccgatg

SEQ ID NO: 9709 - DNA, 203 bp, Homo sapiens
  source 1..203: mol_type = other DNA
ggcgcgccagtcctctcgttgtccgcgccgcgcgtcttgtctgtctcagtgttgttctgtcatttgtctgttcattgttgttttggaccgtttctaaaaatatgggacagaccgtaaccactcccttgagtctgacccttgaacactggggagacgtccagcgcattgcgtccaaccagtccgtggaccgactcggaccgatg

SEQ ID NO: 9710 - DNA, 203 bp, Homo sapiens
  source 1..203: mol_type = other DNA
ggcgcgccagtcctctgtgggcccgctccgcctagcacggctcgtctcctcatcgtactagacacagataacaaaaaagaacgaacgcacgctcggtcgccatggccttggtgagttgcctttttattttactttcacttttacaacatgcgcccgaatctgggacgcagatgagcgaacgggttgcccgactcggaccgatg

SEQ ID NO: 9711 - DNA, 203 bp, Homo sapiens
  source 1..203: mol_type = other DNA
ggcgcgccagtcctgcagattcccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggtcgactcggaccgatg

SEQ ID NO: 9712 - DNA, 203 bp, Homo sapiens
  source 1..203: mol_type = other DNA
ggcgcgccagtcctggctttcaccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcacccgactcggaccgatg

SEQ ID NO: 9713 - DNA, 203 bp, Homo sapiens
  source 1..203: mol_type = other DNA
ggcgcgccagtcctacagatagccggtccctccccggggctggagcctttggtaacgtggttgctggtcaggaaattcccatctacgcgatggagtccttccgtccaccagttgactacctaccagccaaagtcaacgattggcttgagttcgcccaccgccctggtctgttcgagtcttacacttggcgactcggaccgatg

SEQ ID NO: 9714 - DNA, 203 bp, Homo sapiens
  source 1..203: mol_type = other DNA
ggcgcgccagtcctgctctataccgttgacgcggctaatgaccaggacatctatcaaccaccatgtggagctgggtcccttactcggtgctcttgcggggagaccaaggggtatctggtaacacgactggggtcattggttgaggtcaacaaatccgatgacccttattggtgtgtgtgcggggccctcgactcggaccgatg

SEQ ID NO: 9715 - DNA, 203 bp, Homo sapiens
  source 1..203: mol_type = other DNA
ggcgcgccagtcctgtttccaacctaggaaaccctcagctcagagaacaaccctgcattccccacacaacacccacaatcagccactgcgggcgaggagggcacgaggccaggttcccaagagctcagggaacgggcctggctctggcccctgacgcaggaacatggagctgatccaggacacctccccgactcggaccgatg

SEQ ID NO: 9716 - DNA, 203 bp, Homo sapiens
  source 1..203: mol_type = other DNA
ggcgcgccagtcctttgctttacctccgagtgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccccgactcggaccgatg

SEQ ID NO: 9717 - DNA, 203 bp, Homo sapiens
  source 1..203: mol_type = other DNA
ggcgcgccagtcctgattagatcctcggagggtggattcagcggccatcctatttgataatctcgcggtggagatatttaacgatgtaatatatcgacaaaatggagttgccgcgaaaatacgacagggtaacgggcaggatattgacacataagaataaccagatgtgtacaaccgaatgttctcagcgactcggaccgatg

SEQ ID NO: 9718 - DNA, 203 bp, Homo sapiens
  source 1..203: mol_type = other DNA
ggcgcgccagtccttgtgaacacctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtacgactcggaccgatg

SEQ ID NO: 9719 - DNA, 203 bp, Homo sapiens
  source 1..203: mol_type = other DNA
ggcgcgccagtcctactaatcgcctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcaagcgctctcgactcggaccgatg

SEQ ID NO: 9720 - DNA, 203 bp, Homo sapiens
  source 1..203: mol_type = other DNA
ggcgcgccagtccttcttacttcctgtgcttgtgtttaaaaattgtcgcagcttccccaaaccaagtggtcttggttttctctttttattatattgtcaatatggcttgcaaacacggatacccagacgtgtgccctatttgcacagccgttgacgctactcccgactttgaatatttgctcatggcacgactcggaccgatg

SEQ ID NO: 9721 - DNA, 203 bp, Homo sapiens
  source 1..203: mol_type = other DNA
ggcgcgccagtcctgcgttacccgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattcgactcggaccgatg

SEQ ID NO: 9722 - DNA, 203 bp, Homo sapiens
  source 1..203: mol_type = other DNA
ggcgcgccagtcctaactatcgcgaccaactcttccttaaacacaacaagggagacatggacgaaccctggcccggactcgaggcggccgccgacctttacttctccaaatttccaaccatgatccatactctgacgatggaagaggcaatcaatggaactcccaatctcgagggcattgacatgaatcgactcggaccgatg

SEQ ID NO: 9723 - DNA, 203 bp, Homo sapiens
  source 1..203: mol_type = other DNA
ggcgcgccagtcctgcctggtccgacggatgacagaatagggctcccccaagacaatttccaccaagtggagacgaaatgcccctgtggttacaagatgaaggcagttaagaattgtgctggagaactgagactcttggaggaggagggttcatttctctgcagaaataaattcgggagaggttcacgcgactcggaccgatg

SEQ ID NO: 9724 - DNA, 203 bp, Homo sapiens
  source 1..203: mol_type = other DNA
ggcgcgccagtcctagtctacacgatgattgccactgatcctggcggcctgggtattctcggtatccatgtcgccggggtggctggctacaacggcttctccgcgcgccttacccctgaacgtgtccaagctttcctctctaacctggccacacctcagtctgttcttcatttccacccacccatgggcgactcggaccgatg

SEQ ID NO: 9725 - DNA, 203 bp, Homo sapiens
  source 1..203: mol_type = other DNA
ggcgcgccagtcctatcaagagcgcacgtctctcgtcgcagtcggctccatccctcccctgcctttggcgccttccccatcaccaaagaaccagcagccctttctaggaaggaccctcgcctccccgagggcaccgacctggatgctatcaccctcgccaagcacgacaagggcgacatcgcgacgcccgactcggaccgatg

SEQ ID NO: 9726 - DNA, 203 bp, Homo sapiens
  source 1..203: mol_type = other DNA
ggcgcgccagtcctaaggagcgcgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtcgactcggaccgatg

SEQ ID NO: 9727 - DNA, 203 bp, Homo sapiens
  source 1..203: mol_type = other DNA
ggcgcgccagtcctcacgtagccgcccgcagcacgcggatcttacggcctgcgtcatcacccagggcacgatcctcgcccaattgcacgccatccaaaaatcccgccaagagtttcttctgaaaaagggtaaaggggtctacctggacccccagacgggcgaagtgcttaacccgggtctcccccagccgactcggaccgatg

SEQ ID NO: 9728 - DNA, 203 bp, Homo sapiens
  source 1..203: mol_type = other DNA
ggcgcgccagtcctgtcattctcgccgacatggagctgttcctcgcgggccgccgggtgctggtcaccggggcaggcaaagggcgcggcacggtccaggcgctgcacgcgacgggcgcgcgggtggtggctgtgagccggactcaggcggatcttgacagccttgtccgcgagtgcccggggatagaacgactcggaccgatg

SEQ ID NO: 9729 - DNA, 203 bp, Homo sapiens
  source 1..203: mol_type = other DNA
ggcgcgccagtcctatccttcccggacggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgactcggaccgatg

SEQ ID NO: 9730 - DNA, 203 bp, Homo sapiens
  source 1..203: mol_type = other DNA
ggcgcgccagtcctgattcgcccggccccgccgggcggccgcgggtgggtagagaacatggacttcccgtgcctctggctagggctgttgctgcctttggtagctgcgctggatttcaactaccaccgccaggaagggatggaagcgtttttgaagactgttgcccaaaactacagttctgtcactcacgactcggaccgatg

SEQ ID NO: 9731 - DNA, 203 bp, Homo sapiens
  source 1..203: mol_type = other DNA
ggcgcgccagtcctcgatagatcggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacacgactcggaccgatg

SEQ ID NO: 9732 - DNA, 203 bp, Homo sapiens
  source 1..203: mol_type = other DNA
ggcgcgccagtcctatccactacggctcctgaaaaagactgtatgcccaaggccagacggcagcgaactcgtcgcacacgcagcaacagaccaccaacaccatgggtaagataattgctttccttttattccatcttacatgtatcacaatcactaaacagagccggtgcacgcttacggtaggtgtccgactcggaccgatg

SEQ ID NO: 9733 - DNA, 203 bp, Homo sapiens
  source 1..203: mol_type = other DNA
ggcgcgccagtcctttcatcgccggctggacttgtccggttggttcacggctggctacagcgggggagacatttatcacagcgtgtctcatgcccggccccgctggttctggttttgcctactcctgctcgctgcaggggtaggcatctacctcctccccaaccgatgaaggttggggtaaacactcccgactcggaccgatg

SEQ ID NO: 9734 - DNA, 203 bp, Homo sapiens
  source 1..203: mol_type = other DNA
ggcgcgccagtcctacgctttccgggatgccatctggctgttccgcaacaagcatcatcaacacaattttgaataacatctacgttctctacgccctgcgtagacactatgagggggttgagctggacacctacaccatgatctcctatggagacgacatcgtggtggcaagcgattatgatctggaccgactcggaccgatg

SEQ ID NO: 9735 - DNA, 203 bp, Homo sapiens
  source 1..203: mol_type = other DNA
ggcgcgccagtccttaagggttcgtacagtgatctggtcaagtacgtcattctagtggcagctgcatttgctgagagcaatacaggtggtgacattgtgcacttggccatggtggctgcttttaacatccagccaggtttactgattggattcctactgaggaggaagtggagcaatcaggaaagcagcgactcggaccgatg

SEQ ID NO: 9736 - DNA, 203 bp, Homo sapiens
  source 1..203: mol_type = other DNA
ggcgcgccagtcctttaccacacgtctcgctgaggtcatcctttacggcaggcgtccgcgtcgctagctagtcgttctgaagcggcggccagagaagagtcaagggcacgagcatcggccatgcctttcttggacatccagaaaaggttcggccttaacatagatcgatggttgacaatccagagtggcgactcggaccgatg

SEQ ID NO: 9737 - DNA, 203 bp, Homo sapiens
  source 1..203: mol_type = other DNA
ggcgcgccagtcctcttactagcgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagccgactcggaccgatg

SEQ ID NO: 9738 - DNA, 203 bp, Homo sapiens
  source 1..203: mol_type = other DNA
ggcgcgccagtcctcctggacactaattcttctgtataagggcagggggtgggtatttaaggatctatatgcccttctctacctgcacctccaaatgagagatgactcggcgtagggtgctaagcgtggtcgtgctgctagccgccctggcgtgccgcctcggtgcgcagaccccagagcagcccgcacgactcggaccgatg

SEQ ID NO: 9739 - DNA, 203 bp, Homo sapiens
  source 1..203: mol_type = other DNA
ggcgcgccagtcctagattcgtctacaaccgcttccagctacgttactggccccccgtaccctaagatacggggaaaggattccactcagtcagcccccgccaaacggcctacaaaaaagaagttgggaaagagtgagttttcgtgcagcatgagctacacttggaccgacgtgattagcttcaaaaccgactcggaccgatg

SEQ ID NO: 9740 - DNA, 203 bp, Homo sapiens
  source 1..203: mol_type = other DNA
ggcgcgccagtcctctatacaactaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggcgactcggaccgatg

SEQ ID NO: 9741 - DNA, 203 bp, Homo sapiens
  source 1..203: mol_type = other DNA
ggcgcgccagtcctgatccagactccaaattctttgctgaaaacccccctcctgtatctcttgctggaaaaatcaacctttccgatttcactgacctcactctctccactcctggacagatggtgcgccagggcaactccaccactaacatctacggaagtaataacaatgttactactgacgtgggtcgactcggaccgatg

SEQ ID NO: 9742 - DNA, 203 bp, Homo sapiens
  source 1..203: mol_type = other DNA
ggcgcgccagtcctaatctttactcccacgtggcctcctttgtgctggcctggacacgcgcttttgtatcagagtgggctgggttcctctacgaagaggaccgaggcactccgctcgaggacaggcccataaagtcggtctacggggacacggacagcctctttgtcacccagcggggacacgaactccgactcggaccgatg

SEQ ID NO: 9743 - DNA, 203 bp, Homo sapiens
  source 1..203: mol_type = other DNA
ggcgcgccagtcctccagagaactcccattgactcagctttctatggcctcagattccccatccccttcccaacgccccagcactggaagacacgtgctgtccctggtgccggctcctacggctcggtcgtggctggccaggaaatccccctggttggctatgcccccgctgctcccccccgcgattacgactcggaccgatg

SEQ ID NO: 9744 - DNA, 203 bp, Homo sapiens
  source 1..203: mol_type = other DNA
ggcgcgccagtccttttacgacctcgcacgtggcctcctttgtcttggcgtggacgcgcgcctttgtctcagagtggtccgagtttctctacgaggaggaccgcgggacgcccctgcaggacaggccaatcaagtccgtctacggggacaccgacagcctgtttgtcaccgagcgcggacacagactccgactcggaccgatg

SEQ ID NO: 9745 - DNA, 203 bp, Homo sapiens
  source 1..203: mol_type = other DNA
ggcgcgccagtcctgtcgtcaactcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgacgactcggaccgatg

SEQ ID NO: 9746 - DNA, 203 bp, Homo sapiens
  source 1..203: mol_type = other DNA
ggcgcgccagtcctcagacccactctaggggaaggactagaggttagaggagaccccttgcgagtgaacaccacaagaaacagcatattgacacctgggatagactaggagaccctctgtcctaacaacaccagccacttggcacagatcgccgaaagtgtggctggtggtggtagaacacagagtctcgactcggaccgatg

SEQ ID NO: 9747 - DNA, 203 bp, Homo sapiens
  source 1..203: mol_type = other DNA
ggcgcgccagtcctctactgcgctctcgttgcccgctactacccaggccccgccgcctgtctggccctgttgctcattatactatacgcctggagcttcagccattttatggactctctcaagaaccaggtgacagtcaccgccagatacttcagaagggtgcctagccagtccacctgagcgcgaggcgactcggaccgatg

SEQ ID NO: 9748 - DNA, 203 bp, Homo sapiens
  source 1..203: mol_type = other DNA
ggcgcgccagtcctacgcgggactgcgggcttgcccctaactttctttgttgcagcagctgctgcccaaccagattatgactggtgggtgcgactgctagtggcagggttagttttgtgggccggccgtaaccgtggtcaccgcatagctctgcttgtaggtccttggcctctggtagcgcttttaaccgactcggaccgatg

SEQ ID NO: 9749 - DNA, 203 bp, Homo sapiens
  source 1..203: mol_type = other DNA
ggcgcgccagtcctgaatgttactggcagaaccttgggggaggcatggaaggcccagcttaatcaactgacccggcaagagtttatggaataccggaaagacgggatcattgaagtagatagagctgctgcaaagagagcccgccgtgaagggaatgtgacaggagggcacccagtttcacgaggcaccgactcggaccgatg

SEQ ID NO: 9750 - DNA, 203 bp, Homo sapiens
  source 1..203: mol_type = other DNA
ggcgcgccagtcctcccaggccctggcagaactttgggggaggtatggaaggcccagcttaatcaactgacccggcaagagtttatggaataccggaaagacgggatcattgaagtagatagagctgctgcaaagagagcccgccgtgaagggaatgtgacaggagggcacccagtttcacgaggcaccgactcggaccgatg

SEQ ID NO: 9751 - DNA, 203 bp, Homo sapiens
  source 1..203: mol_type = other DNA
ggcgcgccagtcctggtgatatctgggcgatcgcttcctggtcctcgcctcctccgctgtctccctggagttcttgcaagtcggccaggatgtctcaggtacagcgcgtgcacagccaggctgcgaaggctgagtttgagaaagctgcagaggaggttaggcaccttaagaccaagccatcggatgagcgactcggaccgatg

SEQ ID NO: 9752 - DNA, 203 bp, Homo sapiens
  source 1..203: mol_type = other DNA
ggcgcgccagtccttggtgtccctggtgacctcgtcttcgttaagaagcacgacttccagcagttggggccacggtgggacggaccctacactgtagtcctcagtacccccaccgcggtaaaggtcgctgggaagaccccgtggatccactactctcgactcaagaaagctcctgacaaccaagaagacgactcggaccgatg

SEQ ID NO: 9753 - DNA, 203 bp, Homo sapiens
  source 1..203: mol_type = other DNA
ggcgcgccagtcctactccagcctggttggggctgcttcccagctagtagcccttggaactgacgggcactgcgtccacctggccaccacatcggacgggcaggcatttttggtgctgcctgggggctttgttattaaaggccaattggcactcacccccgaggagaggggatatattctggcacgtccgactcggaccgatg

SEQ ID NO: 9754 - DNA, 203 bp, Homo sapiens
  source 1..203: mol_type = other DNA
ggcgcgccagtccttaaggaacctgtcacgattggggaacaagcccagagaagggggagagttgggagagtaaagcctggaagatactacaggagtcaagaaactcccgttggttctaaagattaccattatgatttactgcaagcacagaggtacggtattgaagatgggataaacatcaccaaatccgactcggaccgatg

SEQ ID NO: 9755 - DNA, 203 bp, Homo sapiens
  source 1..203: mol_type = other DNA
ggcgcgccagtcctgcgctgggctgttgccaagggttcttcaggtgccccgattctgtgctcctccgggcatgttattgggatgttcaccgctgctagaaattctggcggttcagtcagtcagattagggttaggccgttggtgtgtgctggataccatccccagtacacagcacatgccactcttgacgactcggaccgatg

SEQ ID NO: 9756 - DNA, 203 bp, Homo sapiens
  source 1..203: mol_type = other DNA
ggcgcgccagtcctatgttccacttagagagttgttcttgatcaattctactgcggatctggataaagatacatcatctctctttcatatgtgatatagtaatggatcttgatcaaatatctgaaacactgagttctgtggccgaagaagagcctttaaccatgtttttacttgataaactgtatgcacgactcggaccgatg

SEQ ID NO: 9757 - DNA, 203 bp, Homo sapiens
  source 1..203: mol_type = other DNA
ggcgcgccagtcctcgtttgttcttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtcgactcggaccgatg

SEQ ID NO: 9758 - DNA, 203 bp, Homo sapiens
  source 1..203: mol_type = other DNA
ggcgcgccagtccttggcattccttggatgctgactaatcagaggaacgtcagcattttccggcccaggctaagagaagtagataagttagaatctaaattatttatcatccccttgacgaattcgcgttggaaaagcacctctcacttgccgctcttcacacccatcattctaattcggcccctgtgcgactcggaccgatg

SEQ ID NO: 9759 - DNA, 203 bp, Homo sapiens
  source 1..203: mol_type = other DNA
ggcgcgccagtcctactggtttgaacacgctaagcggcaggatagaaggcgaagaagagtgtgttctgccagggccgcgttttgctatacaaaatacgagaatgtcaggaagcaactccattatgacaaggttgcgcgcacgctcgacatcatgcgccagacatcacccttacaccagagcccagttacgactcggaccgatg

SEQ ID NO: 9760 - DNA, 203 bp, Homo sapiens
  source 1..203: mol_type = other DNA
ggcgcgccagtccttccggtcagaccaaagatgcagagagaggtaaattaaaaagaagggctattgcaacacccgggatgcaaattagagggttcgtgtacttcgttgaaactttagctagaagcatttgcgaaaagcttgaacagtctggacttccggttgggggtaatgaaaagaaggccaaactgcgactcggaccgatg

SEQ ID NO: 9761 - DNA, 203 bp, Homo sapiens
  source 1..203: mol_type = other DNA
ggcgcgccagtcctcctagtgagacccagaacttgttcaaattactggagaggggctgttccagtcaacgctaggctgtgtgggtcggctagaccggacccaactgattggactagtcttgtcgtcaattatggcgttagggactactgtaaatatgagaaaatgggagatcacatttttgttacagccgactcggaccgatg

SEQ ID NO: 9762 - DNA, 203 bp, Homo sapiens
  source 1..203: mol_type = other DNA
ggcgcgccagtccttaaacgcggacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctgcgactcggaccgatg

SEQ ID NO: 9763 - DNA, 203 bp, Homo sapiens
  source 1..203: mol_type = other DNA
ggcgcgccagtcctagctacaagaggacttggatgaggatgaggaagaggaggaggatgcacccgctgcggggtactgacgcctccgtgatgtgtttttagatgtcccagcagcaagccccggaccccgccataagggcggcgctgcaaagccagccgtccggtctagcatcggacgactgggaggcccgactcggaccgatg

SEQ ID NO: 9764 - DNA, 203 bp, Homo sapiens
  source 1..203: mol_type = other DNA
ggcgcgccagtcctaggtccatgaggagggaagagagaaattggcagctctcttcaggaaatttcctcctcctataccaaattccccctcatctgagggggggcggttcttgttctccctgagccaccatcacccagacacaggcagtctaacaaggaggtgatgtgtgactcggaacaacacccgctcgactcggaccgatg

SEQ ID NO: 9765 - DNA, 203 bp, Homo sapiens
  source 1..203: mol_type = other DNA
ggcgcgccagtcctgcatcgatgaggatggttcggaggatggggaattttcagacctggatctgtctgacagcgaccatgaaggggatgagggtgggggggctgttggagggggcaggagtctgcactccctgtattcactgagcgtcatctaataaagatgtctattgatctcttttagtgtgaatccgactcggaccgatg

SEQ ID NO: 9766 - DNA, 203 bp, Homo sapiens
  source 1..203: mol_type = other DNA
ggcgcgccagtccttgggaggtgagggagtatcctaggaagagattgtctgcagggcctagggctccgcttgacaaatttatagggagggccactgttcttactgttgcgctacatctggctattccgctcaaatggaagccagaccacacgcctgtgtggattgaccagtggccccttcccgagggtcgactcggaccgatg

SEQ ID NO: 9767 - DNA, 203 bp, Homo sapiens
  source 1..203: mol_type = other DNA
ggcgcgccagtccttccactccgaggggcgtgtctgcatagcgttgcgtgccctcatctacaccttcaagacgtatcaggtatttgtaccaaagcccaccgcgctcgccacatttgtccgtgaggcgggcgcgctgcttagacgccactcgatctcgctcctgtccctggagcacaccctgtgtacctcgactcggaccgatg

SEQ ID NO: 9768 - DNA, 203 bp, Homo sapiens
  source 1..203: mol_type = other DNA
ggcgcgccagtccttccaaacggatacaagacctggctacagtaccttatcagcacagtgacaggtatctttttaataagggtactgaagggaataggtgagttggatttacacactccgaccttgccatctcatagacccctctttttcattctcgtgtaccttatttccactgcagtggtaacaagcgactcggaccgatg

SEQ ID NO: 9769 - DNA, 203 bp, Homo sapiens
  source 1..203: mol_type = other DNA
ggcgcgccagtcctttccctgggatccacttaccaatctgtggtatgggcctgaccctgtattaatatggggacgagggcatgtttgtgtttttccacaggatgccgaagcaccgcgctggattccggaaaggctggtacgcgcggcagaggaactccctgacatatcaaatgcaacgcatgacattgcgactcggaccgatg

SEQ ID NO: 9770 - DNA, 203 bp, Homo sapiens
  source 1..203: mol_type = other DNA
ggcgcgccagtcctggccacgggatgttgttgtatgtccgagagacacgtgaggttctgctacgtcattaccaggcacgcgcaggaaacatggcggcggcgggtgttgtgagcgggaagattatatatgaacaagaaggagtatatattcactcatcttgtggaaagaccaatgaccaagacggcttgcgactcggaccgatg

SEQ ID NO: 9771 - DNA, 203 bp, Homo sapiens
  source 1..203: mol_type = other DNA
ggcgcgccagtcctccggtgtagattgtctgacctttgaaaaaatttttgtgtccgtgtagcatttcaataaaagtcattatctgctccgagggataaatcatgtctatctcttcgttgttcggaggtagatacgataataagtttttgcttaacatgtcttcggctcccaaaatagagttgattgtacgactcggaccgatg

SEQ ID NO: 9772 - DNA, 203 bp, Homo sapiens
  source 1..203: mol_type = other DNA
ggcgcgccagtcctgcgacagcgcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagcgactcggaccgatg

SEQ ID NO: 9773 - DNA, 203 bp, Homo sapiens
  source 1..203: mol_type = other DNA
ggcgcgccagtcctcacggatggcaattggctagtcaatgcagacagactagtaagtagcaagaccgggaataggtacatacccggagagggtcacaccctgcaaggaagacattatgaagaactggtgttggcaagaaaacagatcaacaactttcaagggacagacaggtacaacctaggcccaatcgactcggaccgatg

SEQ ID NO: 9774 - DNA, 203 bp, Homo sapiens
  source 1..203: mol_type = other DNA
ggcgcgccagtccttgcaccgggcagacgagcggccgttgccgccgccgcggccatctctagcatgaccagacccaggcgcggaaacgtgtactgggtgcgcgactccatcacgggcgtgcgcgtgcccgtgcgcacccgtcctcctcgtccctgatctaatgcttgtgtcctcccccgcaagcgacgcgactcggaccgatg

SEQ ID NO: 9775 - DNA, 203 bp, Homo sapiens
  source 1..203: mol_type = other DNA
ggcgcgccagtcctggttagtcgcatgttacagatttcactactcccaccagcttggagacaacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 9776 - DNA, 203 bp, Homo sapiens
  source 1..203: mol_type = other DNA
ggcgcgccagtcctgcgcccaggcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 9777 - DNA, 203 bp, Homo sapiens
  source 1..203: mol_type = other DNA
ggcgcgccagtcctcgaacactgccccgatccagtgttaatttggggcagaggttcagtctgtgtttactctcaaacctatgatgccgctagatggctaccagaacggttagtaagacaggtgtctaacaataaccaatccagggagtgattctctccctgagatcgctctttcccttgttcacagatcgactcggaccgatg

SEQ ID NO: 9778 - DNA, 203 bp, Homo sapiens
  source 1..203: mol_type = other DNA
ggcgcgccagtcctcaaagtcggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcgactcggaccgatg

SEQ ID NO: 9779 - DNA, 203 bp, Homo sapiens
  source 1..203: mol_type = other DNA
ggcgcgccagtcctcaccctctgccggcgctccgagtgacgtagggaagcgcgccgcgcacctcatggttccggggacagttagggcggcggatggaggtcagcggtggtgctcgctgcgacatcatggcagctcacctggtaaagcgatgcacgtgcctcctgagagaagctgctcgtcaggcccctcgactcggaccgatg

SEQ ID NO: 9780 - DNA, 203 bp, Homo sapiens
  source 1..203: mol_type = other DNA
ggcgcgccagtcctccagaaccgcctcagggttgttcccaccctgagggcccacgtggcgtagtactctggtatcaaggtacctttgtacgcctattttatttcccttcccccacagtaacttagaagcttatctcatagttcaacagtagggtcactaaccaagtggctcagcgaacaagcacttctcgactcggaccgatg

SEQ ID NO: 9781 - DNA, 203 bp, Homo sapiens
  source 1..203: mol_type = other DNA
ggcgcgccagtcctagcctggggcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagacgactcggaccgatg

SEQ ID NO: 9782 - DNA, 203 bp, Homo sapiens
  source 1..203: mol_type = other DNA
ggcgcgccagtcctggaagtctgcctgtgggttgctcccacccacagggcccaagtggcgtagtacttggtattccggtacctttgtacacctatttacaaaccctaccccttgtaaccttagaagcaattatttaaccgctcactagggggtgtgctatccaagcacatcaagagcaagcacttctgcgactcggaccgatg

SEQ ID NO: 9783 - DNA, 203 bp, Homo sapiens
  source 1..203: mol_type = other DNA
ggcgcgccagtcctttctcggcgcctgtgggttgtacccacccacagggcccactgggcgctagcactctgattctacggaatccttgtgcgcctgttttatgtcccttcccccaatcagtaacttagaagcattgcacctctttcgaccgttagcaggcgtggcgcaccagccatgtcttggtcaagcgactcggaccgatg

SEQ ID NO: 9784 - DNA, 203 bp, Homo sapiens
  source 1..203: mol_type = other DNA
ggcgcgccagtcctctccaaccgcctgtgggttgtacccacccgcagggcccactgggcgctagtacactgatatcacggtacctttgtacgcctgttttatctccctacccccatcgtaacttagaagcttaacaatacagatcaatagcctctgcaccaaaccaggtgtggaatgatcaagcatttcgactcggaccgatg

SEQ ID NO: 9785 - DNA, 203 bp, Homo sapiens
  source 1..203: mol_type = other DNA
ggcgcgccagtcctgtgcgaatgcctgtgggttgttcccacccacaggcccattgggcgctagcactctggtatcacggtacctttgtgcgcctgttttacatcccctccccaaattgtaatttagaagtttcacacaccgatcattagcaagcgtggcacaccagccatgttttgatcaagcacttccgactcggaccgatg

SEQ ID NO: 9786 - DNA, 203 bp, Homo sapiens
  source 1..203: mol_type = other DNA
ggcgcgccagtcctctatgcctgcctgtgggttgttcccacccacagggcccactgggcgctagtacactggtatgccttacctcggtattacggtaccgatgtatatagtacctttgtacgcctgttttatatccctcccccacatgtaaccttagaagtttacacaaacaaagaccaataggagtccgactcggaccgatg

SEQ ID NO: 9787 - DNA, 203 bp, Homo sapiens
  source 1..203: mol_type = other DNA
ggcgcgccagtcctttatgtgagcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtcccgactcggaccgatg

SEQ ID NO: 9788 - DNA, 203 bp, Homo sapiens
  source 1..203: mol_type = other DNA
ggcgcgccagtcctatgtgagagcgcaaactaggattaattcacctgtatccctttccctccacccgcagtaactcagcgctggcgtgtgacgtggtgtaaagttttgcctgaacctgtggttgggcaggtacatgccaacaaccttctaagcacccgcgcttgtgttttgctttatctgctgccatccgactcggaccgatg

SEQ ID NO: 9789 - DNA, 203 bp, Homo sapiens
  source 1..203: mol_type = other DNA
ggcgcgccagtcctcagtatttgcgcactccggtgtccgcgatcacggacgccatcacgcgttgtcgcgagctcaccaaggtggctgccgacgccaagtctgctcctcattcctccttcctctctcaggccttgcggaactatcaacttgctctcaactctgcccgcatggcccaatctggtcctcgccgactcggaccgatg

SEQ ID NO: 9790 - DNA, 203 bp, Homo sapiens
  source 1..203: mol_type = other DNA
ggcgcgccagtcctcggagaccgcggaagtggtccgttctcttcctctcccggcccaagcttctgggtatttctattgcgcgaggcattgtgggttgctgggcggcccggtctcggagaagaggggagagtggcgggccgctgaataagcttccaaaatgatggtgggtgatggcaccacctcagtgacgactcggaccgatg

SEQ ID NO: 9791 - DNA, 203 bp, Homo sapiens
  source 1..203: mol_type = other DNA
ggcgcgccagtcctctgcacacgcggtcgcaatctgattgctccttcccacgcattcgtctccgatgattatgagatcacccacatccgcgttggatcgcgcacgcttgacgtgtcgcgtgttacgcgggtggatgacggtgagttatctctgatctcggtgccggatgggccggagcataagagcctcgactcggaccgatg

SEQ ID NO: 9792 - DNA, 203 bp, Homo sapiens
  source 1..203: mol_type = other DNA
ggcgcgccagtcctggacaaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctacccgactcggaccgatg

SEQ ID NO: 9793 - DNA, 203 bp, Homo sapiens
  source 1..203: mol_type = other DNA
ggcgcgccagtccttcacgcatgcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaaggctgccccgggagacgctggcctcgactcggaccgatg

SEQ ID NO: 9794 - DNA, 203 bp, Homo sapiens
  source 1..203: mol_type = other DNA
ggcgcgccagtcctgtggaccagcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaacgactcggaccgatg

SEQ ID NO: 9795 - DNA, 203 bp, Homo sapiens
  source 1..203: mol_type = other DNA
ggcgcgccagtcctagggctttgcgttgcgttagcactcataacagtggcaatgagagatttgaacatgagtataccaacattactcaactccggagccatggcctggctcttgccgagagccgtgtttgaagggacggttagctcctttgctctgccacttgttagcttgctggctccagggctcagcgactcggaccgatg

SEQ ID NO: 9796 - DNA, 203 bp, Homo sapiens
  source 1..203: mol_type = other DNA
ggcgcgccagtcctaaagcactgctcgtcgtctccgcatcagcggggaaagactttgagctccggctacctgtggacgctagaaaacaaactacgaccactggtgaatctgctgaccccgtcaccactaccgttgagaactacggaggagagactcaggtccaacgtcgccaccacaccgacgttgcccgactcggaccgatg

SEQ ID NO: 9797 - DNA, 203 bp, Homo sapiens
  source 1..203: mol_type = other DNA
ggcgcgccagtcctggtgtttcgctctggggttgttcccaccccagaggcccacgtggcggctagtactccggtaccccggtacccttgtacgcctgttttatactccctttcccaagtaactttagaagaaataaactaatgttcaacaggagggggtacaaaccagtaccaccacgaacacacactcgactcggaccgatg

SEQ ID NO: 9798 - DNA, 203 bp, Homo sapiens
  source 1..203: mol_type = other DNA
ggcgcgccagtccttaagattggctcttgtagcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgacgactcggaccgatg

SEQ ID NO: 9799 - DNA, 203 bp, Homo sapiens
  source 1..203: mol_type = other DNA
ggcgcgccagtcctaggaacgggctggaacattgtgacattaaagagtggggttaatgttcatttcaagccgactgaaccatctgacacactgctgtgtgacataggtgaagcttcacccgtcccagaaattgaatctgccagaacaatcagggggctgcaaatggccgaggaatggctagctaggggcgactcggaccgatg

SEQ ID NO: 9800 - DNA, 203 bp, Homo sapiens
  source 1..203: mol_type = other DNA
ggcgcgccagtcctagtttggcgctggaatctgggaacgacgagaagccaaaagataattttcacaattatgttaatgttaatagccccagcgtacagcttcagctgtctggggatgcagaaccgagactttgtcgagggagtgaatggtgttgagtggatcgatgtcgttctggaaggcggctcatgcgactcggaccgatg

SEQ ID NO: 9801 - DNA, 203 bp, Homo sapiens
  source 1..203: mol_type = other DNA
ggcgcgccagtcctatcgggtcgcttcaaaactgatgttgtaacggctcggatcgtcaccgaaataaattcgcaaattgtcaaaaagttgttcggctgtgtatgttttaatgtcattgaaaatatttagaggtgcttcgatcttaggtaaaatttcggtcgcctgccaattttccatgtttcggcgttcgactcggaccgatg

SEQ ID NO: 9802 - DNA, 203 bp, Homo sapiens
  source 1..203: mol_type = other DNA
ggcgcgccagtcctcattaggaggaaaggcattcatcaggttttcggctcagcatttaaaagcttatttggaggaatgtcatggattactcaaggcatgttgggggcactgctattgtggatggggctgaatgcaagggacagatccatttctatgacttttctagccgtaggaggaattttagtcttcgactcggaccgatg

SEQ ID NO: 9803 - DNA, 203 bp, Homo sapiens
  source 1..203: mol_type = other DNA
ggcgcgccagtcctcacctggtggaagtttctgccgcggctttgcggggacgggggagtggtagtgggggctgcagctgccggacccaggcgcgatggctacgggcgcggatgtacgggacattctagaactcgggggtccagaaggggatgcagcctctgggaccatcagcaagaaggacattatcacgactcggaccgatg

SEQ ID NO: 9804 - DNA, 203 bp, Homo sapiens
  source 1..203: mol_type = other DNA
ggcgcgccagtcctaccggtgcggaatccacgcttgaccatgtactgcttgatagagtcgcggctggccgactcatgggttaaagtcagttgacaagacacatggcttcttcaattctggtttctgactccgtctttgcccccatccttacccacaaactctcccgtcggatccggcgacaccccgtccgactcggaccgatg

SEQ ID NO: 9805 - DNA, 203 bp, Homo sapiens
  source 1..203: mol_type = other DNA
ggcgcgccagtcctgggctcccggagaatcagaccttcaactctgacttcctcctcctgggaatcttcaatcatagccccacccacaccttcctcttctttctggtcctggccatcttttcagtggccttcatgggaaactccatcatggttctcctcatctacctggatacccagctccacaccccccgactcggaccgatg

SEQ ID NO: 9806 - DNA, 203 bp, Homo sapiens
  source 1..203: mol_type = other DNA
ggcgcgccagtcctattacatgggaggagggacattggaagaagaactgtccaaaactcgtaagcggggcaaccccagtgttggtagaagaattacagtagggccgtcagggttcttccgccctccgtgaacccaggctaaaggttaaagtaggggggcaaataatagattttctagtagatacgggacgactcggaccgatg

SEQ ID NO: 9807 - DNA, 203 bp, Homo sapiens
  source 1..203: mol_type = other DNA
ggcgcgccagtcctgggtaaggggaggtcagtgaaacacaggggacagagaaactgacaataacttactcatcgtcaatgatgtgggagattaatggccctgagtcagtgttggtcaatacctatcagtggatcatcagaaactgggaaactgttaaaattcaatggtctcagaatcctacaatgctacgactcggaccgatg

SEQ ID NO: 9808 - DNA, 203 bp, Homo sapiens
  source 1..203: mol_type = other DNA
ggcgcgccagtcctatgggctgggataaagaggacgattgatggggtcctgagaggagcaggacccataaggtttgtgctggctctactgactttcttcaagtttacagccctgaggccaaccattggaatgctgaagagatggaagctggttggagttaatgaggcgactaaacatctgaaaagcttcgactcggaccgatg

SEQ ID NO: 9809 - DNA, 203 bp, Homo sapiens
  source 1..203: mol_type = other DNA
ggcgcgccagtccttccaccatggatagatgtggtgagaataggtgtgctaaccctgggaatcctctcactattgaaagagaggagcaatgcaatggcaaaaaagaagggaggcatgctcctgggagtggcatgcgctaccgctggaatcgctagccctttggtgtttgctggtctgcacatggtgctcgactcggaccgatg

SEQ ID NO: 9810 - DNA, 203 bp, Homo sapiens
  source 1..203: mol_type = other DNA
ggcgcgccagtcctcgctgacaggatcctaggcaattttgtggatctttgctgatacttcattctgcactcaaagccgcatccggcaagagtcatggggaaaacgcagtccaagggacagcccagcacaaatctcctcaaggagacagaaccaaggcatccagtaataccagatgccaggggaactggcgactcggaccgatg

SEQ ID NO: 9811 - DNA, 203 bp, Homo sapiens
  source 1..203: mol_type = other DNA
ggcgcgccagtcctgttaagccggatcctaggcatagtgtctaacactttcactgagcaactctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 9812 - DNA, 203 bp, Homo sapiens
  source 1..203: mol_type = other DNA
ggcgcgccagtcctgcccgcttggatcctaggctattggattgcgctttgcttttgtcattttggcagatagtctcagttctttgttgtgtgcatacaacacaacaatctggcgatgagtgcctcaaaggaaataaaatcctttttgtggacacaatctttgaggagggaattatctggttactgctccgactcggaccgatg

SEQ ID NO: 9813 - DNA, 203 bp, Homo sapiens
  source 1..203: mol_type = other DNA
ggcgcgccagtccttgaccgaaggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaacccgactcggaccgatg

SEQ ID NO: 9814 - DNA, 203 bp, Homo sapiens
  source 1..203: mol_type = other DNA
ggcgcgccagtcctggaggcagggatgctttaaaattaagcattgaggacccaagtcacgaaggggagggaataccactatatgatgcgatcaagtgcatgagaacattctttggatggaaagaaccctatattgttaaaccacacgaaaagggaataaatccaaattatctgctgtcatggaagcaacgactcggaccgatg

SEQ ID NO: 9815 - DNA, 203 bp, Homo sapiens
  source 1..203: mol_type = other DNA
ggcgcgccagtcctgcgtaattggccaaaccctcctcttcaacatattgggggggtgggtggctgcccagctcgccgcccccggtgccgctaccgcctttgtgggcgctggcttagctggcgccgccatcggcagcgttggactggggaaggtcctcgtggacattcttgcagggtatggcgcgggcgcgactcggaccgatg

SEQ ID NO: 9816 - DNA, 203 bp, Homo sapiens
  source 1..203: mol_type = other DNA
ggcgcgccagtcctcttccctgggccagcgatgccccggacctacaaaagccggacaaggcacttcagagcccaccaccggcctccacagacccagacaccatgctatcaggtaacgcaggagaaggagcaacagcctgcggaggttcggccgccgcgggccaggacctcatcagcgtcccccgcaaccgactcggaccgatg

SEQ ID NO: 9817 - DNA, 203 bp, Homo sapiens
  source 1..203: mol_type = other DNA
ggcgcgccagtcctctttaagcggccagtggagtgaaagccatcagggccggtctcgatgaggccaaaccctggtacaagcttattaagctcctgagccgcttgtcgtgcatggccgctgtagcagcgcggtcaaaggacccagtccttgtggccatcatgctggctgacaccggtctcgagattctgcgactcggaccgatg

SEQ ID NO: 9818 - DNA, 203 bp, Homo sapiens
  source 1..203: mol_type = other DNA
ggcgcgccagtcctaaccgacgggcccgcgcgctcctgggcgggggatgttgtgatggagaagccgcggcggagcccgaaccccgcagcctgagccacctccgtcatctgggcccggggcctcaccgcgcagattccttctggaaccccaacgccttcgagacggattccgacctgccggctggatggcgactcggaccgatg

SEQ ID NO: 9819 - DNA, 203 bp, Homo sapiens
  source 1..203: mol_type = other DNA
ggcgcgccagtcctccgggcccggcgaactcagagggggcggttaggctgtccttcttctcgactgactccatgatctttttctgcctataggagaaggaaatggccagtcgggaagaggagcagcgcgaaaccacccccgagcgcggacgcggtgcggcgcgacgtcccccaaccatggaggacgtgcgactcggaccgatg

SEQ ID NO: 9820 - DNA, 203 bp, Homo sapiens
  source 1..203: mol_type = other DNA
ggcgcgccagtcctcgagatgcggcgcgtgcgcaattggctcgagtacgctgcccgccactcttgggagaggaacctaccctggaccgctgccgacgaagttggcgaccagctagtttcctatcccatccaaccggagactctcgcaaacacccaaaccaacacagcttttgtcctgtccctcttctccgactcggaccgatg

SEQ ID NO: 9821 - DNA, 203 bp, Homo sapiens
  source 1..203: mol_type = other DNA
ggcgcgccagtcctgtgatacgggcgggcggcgaacttcctccacaccttgaaagggatgtcaaattcctggtccacaattttcattgtcttccctctcagatgtcaaagaggctccgggtggaagatgacttcaatcccgtctacccctatggctacgcgcggaatcaaaatatccccttccttactcgactcggaccgatg

SEQ ID NO: 9822 - DNA, 203 bp, Homo sapiens
  source 1..203: mol_type = other DNA
ggcgcgccagtccttcatgtacggcttcggcttaggagggcgaaaagctgagtggcgtcggagggagctctactgcagggagccaacataccctaccgagcactcagagagtcgttggaagacgggaaggaagcccgacgactgagcggtccaccccagacgtgattctggtcgcccggagatcaagccgactcggaccgatg

SEQ ID NO: 9823 - DNA, 203 bp, Homo sapiens
  source 1..203: mol_type = other DNA
ggcgcgccagtccttatcataggggacccgatatctgcctacaaggaagtcatcggccacaatctttttgatcttaagagaacaagcttcgagaagctggccaagttaaatctcagcatgtcagtactcggagcctggactagacacaccagtaaaagactactacaagactgtgtcaatgtgggtgtcgactcggaccgatg

SEQ ID NO: 9824 - DNA, 203 bp, Homo sapiens
  source 1..203: mol_type = other DNA
ggcgcgccagtcctatgtagacgggcccgggggatctcccccgcggtaactggtcacagttgccgcggacggagatcatcccccggttaccccctttcgacgcgggtactgcgatagtgccaccccagtccttcctactcccgactcccgaccccaacccaggttccttggaacaggaacaccaatttcgactcggaccgatg

SEQ ID NO: 9825 - DNA, 203 bp, Homo sapiens
  source 1..203: mol_type = other DNA
ggcgcgccagtcctatgacctagggcctctttgagattccaagctacagatcactttacctgcgttgggtgaacgccgtgtgcggcgacgcataatcccccaaacatcacaattggcacaatgattttggggcgcgcgacgccgtgggagtgaaaagcccgaaagggcttttcccgcttccttaatcccgactcggaccgatg

SEQ ID NO: 9826 - DNA, 203 bp, Homo sapiens
  source 1..203: mol_type = other DNA
ggcgcgccagtcctgtctgagtgggcgctagggtcccacccctaacatgccaacgacagctcctgcgctgcactccacacttacgtttgtgcacgcgcgggaaccgatggactttcgttcaaccacctccagctggactcactgcaccgcgtggccatgttagctggattgtgtggacgaacaccgctcgactcggaccgatg

SEQ ID NO: 9827 - DNA, 203 bp, Homo sapiens
  source 1..203: mol_type = other DNA
ggcgcgccagtccttaattagagggcgctagggtcttgccctagttagccgtaacgaccgtccctgcgactcacctcgcacttacgccatcgctcttcggtggcccagatggacttccgttcacccacctctggctggacctgctgcaccgcacctggcccggacagctggactgtgcggacgaacaccgactcggaccgatg

SEQ ID NO: 9828 - DNA, 203 bp, Homo sapiens
  source 1..203: mol_type = other DNA
ggcgcgccagtcctatctaacagggcgctagggtttcacccctagcatgccactgcagtccctgcgatacactccacacttacgttcttgtgtgcgcgggacccgatggactttcgttcacccacttacagctggacccacgacaccgcgtgaccactttgctggattgtgcggacgaacaccgcttgcgactcggaccgatg

SEQ ID NO: 9829 - DNA, 203 bp, Homo sapiens
  source 1..203: mol_type = other DNA
ggcgcgccagtcctaactcctagggctgactttgtgaacatcgtttcctctgcccccttcattgtccccatggccgacgttaatgacaagggacggttttacacctcccgtgtcgtcatcgtcacctcaaacttccccggccctaacccccgctccgcccgctgtgtggccgcgctggaacgccgcctcgactcggaccgatg

SEQ ID NO: 9830 - DNA, 203 bp, Homo sapiens
  source 1..203: mol_type = other DNA
ggcgcgccagtcctgcacacacggggcgagactggttgtgctcgccactgctacccctccgggctccgtcactgtgtcccatcctaacatcgaggaggttgctctgtccaccaccggagagatccctttttacggcaaggctatccccctcgaggtgatcaaggggggaagacatctcatcttctgcccgactcggaccgatg

SEQ ID NO: 9831 - DNA, 203 bp, Homo sapiens
  source 1..203: mol_type = other DNA
ggcgcgccagtcctcgataacggggggcaggagtctgcactccctgtattcactgagcgtcatctaataaagatgtctattgatctcttttagtgtgaatcatgtctgacgagggaccaggtacaggacctggaaatggcctaggacagaaggaagacacatctggaccagacggctccagcggcagtcgactcggaccgatg

SEQ ID NO: 9832 - DNA, 203 bp, Homo sapiens
  source 1..203: mol_type = other DNA
ggcgcgccagtcctctagttaggggggtgggggggcctcggccccctcaccctcttttccggtggccacccgcccgggccaccgttactccactccactccttcgggactggtttggaggaacataacagggcttcccatccctgtttacccttactccactcacccttccccttgaccaaccctatccgactcggaccgatg

SEQ ID NO: 9833 - DNA, 203 bp, Homo sapiens
  source 1..203: mol_type = other DNA
ggcgcgccagtccttgttgtaagggttggagtggccgcaacgggcggggcggggcggggccgggcaagtttgttccccgagttcggagcctaggagccccccgcggctgcggcgcaggtgccctcggcctgagtcgggatggagctgcctgctgtgaacctgaaggggctgcattgtattctcaggctcgactcggaccgatg

SEQ ID NO: 9834 - DNA, 203 bp, Homo sapiens
  source 1..203: mol_type = other DNA
ggcgcgccagtcctatgcgcaaggtaaactttgtgagtatggaattctctcttactgatccgaggctggagccacacagatgggaaaagtactgcgttcttcggataggagacatgctcttacggactgaaataggccaagtgtcaaggcccatgtttctttatgtgagaaccaatggaacctccaagcgactcggaccgatg

SEQ ID NO: 9835 - DNA, 203 bp, Homo sapiens
  source 1..203: mol_type = other DNA
ggcgcgccagtccttcgagagaggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacaccgactcggaccgatg

SEQ ID NO: 9836 - DNA, 203 bp, Homo sapiens
  source 1..203: mol_type = other DNA
ggcgcgccagtcctaatcgaacggtggtgaatggttctcaattccatgctggatgtctggcgatggttatggtcccggagtactcctacgggaccttcaaccagaaccgacagaatgctatcttcacctttccttatgccctcctcaacctctaccagggtaatactgcctctcttgaagttccctaccgactcggaccgatg

SEQ ID NO: 9837 - DNA, 203 bp, Homo sapiens
  source 1..203: mol_type = other DNA
ggcgcgccagtccttcattcctggtggtgctttgatggaccctcatgcaatactgttctggaagacaataacccagtggagttatggacaaagtcaggtgagaagaaaatcttgaagccccggtggagagatggaagattgtgggcagatcaccaggccttaaaagccttcaaggattttgcgagtggcgactcggaccgatg

SEQ ID NO: 9838 - DNA, 203 bp, Homo sapiens
  source 1..203: mol_type = other DNA
ggcgcgccagtcctgtaaaccgggtggtgctttgatggaccctcatgcaatactgttctggaagacaataacccagtggagttatggacaaagtcaggtgagaagaaaatcttgaagccccggtggagagatggaagattgtgggcagatcaccaggctttaaaagccttcaaggattttgcgagtggcgactcggaccgatg

SEQ ID NO: 9839 - DNA, 203 bp, Homo sapiens
  source 1..203: mol_type = other DNA
ggcgcgccagtcctctggataagtaaaaggtggcctccctgcccagggccgtgtccaaccatttgattagaagggtagcatcctcgggaagtgcgggtgggctgcggttgcaggccagggcgtaaaagagacccagctgtgaagagaagccctcgagacctccccccatctccctcttaccttgtgtccgactcggaccgatg

SEQ ID NO: 9840 - DNA, 203 bp, Homo sapiens
  source 1..203: mol_type = other DNA
ggcgcgccagtcctgagcggcagtatgtgatggttcagtagagtattgggtgtggagactagctataaaagaggccgggaggccttctgcgtccagacgcgatggcacacgccagagacaaggcaggcgctgtcctggccatgatactcatctgtgagacaagccttatctggacatctagtggcagtcgactcggaccgatg

SEQ ID NO: 9841 - DNA, 203 bp, Homo sapiens
  source 1..203: mol_type = other DNA
ggcgcgccagtcctggagccgcgtcgaaacctcagtggataaaagacctagagaatgtgtatcccagaagaagctggccaaggatatgggagcaaccaccatggaccagaagtctctctgggcaggatctgcctacaaactggtttgctactttaccaactggtcccaggaccggcaggaaccaggaacgactcggaccgatg

SEQ ID NO: 9842 - DNA, 203 bp, Homo sapiens
  source 1..203: mol_type = other DNA
ggcgcgccagtcctcacgtcaggtctacgtggaccgacaagaacagtttcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 9843 - DNA, 203 bp, Homo sapiens
  source 1..203: mol_type = other DNA
ggcgcgccagtcctgctaagtagtctccgtacccgcagaaattctgcggaagtctcggagattcgcccgggccctgcccgtttgggcgcggccggactacaaccccccgctagtagagacgtggaaaaagcctgactacgaaccacctgtggtccatggctgcccgctaccacctccacggtcccctccgactcggaccgatg

SEQ ID NO: 9844 - DNA, 203 bp, Homo sapiens
  source 1..203: mol_type = other DNA
ggcgcgccagtcctcggtcgaggtctcttggtggcattattggctcaagtttctttaaacttaagcgcgccgtggctcctgctctagggaataaagagcgagctcaaaaaagacacttttattttgcaaactcaaataaaggtgctaaaaaatcaaaaaacaacgaacctaaaccaagcacctcaaaacgactcggaccgatg

SEQ ID NO: 9845 - DNA, 203 bp, Homo sapiens
  source 1..203: mol_type = other DNA
ggcgcgccagtcctagtcatctgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccagcccctgtcgttccagcgactcggaccgatg

SEQ ID NO: 9846 - DNA, 203 bp, Homo sapiens
  source 1..203: mol_type = other DNA
ggcgcgccagtcctattccttcgtcttgcggaccaggaggagcaactcgaggaagcagcgaccaacgcttctctgtggggagacggcgacctggccgaaggatggatgagtcccgcagacagcgacctgctggtcatgtggcagctaacctcagcccccaaggtgcacgccaacggtccttcaaggatcgactcggaccgatg

SEQ ID NO: 9847 - DNA, 203 bp, Homo sapiens
  source 1..203: mol_type = other DNA
ggcgcgccagtcctcggattcagtgaagagggtagtaatgagcttgttggacggcagagggccagtacgtttcgtgctggctcttatcacgttcttcaagtttacagcattagccccgaccaaggcgcttttaggccgatggaaagcagtggaaaagagtgtggcaatgaaacatcttactagtttcacgactcggaccgatg

SEQ ID NO: 9848 - DNA, 203 bp, Homo sapiens
  source 1..203: mol_type = other DNA
ggcgcgccagtcctatgcatttgtgatgggagtacgacctgatagggcgctgcagaggcccactattaggctagtataaaaatctctgctgtacatggcacatggagttgaatcactttgaacttttatacaaaacaaacaaacaaaaaccaatgggagtggaggaaccggtgtacgatgccacggggcgactcggaccgatg

SEQ ID NO: 9849 - DNA, 203 bp, Homo sapiens
  source 1..203: mol_type = other DNA
ggcgcgccagtccttgtaattagtgcgaattgcctacctacgtcaccatcccgaataccgcaatcaaaatgttgcggcacttcttaggcttatttaaaaccatgcaggctatgctaccagtcattttaattttgctactaccctgcattcccctagcttccaccgccactcgcgctacacctgaacaacgactcggaccgatg

SEQ ID NO: 9850 - DNA, 203 bp, Homo sapiens
  source 1..203: mol_type = other DNA
ggcgcgccagtcctcacagttcgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccgactcggaccgatg

SEQ ID NO: 9851 - DNA, 203 bp, Homo sapiens
  source 1..203: mol_type = other DNA
ggcgcgccagtcctcggaacaagtgctagcagggccagccttgaactcgctggacagagctacagacctatggggcctggaagtgcccgctgagaaagggagaagacagcagaggggttgccgagggagttcctggtcggctccgacgccttctgctgcaacttggctagtgccctactttcagacaccgactcggaccgatg

SEQ ID NO: 9852 - DNA, 203 bp, Homo sapiens
  source 1..203: mol_type = other DNA
ggcgcgccagtccttcatagtggtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcgactcggaccgatg

SEQ ID NO: 9853 - DNA, 203 bp, Homo sapiens
  source 1..203: mol_type = other DNA
ggcgcgccagtccttaacgcccgttaagtccgtcaagagactactcttgagtgccagcgagtagagttttctctaaactgtgctcccaaagtttaagaaaaatgagacacctgcacctcctgtcttcaactgtgcctattgacatggccgcattattgctggaggactatgtaaatacaatattggagcgactcggaccgatg

SEQ ID NO: 9854 - DNA, 203 bp, Homo sapiens
  source 1..203: mol_type = other DNA
ggcgcgccagtccttccgtaatgttatatagaccggcggcggagcacgcgtgtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgcgactcggaccgatg

SEQ ID NO: 9855 - DNA, 203 bp, Homo sapiens
  source 1..203: mol_type = other DNA
ggcgcgccagtcctcgtacgatgttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgcgactcggaccgatg

SEQ ID NO: 9856 - DNA, 203 bp, Homo sapiens
  source 1..203: mol_type = other DNA
ggcgcgccagtcctcaccaagggttgggtcgcgaaaggccttgtggtactgcctgatagggtgcttgcgagtgccccgggaggtctcgtagaccgtgcaacatgagcacacttcctaaacctcaaagaaaaaccaaaagaaacaccatccgtcgcccacaggacgtcaagttcccgggtggcggacagcgactcggaccgatg

SEQ ID NO: 9857 - DNA, 203 bp, Homo sapiens
  source 1..203: mol_type = other DNA
ggcgcgccagtcctaacggcccgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagcgactcggaccgatg

SEQ ID NO: 9858 - DNA, 203 bp, Homo sapiens
  source 1..203: mol_type = other DNA
ggcgcgccagtcctaacctccttaagccaaatgctgatcaacaggatgcacaaaaccaaccgcaatggacccaggtatgaagaagatgtggacttgggttcagggaccagagctgtgagctgcacaagacagaggactgactggggaatggtcgctgatagggtgaagaatttggccagagaatatgccgactcggaccgatg

SEQ ID NO: 9859 - DNA, 203 bp, Homo sapiens
  source 1..203: mol_type = other DNA
ggcgcgccagtccttgctatcttacacagagcgatctaagcggcgagaccggagacgcagatctgtttgtcacgcccgcacctggttttgcttcaggaaatatgactacgtccggcgttccatttggcatgacactacgaccaacacgatctcggttgtctcggcgcactccgtacagtagggatcgtcgactcggaccgatg

SEQ ID NO: 9860 - DNA, 203 bp, Homo sapiens
  source 1..203: mol_type = other DNA
ggcgcgccagtcctagtaaacctaccggagcagtcgcctggccatctacatcgaggacctcggtcgaaaatactgccccgcgagcgcgaccgggggagatcatggcatccggcaagcaccatcagcccggggggacgcggagcctgaccatgcaaaaagtaagcctgcgcgtgaccccccgcctggtgcgactcggaccgatg

SEQ ID NO: 9861 - DNA, 203 bp, Homo sapiens
  source 1..203: mol_type = other DNA
ggcgcgccagtcctcactgcattactgtcgttagcgggcagagacaggatagacagggaggagagcgaaggaggccccaactcgaccgcgaccagtgtgcctactgcaaagaaaaaggacattgggctaaagattgccccaagaagccaagaggaccccggggaccgcgaccccaggcctccctcctgcgactcggaccgatg

SEQ ID NO: 9862 - DNA, 203 bp, Homo sapiens
  source 1..203: mol_type = other DNA
ggcgcgccagtcctgctgagactagcctgcaaggaagattacaggtacgcaatatcgtcaaccgatgagatagggctacttggggccggaggtctcaccaccacctggaaggaatacaaccacgatttgcaactgaatgacgggaccgttaaggccagttgcgtggcaggttcctttaaagtcacagccgactcggaccgatg

SEQ ID NO: 9863 - DNA, 203 bp, Homo sapiens
  source 1..203: mol_type = other DNA
ggcgcgccagtcctcgaacttatatcctctcctttgcacgccgtgggaccatccaggagaagttgatttccgtggcaggactcgccgtccactccggaccagacgagtaccggcgcctctttgagcccttccagggcctctttgagattccaagctacagatcactttacctgcgttgggtgaacgcccgactcggaccgatg

SEQ ID NO: 9864 - DNA, 203 bp, Homo sapiens
  source 1..203: mol_type = other DNA
ggcgcgccagtcctggctatactatgtctgctatctttggcctgtccctgtagtggggcgcgggtcactgacccagacacaaataccacaatcctgaccaattgctgccagcgtaatcaggttatctattgttctccttccacttgcctacacgagcctggttgtgtgatctgtgcggacgagtgctgcgactcggaccgatg

SEQ ID NO: 9865 - DNA, 203 bp, Homo sapiens
  source 1..203: mol_type = other DNA
ggcgcgccagtcctgcgcactatcacagcacacaaattgggggaataaggatggtggacatccttaggcaaaacccaactgaggagcaagctgtggatatatgcaaagcagcaatgggtttgaggatcagttcatcctttagctttggaggcttcactttcaaaagaacaaatggatcatccgtcaagcgactcggaccgatg

SEQ ID NO: 9866 - DNA, 203 bp, Homo sapiens
  source 1..203: mol_type = other DNA
ggcgcgccagtccttacctgcgtcacatagatgcccactttctgtcacagactaagcagcagggacttaacttctcgtacctaactgcctaccaagccactgtgtgcgcccgcgcgcaggctcctcccccaagttgggacgagatgtggaagtgtctcgtgcggcttaagccaacactacatggacctcgactcggaccgatg

SEQ ID NO: 9867 - DNA, 203 bp, Homo sapiens
  source 1..203: mol_type = other DNA
ggcgcgccagtcctgacatcgatcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggcggaccagaaaccccgcaaacgactcggaccgatg

SEQ ID NO: 9868 - DNA, 203 bp, Homo sapiens
  source 1..203: mol_type = other DNA
ggcgcgccagtccttgatctgttccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgccgactcggaccgatg

SEQ ID NO: 9869 - DNA, 203 bp, Homo sapiens
  source 1..203: mol_type = other DNA
ggcgcgccagtcctccctcaagtcctgaaacatatgctgtaataactggagctccgggggctgtagctgggtttgctgcattggttcaaactgtaactggtggtagtgctattgctcagttgggatatagattttttgctgactgggatcataaagtttcaacagttgggctttttcagcagccagctcgactcggaccgatg

SEQ ID NO: 9870 - DNA, 203 bp, Homo sapiens
  source 1..203: mol_type = other DNA
ggcgcgccagtccttggcgccgtcgatcctctactcggtcctccagcacctcgcccccaggctacctgacggggggcacgacgggcccccgtagtcccgccatgcgccagggcgcccccgcgcgggggcgccggtggttcgtcgtatgggcgctcttggggttgacgctgggggtcctggtggcgtcgcgactcggaccgatg

SEQ ID NO: 9871 - DNA, 203 bp, Homo sapiens
  source 1..203: mol_type = other DNA
ggcgcgccagtcctcggcagcgtcggaaagtgtcatgcttggtattctcattatgttcttaagtttttcctcttagtgtttggtgagaatggtgtgtttttctataagcacttgcatggtgatgtcttgcctaatgattttgcctcgaaactaccattgcaagagccatttttcccttttgaaggcaacgactcggaccgatg

SEQ ID NO: 9872 - DNA, 203 bp, Homo sapiens
  source 1..203: mol_type = other DNA
ggcgcgccagtcctgttcatactcggcggcttccgtagcgggagggcgaaagatggcggcggcagtactgggacagttgggtgcgttatggatacataacctgaggagccgggggaagctggccttggggaaatctaccactgtcgaagacaaataaaatatagcaaagacaagatgtggtatttggccgactcggaccgatg

SEQ ID NO: 9873 - DNA, 203 bp, Homo sapiens
  source 1..203: mol_type = other DNA
ggcgcgccagtcctgaagggaatcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagaccgactcggaccgatg

SEQ ID NO: 9874 - DNA, 203 bp, Homo sapiens
  source 1..203: mol_type = other DNA
ggcgcgccagtcctggacgttctcgggggcagaggtggaggcgattgcgaagggctggggtccgacctggaaggcggatgactggcagaaccccttccgcgttcgggggtgtgctccctgtggcggtcgcttaactgatttccttcgcggctggccattgtgttctcctaggcagagaaacaacagaccgactcggaccgatg

SEQ ID NO: 9875 - DNA, 203 bp, Homo sapiens
  source 1..203: mol_type = other DNA
ggcgcgccagtccttgtcaagctctataggaatgaaggaagacgcttggcgtgtggggacacggttgatggtttgcccgttgttgcgcgtctcggcgaccttgttttcgcagggttggctatgccgccagatgggtgggccattaccgcaccttttacgctgcagtgtctctctgaacgtggcacgctcgactcggaccgatg

SEQ ID NO: 9876 - DNA, 203 bp, Homo sapiens
  source 1..203: mol_type = other DNA
ggcgcgccagtcctagaaagactctatatccaacactaagaaaattcagtcgcgcctccaaagaaggaagcatcatttcatataatcgtggcaacattggataaaacacgacctcaaactcccttccctgctcacagactcgctcatacaaaagttcaagattcgtcttttcaggtgaggaatccatccgactcggaccgatg

SEQ ID NO: 9877 - DNA, 203 bp, Homo sapiens
  source 1..203: mol_type = other DNA
ggcgcgccagtcctatcgaggatctcaacgcctacgttgcttacgaagacccccagggcgtggtctaccaagaagtagaaccataccactggatggttgccgttgcaatggtgggcacgcgttgggactactctgccactaacaactgtactcactttgtttctaatatcactggtgttgaactcccccgactcggaccgatg

SEQ ID NO: 9878 - DNA, 203 bp, Homo sapiens
  source 1..203: mol_type = other DNA
ggcgcgccagtcctactaacattctcccagtaccgctggttcggcctcaatgaagatctcactccattgaacgtcaccggtggtctgttctatcacgtctccctcaaccccgtcaacttccagcaaaactctctcctcagtgttcttggtgctttcacttacgtgtatgctaacctttccctcaacatcgactcggaccgatg

SEQ ID NO: 9879 - DNA, 203 bp, Homo sapiens
  source 1..203: mol_type = other DNA
ggcgcgccagtcctatgacaactctctggcaaccttctttcacagacttcgactccttggttgatgccattgtcgggcgtctggaccggtcaacgggggtttccgacctcctggctagtctggtcaaacgacagggcttgaccattgaagcggagcctactgaactttcctaccaggatgctttagaacgactcggaccgatg

SEQ ID NO: 9880 - DNA, 203 bp, Homo sapiens
  source 1..203: mol_type = other DNA
ggcgcgccagtcctacgatatgtctgcctcccactccatggggcctttgatagtcaacatgatatatttgtccttagtccagaaatcatcactcggatttattatggaaaacataccgtttgcgcctcccaagttttttatagttgtatacggaaaataaggtaattcccctggcttgtcacctctagcgactcggaccgatg

SEQ ID NO: 9881 - DNA, 203 bp, Homo sapiens
  source 1..203: mol_type = other DNA
ggcgcgccagtcctgatttctatctgctgtacatggcacatggagttgaatcactttgaacttttatacaaaacaaacaaacaaaaaccaatgggagtggaggaaccggtgtacgatgccacggggagaccgttgttcggagacccgagtgaggtacacccacaatcaacactgaagctaccacatgacgactcggaccgatg

SEQ ID NO: 9882 - DNA, 203 bp, Homo sapiens
  source 1..203: mol_type = other DNA
ggcgcgccagtcctatctcaattcttcaccactgcctacaacgctcatgcctacttcaattgtggctttgacgtcacagtcgtcgtgaacgcctcccagttccacggcggctcgctgattgtcttggccatggctgaaggtctaggcgacatcaccccagctgactcttccacttggttcaatttccccgactcggaccgatg

SEQ ID NO: 9883 - DNA, 203 bp, Homo sapiens
  source 1..203: mol_type = other DNA
ggcgcgccagtcctcactttcctcttgctctattcaccgttacttttcttcttgcccgttctctttcttagtatgaatccagtatgcctgcctgtaattgttgcgccctacctgttttggctggcggctattgccgcctcgtgtttcacggcctcagttagtaccgttgtgaccgccaccggcttggccgactcggaccgatg

SEQ ID NO: 9884 - DNA, 203 bp, Homo sapiens
  source 1..203: mol_type = other DNA
ggcgcgccagtcctgagtgacgtgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggagaattttgtacgactcggaccgatg

SEQ ID NO: 9885 - DNA, 203 bp, Homo sapiens
  source 1..203: mol_type = other DNA
ggcgcgccagtcctactgtaagtgaagagataggaagaggaagtcaggccagggaatccctgccaccggatgttggatgacggtgctgtctgcgttccaaccccaggaggactgggttaacaaatctgggtgcatggaggagctaagcgttcaaaaccgtctcggagaactccctggctcacgaagtgcgactcggaccgatg

SEQ ID NO: 9886 - DNA, 203 bp, Homo sapiens
  source 1..203: mol_type = other DNA
ggcgcgccagtcctctggaaggtgaattcatttttctgggtctctctgattctcagggactccagaccttcctatttatgttgttttttgtattctatggaggaatcgtgtttggaaaccttcttattgtcataacagtggtatctgactcccaccttcactctcccatgtacttcctgctagccaaccgactcggaccgatg

SEQ ID NO: 9887 - DNA, 203 bp, Homo sapiens
  source 1..203: mol_type = other DNA
ggcgcgccagtcctgactctgctgaccggtttgtggaggtcacagtgtcggataaccaacacacactcgacgtgatgcaggcacacaaagacaatatcgtgggcgcgcttcttcgcgcagccacgtactatttttctgatttggaaatagcagtgacccacactgggaagctcacatgggtgcccaaccgactcggaccgatg

SEQ ID NO: 9888 - DNA, 203 bp, Homo sapiens
  source 1..203: mol_type = other DNA
ggcgcgccagtccttttgagtgtgagacgacgggtgaaaaagttgctgaggctgtgattgaacctgtccttcttgctgctactggaactcccatatcttttgtcaccaacctcttcgcccaatggcgaggagaactccagctttcccttctctttactggttccgcccaacacttcgggcgtctcgctcgactcggaccgatg

SEQ ID NO: 9889 - DNA, 203 bp, Homo sapiens
  source 1..203: mol_type = other DNA
ggcgcgccagtcctgacgataatgaggtggctcgtggagcgtgggtttctcaaaccaagaggcaaagttgtggacttaggctgcggcagaggaggctggagttactactgtgcaacattaaagcaggttcaggaagtgagaggttacacaaaaggagggccagggcatgaggaaccagtgatgacccacgactcggaccgatg

SEQ ID NO: 9890 - DNA, 203 bp, Homo sapiens
  source 1..203: mol_type = other DNA
ggcgcgccagtcctaggatgcctgagtgagaatgtgtcagaagtcatttgttacagtccaaagtggaccaggcctatcactctagagtataacaactccatatcttggtacccctatacaatccctggtgcgaggggatgtatggttaaattcaaaaataacacatggggttgctgccgtattcgcaacgactcggaccgatg

SEQ ID NO: 9891 - DNA, 203 bp, Homo sapiens
  source 1..203: mol_type = other DNA
ggcgcgccagtcctcgttaccctgataccagagatgtggaagagcgcgtccatgtaatgcgcaaaaccaagcttgcacccaccgtcgcgcacggtgtgttcaatcctgagttcgggcctgccgccttgtctaacaaggacccacgcctgaacgaaggtgttgtcctcgatgaagtcattttctccaagcgactcggaccgatg

SEQ ID NO: 9892 - DNA, 203 bp, Homo sapiens
  source 1..203: mol_type = other DNA
ggcgcgccagtcctcgaaaggatgatttttccacctgttcgacaggctactatgatatgacgcttgtttcttttattttgcagactaattcaaaactaacaatgttggagcgcagcgcggtaacctattgtatttgcatcccaacggttttgaatgtttctttggaaaatttttcttttattcaatttcgactcggaccgatg

SEQ ID NO: 9893 - DNA, 203 bp, Homo sapiens
  source 1..203: mol_type = other DNA
ggcgcgccagtccttgtccggttgcaactggacgcggggcgaacgctgtgatctggaagacagggacaggtccgagctcagcccattgctgctgtccaccacacagtggcaggtccttccgtgttctttcacgaccctgccagccttgtccaccggcctcatccacctccaccagaacattgtggacgcgactcggaccgatg

SEQ ID NO: 9894 - DNA, 203 bp, Homo sapiens
  source 1..203: mol_type = other DNA
ggcgcgccagtccttcggcccatgccagggataaaagttcgatttttgccgtagcggctagtaatgattctggagacgtgctgtttttgagtgaactaaggatgaactctaaatcgagtgcacgagctgccattgtggatactgtggaagctgtgaagaagagaaaatatatatctatcgatgagggacgactcggaccgatg

SEQ ID NO: 9895 - DNA, 203 bp, Homo sapiens
  source 1..203: mol_type = other DNA
ggcgcgccagtcctccctgccgtgccagtgctattcccaaaaataaagaatggagaggtgactgacagttacgataactataccttcctcaacgcaagaaaattaggggatgatgtacccccttacgtgtatgccacagaggatgaggacttagcggtagagctgctgggcttagactggccggaccccgactcggaccgatg

SEQ ID NO: 9896 - DNA, 203 bp, Homo sapiens
  source 1..203: mol_type = other DNA
ggcgcgccagtcctttgcacggtgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatccgactcggaccgatg

SEQ ID NO: 9897 - DNA, 203 bp, Homo sapiens
  source 1..203: mol_type = other DNA
ggcgcgccagtcctcgacggcatgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctcgactcggaccgatg

SEQ ID NO: 9898 - DNA, 203 bp, Homo sapiens
  source 1..203: mol_type = other DNA
ggcgcgccagtcctttcattaatggacggcattgcagcgtggatccacgctgcccacgtaaaggctgccgacaccaggattgagccaccatcggaatcgacatggcgtgttcaacgctctcagaatcccctaaagataagattgacccgcgggacctcctaatccccttaattctcttcctgtctctccgactcggaccgatg

SEQ ID NO: 9899 - DNA, 203 bp, Homo sapiens
  source 1..203: mol_type = other DNA
ggcgcgccagtcctcaaatcggtggactctctcaagaaccaggtgacagtcaccgccagatacttcagaagggtgcctagccagtccacctgagcgcgaggatggccctgcaaactgacacacatgcctggcgggtggagatagggaccaggggactaatgttctctaactgtgtcccactccacctgcgactcggaccgatg

SEQ ID NO: 9900 - DNA, 203 bp, Homo sapiens
  source 1..203: mol_type = other DNA
ggcgcgccagtccttggtggtttggatcctaggcgtaacttcatcattaaatctcagattctgctctgagtgtgacttactgcgaagaggcagacaaatgggcaactgcaacggggcatccaagtctaaccagccagactcctcaagagccacacagccagccgcagaatttaggagggtagctcacacgactcggaccgatg

SEQ ID NO: 9901 - DNA, 203 bp, Homo sapiens
  source 1..203: mol_type = other DNA
ggcgcgccagtcctcagacgtgtggatgtgcgcgtggaggctttgctggaagccaccgtggaacatctcgagaaccgtgttacctttgacctggctgttattttccaccaacacagtgggggcgagaggtgccacctccgggacctgcattttgaagtgttccgagaccgtttggaataaagttaatccgactcggaccgatg

SEQ ID NO: 9902 - DNA, 203 bp, Homo sapiens
  source 1..203: mol_type = other DNA
ggcgcgccagtcctggacttgatggcggtaacccgtctggatgtgttggcacttccatcatcaacaccatcatcaacaacatttgtgttctttctgctttaatccaacaccctgatttttctcctgaatccttcagaattttggcctatggtgatgatgtgatttatgggtgcgatccacccatccatcgactcggaccgatg

SEQ ID NO: 9903 - DNA, 203 bp, Homo sapiens
  source 1..203: mol_type = other DNA
ggcgcgccagtcctcgtagggctggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagcgactcggaccgatg

SEQ ID NO: 9904 - DNA, 203 bp, Homo sapiens
  source 1..203: mol_type = other DNA
ggcgcgccagtccttctggagctgggttcaggcgattttgtcagtatgatcactcaaggggagaagaaggaagaagaagttcctcaggtgtttgacgaaaacatgctgcgaaaaaggcaactaacagtgctggacctacatccaggttcaggaaagaccagaaaggtcctccccatgattctgaagagcgactcggaccgatg

SEQ ID NO: 9905 - DNA, 203 bp, Homo sapiens
  source 1..203: mol_type = other DNA
ggcgcgccagtcctgtaagacatggtcagtaggaggtatttggcatcattgcataagaaggctttacccacttccgtgacattcgagctcctgttcgacgggaccaacccatcaactgaggaaatgggagatgacttcaggtccgggctgtgcccgtttgatacgagtcctgttgttaagggaaagtacgactcggaccgatg

SEQ ID NO: 9906 - DNA, 203 bp, Homo sapiens
  source 1..203: mol_type = other DNA
ggcgcgccagtcctacacgacctggtggatacaacagacgtagccgtgactgtggtaggggaagcccccactatgactacaggggagacaccgacagtgttcaccagctcaggttcaggcctgaaaagccaacaagttttgaaactaggggtaggtgaaggccaatatccagggactaatccacagagcgactcggaccgatg

SEQ ID NO: 9907 - DNA, 203 bp, Homo sapiens
  source 1..203: mol_type = other DNA
ggcgcgccagtcctcctttcactgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccacccgactcggaccgatg

SEQ ID NO: 9908 - DNA, 203 bp, Homo sapiens
  source 1..203: mol_type = other DNA
ggcgcgccagtcctgaatcctctgtgtacattgaggtattgcatttgactcaagggacctgttgggaacagatgtacactcccggcggagaagtaagaaatgatgatgttgaccagagtttgatcatcgctgccagaaacattgttaggagagcaacagtatcagcggacccactggcatcactcttgcgactcggaccgatg

SEQ ID NO: 9909 - DNA, 203 bp, Homo sapiens
  source 1..203: mol_type = other DNA
ggcgcgccagtccttaaacaattgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaacgactcggaccgatg

SEQ ID NO: 9910 - DNA, 203 bp, Homo sapiens
  source 1..203: mol_type = other DNA
ggcgcgccagtcctagcccagattacaaggagaatagattcatcgagattggagtgacaaggagagaagtccacatatactatcttgaaaaggccaataaaattaaatctgagaatacacacatccacattttctcattcactggggaagaaatggccacaaaggccgactacactctcgatgaggaacgactcggaccgatg

SEQ ID NO: 9911 - DNA, 203 bp, Homo sapiens
  source 1..203: mol_type = other DNA
ggcgcgccagtcctggagtagtttacactaagaccggagaggtttttccttgtgctggtttgtttccccggtgcgacatatgacgcgctggtgactttctgtgtgtgtcacgtagctcttctatgtttaacatccagtgcagcatcgttctttgggactgactctagggttagggcccatagaatgttcgactcggaccgatg

SEQ ID NO: 9912 - DNA, 203 bp, Homo sapiens
  source 1..203: mol_type = other DNA
ggcgcgccagtcctctgtgaagttacatcggacaaactctgaccgaaccactctgagaacagagtatcgttctgaaacctgttctccatcacagagctggtatggcctccagtcgtgtagacaccattaatttacggatctggctggtctctataatctgtgcagccttgtcattcataaacgtcacgcgactcggaccgatg

SEQ ID NO: 9913 - DNA, 203 bp, Homo sapiens
  source 1..203: mol_type = other DNA
ggcgcgccagtcctattcacccttatccaaaaatctacaagacttattttgagaaagtcgaaaggttaaaacatggaacctttggccctgtccattttagaaaccaagtcaaaatacgccgaagagttgacataaaccctggtcatgcagacctcagtgccaaggaggcacaagacgtaatcatggaacgactcggaccgatg

SEQ ID NO: 9914 - DNA, 203 bp, Homo sapiens
  source 1..203: mol_type = other DNA
ggcgcgccagtcctgtcctacattccagttaatctatgggggcgtgatatattaagcaaaatgggtgtttatttatatagtccttcacccactgtgacagatttgatgttagaccaaggcttacttccaaatcaaggtttaggtaaacaacatcaaggcatcattttaccccttgatttaaaatctaacgactcggaccgatg

SEQ ID NO: 9915 - DNA, 203 bp, Homo sapiens
  source 1..203: mol_type = other DNA
ggcgcgccagtcctaagtgctcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagcccgactcggaccgatg

SEQ ID NO: 9916 - DNA, 203 bp, Homo sapiens
  source 1..203: mol_type = other DNA
ggcgcgccagtccttcactaaattctctgcacgtcttttggtggcttcggcctccagaacggcggagacccaggcaacctccactccaacacatggggaaccctcattctctatgttgacctcccccaaagcgatagtgtctcagtctctgcttacatctctttccgcgacttcgaagcctacgtccccgactcggaccgatg

SEQ ID NO: 9917 - DNA, 203 bp, Homo sapiens
  source 1..203: mol_type = other DNA
ggcgcgccagtccttcacatccttctgaagcataaagcccaggatcgccggcagggcctccttcttgataaagttagcctcgtccacaaacaagaggtgaaatgtctgcccccggatgctctgaaagacaggataagaagcgagtcactattggggagacagaatttggacaattgctgagctgggaccgactcggaccgatg

SEQ ID NO: 9918 - DNA, 203 bp, Homo sapiens
  source 1..203: mol_type = other DNA
ggcgcgccagtcctgtgagtacttcttggatcaatatttaatcgcagacgaggtttcgtggaacgttgttcccgtaatctgttttttcaggcagtggggactcaagttagatttttttaaaaagttttcggggaagaccaagcggttgtcattttcgtttatacgtgatttgttcgccaggtctcaggcgactcggaccgatg

SEQ ID NO: 9919 - DNA, 203 bp, Homo sapiens
  source 1..203: mol_type = other DNA
ggcgcgccagtcctgacagaagttgaagtatcttactacctccacaagaagatcatagatgaaatagcaggagggaccaacttcatctcaagacttgtagccgctttgatcgaagtcaattgggcctttgacaacgaagaagttaggggtttgaagaagttcttcctgttgtctagtagggttaaagacgactcggaccgatg

SEQ ID NO: 9920 - DNA, 203 bp, Homo sapiens
  source 1..203: mol_type = other DNA
ggcgcgccagtccttatacaccttgatcctgcgccgggcggacgcggtcagccccggccaggccctgcccccggatgggctttacctcacgtacgactctgaccggcccctaattcttctgtataagggcagggggtgggtatttaaggatctatatgcccttctctacctgcacctccaaatgagagcgactcggaccgatg

SEQ ID NO: 9921 - DNA, 203 bp, Homo sapiens
  source 1..203: mol_type = other DNA
ggcgcgccagtccttcatcggattgcgcgtgcatgcgtgtgcttcagacagcccaggcagcgactgtgattgtggatattctttctgcaagttttgtcgtgaacgtgttgagaaaaagacagcttaggagaacaagagctgggaatggccgggaaggccgttctaaaaggaaagggggggggtccccccgactcggaccgatg

SEQ ID NO: 9922 - DNA, 203 bp, Homo sapiens
  source 1..203: mol_type = other DNA
ggcgcgccagtccttatacgtattgtttcgattcttccaaaatcagagacagagtgctcccggtgccatgaacggagacgatgcctttgtacggagacctagggttggttctcaaataccagagaagatgcaaaagcatccctggagacaagtctgtgaccgtggaatacatttggtgaatctcagtccgactcggaccgatg

SEQ ID NO: 9923 - DNA, 203 bp, Homo sapiens
  source 1..203: mol_type = other DNA
ggcgcgccagtcctgactagggtttcacctaaatttccgcgtacggtgtcaaagttctgtgtttttacgtaggtgtcagctgatcgctagggtatttaaacctgacgagttccgtcaagaggccactcttgagtgccagcgagaagagttttctcctccgcgccgcaagtcagttctgcgctttgaaacgactcggaccgatg

SEQ ID NO: 9924 - DNA, 203 bp, Homo sapiens
  source 1..203: mol_type = other DNA
ggcgcgccagtcctccttatctttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgtcgactcggaccgatg

SEQ ID NO: 9925 - DNA, 203 bp, Homo sapiens
  source 1..203: mol_type = other DNA
ggcgcgccagtccttatcggataaaaatctctagcagtggcgcccgaacagggactcgaaagcgaaagttccagagaagttctctcgacgcaggactcggcttgctgaggtgcacacagcaagaggcgagagcggcgactggtgagtacgcctaagatttttgactagcggaggctagaaggagagagcgactcggaccgatg

SEQ ID NO: 9926 - DNA, 203 bp, Homo sapiens
  source 1..203: mol_type = other DNA
ggcgcgccagtcctttgcgctcaaaatctctagcagtggcgcccgaacagggacgcgaaagcgaaagtagaaccagagaagatctctcgacgcaggactcggcttgctgaagtgcacacggcaagaggcgagagcggcgactggtgagtacgccaaatttttgactagcagaggctagaaggagagagcgactcggaccgatg

SEQ ID NO: 9927 - DNA, 203 bp, Homo sapiens
  source 1..203: mol_type = other DNA
ggcgcgccagtcctgacgcgtaaaaatctctagcagtggcgcccgaacagggactcgaaagcgaaagtgttccagagaagctctctcgacgcgaggactcggcttgctgaggtgcacacagcaaggggcgagagcggcgactggtgagtacgccaattttttgactagcggaggctagaaggagagagcgactcggaccgatg

SEQ ID NO: 9928 - DNA, 203 bp, Homo sapiens
  source 1..203: mol_type = other DNA
ggcgcgccagtcctaccggcagaaaatctctagcagtggcgcccgaacagggacttgaaagcgaaagttccagagaagttctctcgacgcaggactcggcttgctgaggtgcacacagcaagaggcgagagcggcgactggtgagtacgcctaaagatttttgactagcggaggctagaaggagagagcgactcggaccgatg

SEQ ID NO: 9929 - DNA, 203 bp, Homo sapiens
  source 1..203: mol_type = other DNA
ggcgcgccagtcctcgatgcgcaaaatctctagcagtggcgcccgaacagggacttgaaagcgacagtagaaccagaggagctctctcgacacaggactcggcttgctgaagcgcgcacggcaagaggcgaggggcggcgactggtgagtacgccaatttttgactagcggaggctagaaggagagagcgactcggaccgatg

SEQ ID NO: 9930 - DNA, 203 bp, Homo sapiens
  source 1..203: mol_type = other DNA
ggcgcgccagtcctggctcctgaaatctctagcagtggcgcccgaacagggaccgagaaagcgaaagtagaaccagaggagctctctcgacgcacgactcggcttgctgagcgcgcacggcaagaggcgaggggcggcgaccggtgagtacgccaattttttgactagcggaggctagaaggagagagcgactcggaccgatg

SEQ ID NO: 9931 - DNA, 203 bp, Homo sapiens
  source 1..203: mol_type = other DNA
ggcgcgccagtcctgcttcttcaaatctctagcagtggcgcccgaacagggaccggaaagcgaaagagaaaccagagaagctctctcgacgcaggactcggcttgctgaagcgcgcacggcaagaggcgaggggcggcgaacggtgagtacgccaaaattttgactagcggaggctagaaggagagagcgactcggaccgatg

SEQ ID NO: 9932 - DNA, 203 bp, Homo sapiens
  source 1..203: mol_type = other DNA
ggcgcgccagtcctttgtatcgaaatctctagcagtggcgcccgaacagggacctgaaagcgaaagtaccagagaagttctctcgacgcaggactcggcttgctgaggtgcacacagcaagaggcgagagcggcgactggtgagtacgccaaagaattttttgactagcggtggctagaaggagagagcgactcggaccgatg

SEQ ID NO: 9933 - DNA, 203 bp, Homo sapiens
  source 1..203: mol_type = other DNA
ggcgcgccagtcctcttgcgttaaatctctagcagtggcgcccgaacagggacgcgaaagcgaaagtagaaccagaggagaactctcgacgcaggactcggcttgctgaagtgcactcggcaagaggcgagagcggcggctggtgagtacgccattttatttgactagcggaggctagaaggagagtgcgactcggaccgatg

SEQ ID NO: 9934 - DNA, 203 bp, Homo sapiens
  source 1..203: mol_type = other DNA
ggcgcgccagtcctttagttcaaaatctctagcagtggcgcccgaacagggacgcgaaagcgaaagtagaaccagaggagatctctcgacgcaggactcggcttgctgaggtgcacacagcaagaggcgagagcggcggctggtgagtacgccaatttttttgactagcggaggctagaaggagagagcgactcggaccgatg

SEQ ID NO: 9935 - DNA, 203 bp, Homo sapiens
  source 1..203: mol_type = other DNA
ggcgcgccagtcctcgtcagtaaaatctctagcagtggcgcccgaacagggactcgaaagcgaaagttccagagaagttctctcgacgcaggactcggcttgctgaggtgcacacagcaagaggcgagagcggcgactggtgagtacgcctaagaattttttgactagcggaggctagaaggagagagcgactcggaccgatg

SEQ ID NO: 9936 - DNA, 203 bp, Homo sapiens
  source 1..203: mol_type = other DNA
ggcgcgccagtcctttaaggagaaatctctagcagtggcgcccgaacagggactggaaaagcgaaagtaaaaccagaggagatctctcggcgcaggactcggcttgctgcagcgcgcgcggcaagaggcgaggggcggcgactggtgagtacgccaatttttgactagcggaggctagaaggagagagcgactcggaccgatg

SEQ ID NO: 9937 - DNA, 203 bp, Homo sapiens
  source 1..203: mol_type = other DNA
ggcgcgccagtcctcgggtttgaaatctctagcagtggcgcccgaacagggacttgaaagcgaaagagaaaccagaggagatctctcgacgcaggactcggcttgctgaagcgcgcacagcaagaggcgaggggcggcgaccggtgagtacgccaattttttgactagcggaggctagaaggagagagcgactcggaccgatg

SEQ ID NO: 9938 - DNA, 203 bp, Homo sapiens
  source 1..203: mol_type = other DNA
ggcgcgccagtcctttgggactaaatctctagcagtggcgcccgaacagggacttgaaagcgaaagagaaaccagaggagatctctcgacgcaggactcggcttgctgaagcgcgcacggcaagaggcgaggggcggcgactggtgagtacgccaaatttttgactagcggaggctagaaggagagagcgactcggaccgatg

SEQ ID NO: 9939 - DNA, 203 bp, Homo sapiens
  source 1..203: mol_type = other DNA
ggcgcgccagtcctaagatcacaaatctctagcagtggcgcccgaacagggacttgaaagtgaaagtagaaccagaggagctctctcgacgcaggactcggcttgctgaagcgcgcacggcaagaggcgaggggcagcgaacggtgagtacgcaaaatttttgactagcggaggctagaaggagagagcgactcggaccgatg

SEQ ID NO: 9940 - DNA, 203 bp, Homo sapiens
  source 1..203: mol_type = other DNA
ggcgcgccagtccttgaccattaacagggacccgaaagtgaaagttaatagggactcgaaagcgaaagttccagagaagttctctcgacgcaggactcggcttgctgaagtgcacacagcaagaggcgagagcggcgactggtgagtacgccaaatccttttgactagcggaggctagaaggagagagcgactcggaccgatg

SEQ ID NO: 9941 - DNA, 203 bp, Homo sapiens
  source 1..203: mol_type = other DNA
ggcgcgccagtcctatatccttaacagggacctgaaaacgaaagttaatagggactcgaaagcgaaagttccagagaagttctctcgacgcaggactcggcttgctgaggtgcacacagcaagaggcgagagcggcgaactggtgagtacgccaaaaattttgactagcggaggctagaaggagagagcgactcggaccgatg

SEQ ID NO: 9942 - DNA, 203 bp, Homo sapiens
  source 1..203: mol_type = other DNA
ggcgcgccagtccttcggcgtcaacagggacttgaaagagaaagttaaaagggactcgaaagcgaaagttccagagaagttctctcgacgcaggactcggcttgctgaaggtgcacacagcaagaggcgagagcggcggctggtgagtacgccaaattttttgactagcggaggctagaaggagagagcgactcggaccgatg

SEQ ID NO: 9943 - DNA, 203 bp, Homo sapiens
  source 1..203: mol_type = other DNA
ggcgcgccagtcctccttcctaaacagggacttgaaagcgaaagttaacagggactcgaaagcgaaagttccagagaagttctctcgacgcaggactcggcttgctgaaggtgcacacagcaagaggcgagagcggcggctggtgagtacgccataaattttgactagcggaggctagaaggagagagcgactcggaccgatg

SEQ ID NO: 9944 - DNA, 203 bp, Homo sapiens
  source 1..203: mol_type = other DNA
ggcgcgccagtcctctgtttgaaacagggacttgaaagtgaaagttaatagggactcgaaagcggaagttcccagaggagatctctcgacgcaggactcggcttgctgcagcgcgcacagcaagaggcgaggggcagcagctggtgagtacgctgaaattttgactagcggaggctagaaggagagagcgactcggaccgatg

SEQ ID NO: 9945 - DNA, 203 bp, Homo sapiens
  source 1..203: mol_type = other DNA
ggcgcgccagtcctcagtacagaactagagatccctcagaccactctagaaggtgtaaaaatctctagcagtggcgcccgaacagggacccgaaagcgaaagttaatagggactcgaaagcgaaagttccagagaagttctctcgacgcaggactcggcttgctgaggtgcacacggcaagaggcgagcgactcggaccgatg

SEQ ID NO: 9946 - DNA, 203 bp, Homo sapiens
  source 1..203: mol_type = other DNA
ggcgcgccagtcctcacatgtaaactagagatccctcagaccactctagacagtgtaaaaatctctagcagtggcgcccgaacagggacccgaaagtgaaagttaatagggactcgaaagcgaaagttccagagaagttctctcgacgcaggactcggcttgctgaagtgcacacagcaagaggcgagcgactcggaccgatg

SEQ ID NO: 9947 - DNA, 203 bp, Homo sapiens
  source 1..203: mol_type = other DNA
ggcgcgccagtcctgttcgcgaaactagagatccctcagaccactctagacagtgtaaaaatctctagcagtggcgcccgaacagggacttgaaagcgaaagttaatagggactcgaaagcgaaagttccagagaagatctctcgacgcaggactcggcttgctgaagtgcactcggcaagaggcgagcgactcggaccgatg

SEQ ID NO: 9948 - DNA, 203 bp, Homo sapiens
  source 1..203: mol_type = other DNA
ggcgcgccagtcctcccttcgtaactagagatccctcagaccactctagacagtgtaaaaatctctagcagtggcgcccgaacagggacttgaaagcgaaagttaatagggactcgaaagcgaaagttccagagaagttctctcgacgcaggactcggcttgctgaggtgcacacagcaagaggcgagcgactcggaccgatg

SEQ ID NO: 9949 - DNA, 203 bp, Homo sapiens
  source 1..203: mol_type = other DNA
ggcgcgccagtccttgctcaaaaactagagatccctcagaccactctagacagtgtaaaaatctctagcagtggcgcccgaacagggacttgaaagtgaaagttaaaagggactcgaaagcggaagttccagagaagttctctcgacgcaggactcggcttgctgaggtgcacacagcaagaggcgagcgactcggaccgatg

SEQ ID NO: 9950 - DNA, 203 bp, Homo sapiens
  source 1..203: mol_type = other DNA
ggcgcgccagtccttcaactggaactagagatccctcagaccactctagacggtataaaaatctctagcagtggcgcccgaacagggacccgaaagtgaaagttaatagggactcgaaagcggaagttccagagaagttctctcgacgcaggactcggcttgctgaggtgcacacagcaagaggcgagcgactcggaccgatg

SEQ ID NO: 9951 - DNA, 203 bp, Homo sapiens
  source 1..203: mol_type = other DNA
ggcgcgccagtcctcgtcttgcaactagagatccctcagaccactctagactaagtaaaaatctctagcagtggcgcccgaacagggactcgaaagcgaaagttaatagggactcgaaagcgaaagttccagagaagttctctcgacgcaggactcggcttgctgaggtgcacacagcaagaggcgagcgactcggaccgatg

SEQ ID NO: 9952 - DNA, 203 bp, Homo sapiens
  source 1..203: mol_type = other DNA
ggcgcgccagtcctccaaccagaactagagatccctcagaccactctagactaagtaaaaatctctagcagtggcgcccgaacagggacttgaaagcgaaagttaatagggactcgaaagcgaaagttccagagaagttctctcgacgcaggactcggcttgctgaggtgcacacagcaagaggcgagcgactcggaccgatg

SEQ ID NO: 9953 - DNA, 203 bp, Homo sapiens
  source 1..203: mol_type = other DNA
ggcgcgccagtcctaggccaagaactagagatccctcagaccactctagactaagtaaaaatctctagcagtggcgcccgaacagggacttgaaagcgaaagttaatagggactcgaaagcgaaagttccagagaagttctctcgacgctggactcggcttgctgaggtacacacagcaagaggcgagcgactcggaccgatg

SEQ ID NO: 9954 - DNA, 203 bp, Homo sapiens
  source 1..203: mol_type = other DNA
ggcgcgccagtcctgcgttctgaactagagatccctcagaccactctagactgagtaaaaatctctagcagtggcgcccgaacagggacttgaaagcgaaagttaatagggactcgaaagcgaaagttccagagaagttctctcgacgcaggactcggcttgctgaggtgcacacagcaagaggcgagcgactcggaccgatg

SEQ ID NO: 9955 - DNA, 203 bp, Homo sapiens
  source 1..203: mol_type = other DNA
ggcgcgccagtcctgtctacttaactagagatccctcagaccactctagactgagtaaaaatctctagcagtggcgcccgaacagggacttgaaagcgaaagttaatagggactcgaaagcgaaagttccagagaagttctctcgacgcaggactcggcttgctgcggtgcacacagcaagcggcgagcgactcggaccgatg

SEQ ID NO: 9956 - DNA, 203 bp, Homo sapiens
  source 1..203: mol_type = other DNA
ggcgcgccagtcctgagtacctaactagagatccctcagaccactctagactgagtaaaattctctagcagtggcgcccgaacagggacttgaaaacgaaagttaatagggactcgaaagcgaaagttccagagaagttctctcgacgcaggactcggcttgctgaggtgcacacagcaagaggcgagcgactcggaccgatg

SEQ ID NO: 9957 - DNA, 203 bp, Homo sapiens
  source 1..203: mol_type = other DNA
ggcgcgccagtcctccaggctaaactagagatccctcagaccactctagactgtgtaaaaatctctagcagtggcgcccgaacagggacttgaaagtgaaagttaatagggactcgaaagcgaaagttccagagaagttctctcgacgcaggactcggcttgctgaggtgcacacagcaagaggcgagcgactcggaccgatg

SEQ ID NO: 9958 - DNA, 203 bp, Homo sapiens
  source 1..203: mol_type = other DNA
ggcgcgccagtccttagcctttaactagagatccctcagaccactctagatagtgtaaaaatctctagcagtggcgcccgaacagggacttgaaaacgaaagttaatagggactcgaaagcgaaagttccagagaagttctctcgacgcaggactcggcttgctgaggtgcacacagcaagaggcgagcgactcggaccgatg

SEQ ID NO: 9959 - DNA, 203 bp, Homo sapiens
  source 1..203: mol_type = other DNA
ggcgcgccagtcctggcggctcaatctatagcagtggcgcccgaacagggaccagaaagcgaaagtagaaccagaggagctctctcgacgcaggactcggcttgctgaagcgcgcacggcaagaggcgaggggcggcgactggtgagtacgccaaaaattttgactagcggaggctagaaggagagagcgactcggaccgatg

SEQ ID NO: 9960 - DNA, 203 bp, Homo sapiens
  source 1..203: mol_type = other DNA
ggcgcgccagtcctcagctatcaatctctagcagtggcgcccgaacagggaccagaaagcgaaagtaaaaccagagaagttctctcgacgcaggactcggcttgctgaagtgcactcggcaagaggcgagaggggcggctggtgagtacgccatttttatttgactagcggaggctagaaggagagagcgactcggaccgatg

SEQ ID NO: 9961 - DNA, 203 bp, Homo sapiens
  source 1..203: mol_type = other DNA
ggcgcgccagtcctgtaccgttaatctctagcagtggcgcccgaacagggaccagaaagcgaaagtaagaccagaggagatctctcgacgcaggactcggcttgctgaagtgcactcggcaagaggcgagagcggcgactggtgagtacgccaattttatttgactagcggaggctagaaggagagagcgactcggaccgatg

SEQ ID NO: 9962 - DNA, 203 bp, Homo sapiens
  source 1..203: mol_type = other DNA
ggcgcgccagtcctaaacagtgaatctctagcagtggcgcccgaacagggaccggaaaacgaaagtaaaaccagaggagatctctcgacgcaggactcggcttgctgaagcgcgcacggcaagaggcgaggggcggcggctggtgagtacgccaaaatttttgactagcggaggctagaaggagagagcgactcggaccgatg

SEQ ID NO: 9963 - DNA, 203 bp, Homo sapiens
  source 1..203: mol_type = other DNA
ggcgcgccagtcctctgctcctaatctctagcagtggcgcccgaacagggaccggaaagcgaaagagaaaccagaggagctctctcgacgcaggactcggcttgctgaagcgcgcacggcaagaggcgagaggcggcgactggtgagtacgccgaaatttttgactagcggaggctagaaggagagagcgactcggaccgatg

SEQ ID NO: 9964 - DNA, 203 bp, Homo sapiens
  source 1..203: mol_type = other DNA
ggcgcgccagtcctagtgcaaaaatctctagcagtggcgcccgaacagggacctgaaagcgaaagtaaaaccagagaagatctctcgacgcaggactcggcttgctgaggcgcacggcaagaggcgaggagcggcgactggtgagtacgccgaaaaatttttgactagcggaggctagaaggagagagcgactcggaccgatg

SEQ ID NO: 9965 - DNA, 203 bp, Homo sapiens
  source 1..203: mol_type = other DNA
ggcgcgccagtccttaacacgtaatctctagcagtggcgcccgaacagggacctgaaagcgaaagtaagaccagaggagatctctcgacgcaggactcggcttgctgaagtgcactcggcaagaggcgagagcggcgactggtgagtacgccaaatttatttgactagcggaggctagaaggagagagcgactcggaccgatg

SEQ ID NO: 9966 - DNA, 203 bp, Homo sapiens
  source 1..203: mol_type = other DNA
ggcgcgccagtcctagcgtgttaatctctagcagtggcgcccgaacagggacctgaaagcgaaagtaagaccagaggagatctctcgacgcaggactcggcttgctgaagtgcactcggcaagaggcgagaggggcgactggtgagtacgccaattttatttgactagcggaggctagaaggagagagcgactcggaccgatg

SEQ ID NO: 9967 - DNA, 203 bp, Homo sapiens
  source 1..203: mol_type = other DNA
ggcgcgccagtcctggaacgccaatctctagcagtggcgcccgaacagggacctgaaagcgaaagtagaaccagagaagatctctcgacgcaggactcggcttgctgaagcgcgcacagcaagaggcgaggggcagcgactggtgagtacgctgaaatttttgactagcggaggctagaaggagagagcgactcggaccgatg

SEQ ID NO: 9968 - DNA, 203 bp, Homo sapiens
  source 1..203: mol_type = other DNA
ggcgcgccagtccttggttcaaaatctctagcagtggcgcccgaacagggacctgaaagcgaaagtagaaccagaggagatctctcgacgcaggactcggcttgctgaagcgcgcacagcaagaggcgaggggcggcgactggtgagtacgccaaaaattttgactagcggaggctagaaggagagagcgactcggaccgatg

SEQ ID NO: 9969 - DNA, 203 bp, Homo sapiens
  source 1..203: mol_type = other DNA
ggcgcgccagtcctgcgaggagaatctctagcagtggcgcccgaacagggacctgaaagcgaaagtgagaccagagaagctctctcgacgcaggactcggcttgctgaagcgcgcacagcaagaggcgagagcggcgactggtgagtacgccgaaaatttttgactagcggaggctagaaggagagagcgactcggaccgatg

SEQ ID NO: 9970 - DNA, 203 bp, Homo sapiens
  source 1..203: mol_type = other DNA
ggcgcgccagtcctgcacaggaaatctctagcagtggcgcccgaacagggacctgaaagcgaaagtgagaccagaggagatctctcgacgcaggactcggcttgctgaagtgcactcagcaagaggcgagagcggcgactggtgagtacgccaattttatttgactagcggaggctagaaggagagagcgactcggaccgatg

SEQ ID NO: 9971 - DNA, 203 bp, Homo sapiens
  source 1..203: mol_type = other DNA
ggcgcgccagtcctgtaactgcaatctctagcagtggcgcccgaacagggactagaaagcgaaagtagaaccagagaagatctctcgacgcaggactcggcttgctgaagcgcacggcaagaggcgaggggcggcgactggtgagtacgccaacaaatttttgactagcggaggctagaaggagagagcgactcggaccgatg

SEQ ID NO: 9972 - DNA, 203 bp, Homo sapiens
  source 1..203: mol_type = other DNA
ggcgcgccagtcctcaactgacaatctctagcagtggcgcccgaacagggacttgaaaacgaaagtaaactggagcagttctctcgacgcggggactcggcttgctgaagtgcacacggcaagaggcgaggggaggcgactggtgagtacgcctaacttttgactagcggtaggctagaaggagagagcgactcggaccgatg

SEQ ID NO: 9973 - DNA, 203 bp, Homo sapiens
  source 1..203: mol_type = other DNA
ggcgcgccagtcctgatcgccgaatctctagcagtggcgcccgaacagggacttgaaaacgaaagtagaaccagaggagatctctcgacgcaggactcggcttgctgaagcgcgcacggcaagaggcgaggggcggcgactggtgagtacgccaaaaactttgactagcggaggctagaaggagagagcgactcggaccgatg

SEQ ID NO: 9974 - DNA, 203 bp, Homo sapiens
  source 1..203: mol_type = other DNA
ggcgcgccagtcctcaatcattaatctctagcagtggcgcccgaacagggacttgaaaacgaaagtagaaccggaggagctctctcgacgcaggactcggcttgctgaagcgcgcgcggcaagaggcgaggggcggcgactggtgagtacgccaaaatttttgactagcggaggctagaaggagagagcgactcggaccgatg

SEQ ID NO: 9975 - DNA, 203 bp, Homo sapiens
  source 1..203: mol_type = other DNA
ggcgcgccagtcctgtgtcgtcaatctctagcagtggcgcccgaacagggacttgaaagcgaaagtaagaccagaggagatctctcgacgcaggactcggcttgctgaagtgcactcggcaagaggcgagaggggcgactggtgagtacgccaattttatttgactagcggaggctagaaggagagagcgactcggaccgatg

SEQ ID NO: 9976 - DNA, 203 bp, Homo sapiens
  source 1..203: mol_type = other DNA
ggcgcgccagtcctaccgcacaaatctctagcagtggcgcccgaacagggacttgaaagcgaaagtaagaccagaggagctctctcgacgcaggactcggcttgctgaagcgcgcacagcaagaggcgaggggcggcgactggtgagtacgccaaaacttttgactagcggaggctagaaggagagagcgactcggaccgatg

SEQ ID NO: 9977 - DNA, 203 bp, Homo sapiens
  source 1..203: mol_type = other DNA
ggcgcgccagtcctgaggagttaatctctagcagtggcgcccgaacagggacttgaaagcgaaagtagaaccagagaagatctctcgacgcaggactcggcttgctgcagcgcgcacggcaagaggcgaggggcggcgaccggtgagtacgccaaaatttttgactagcggaggctagaaggagagagcgactcggaccgatg

SEQ ID NO: 9978 - DNA, 203 bp, Homo sapiens
  source 1..203: mol_type = other DNA
ggcgcgccagtcctcttgacagaatctctagcagtggcgcccgaacagggacttgaaagcgaaagtagaaccagaggagatctctcgacgcaggactcggcttgctgaagcgcgcacagcaagaggcgaggggcggcgactggtgagtacgccaaaattttttactagcggaggctagaaggagagagcgactcggaccgatg

SEQ ID NO: 9979 - DNA, 203 bp, Homo sapiens
  source 1..203: mol_type = other DNA
ggcgcgccagtccttacgccctaatctctagcagtggcgcccgaacagggacttgaaagcgaaagtagaaccagaggagctctctcgacgcaggactcggcttgctgaagcgcgcacagcaagaggcgaggggcagcgaacggtgagtacgctgaaatttttgactagcggaggctagaaggagagagcgactcggaccgatg

SEQ ID NO: 9980 - DNA, 203 bp, Homo sapiens
  source 1..203: mol_type = other DNA
ggcgcgccagtcctgacctgaaaatctctagcagtggcgcccgaacagggacttgaaagcgaaagtagaaccagaggagctctctcgacgcaggactcggcttgctgaagcgcgcacagcaagaggcgaggggcggcgactggtgagtacgccaaaatttttgactagcggaggctagaaggagagagcgactcggaccgatg

SEQ ID NO: 9981 - DNA, 203 bp, Homo sapiens
  source 1..203: mol_type = other DNA
ggcgcgccagtcctcccggaacaatctctagcagtggcgcccgaacagggacttgaaagcgaaagtagaaccagaggagctctctcgacgcaggactcggcttgctgaagcgcgcacggcaagaggcgaggggcagcgaacggtgagtacgctgaaaaatttgactagcggaggctagaaggagagagcgactcggaccgatg

SEQ ID NO: 9982 - DNA, 203 bp, Homo sapiens
  source 1..203: mol_type = other DNA
ggcgcgccagtcctagcacttgaatctctagcagtggcgcccgaacagggacttgaaagcgaaagtagaaccagaggagctctctcgacgcaggactcggcttgctgaagcgcgcacggcaagaggcgaggggcggcgaacggtgagtacgccaaaatttttgactagcggaggctagaaggagagagcgactcggaccgatg

SEQ ID NO: 9983 - DNA, 203 bp, Homo sapiens
  source 1..203: mol_type = other DNA
ggcgcgccagtcctaaggcatgaatctctagcagtggcgcccgaacagggacttgaaagcgaaagtagaaccggaggagctctcttgacgcaggactcggcttgctgaagcgcgcacggcaagaggcgaggggcggcgactggtgagtacgccaaaatttttgactagcggaggctagaaggagagagcgactcggaccgatg

SEQ ID NO: 9984 - DNA, 203 bp, Homo sapiens
  source 1..203: mol_type = other DNA
ggcgcgccagtcctctaaggtaaatctctagcagtggcgcccgaacaggggcaagaaaaggaaaatgagacccgaggggatttcttgacgcaggactcggcttgctgaagtgcactcggcaagaggcgagaggggcgactggtgagtacgccaattttatttgactagcggaggctagaaggagagagcgactcggaccgatg

SEQ ID NO: 9985 - DNA, 203 bp, Homo sapiens
  source 1..203: mol_type = other DNA
ggcgcgccagtcctccatacggaatctctagcagtggcgcctgaacagggacctgaaaacgaaagcggaaccggagcagctctctcgacgcaggactcggcttgctgaagcgcgcacagcaagaggcgaggggaggcgactggtgagtacgccaaattttttgactagcggaggctagaaggagagagcgactcggaccgatg

SEQ ID NO: 9986 - DNA, 203 bp, Homo sapiens
  source 1..203: mol_type = other DNA
ggcgcgccagtcctcggtcatcaatttttagcaggggggccccaacagggacccgaaagccaaagttagaacccgagaagttctctcgacgcaggaactcggcttgctgaggtgcacacagcaagaggcgaaagcggcgaactggtgagtaccgccctttttgattaccggaggttaataggagagagcgactcggaccgatg

SEQ ID NO: 9987 - DNA, 203 bp, Homo sapiens
  source 1..203: mol_type = other DNA
ggcgcgccagtcctatacatgaacagggaccagaaagtgaaagtggaaccagggaagaaaacctccgacgcaacgggctcggcttagcggagtgcacctgctaagaggcgagaggaactcacagagggtgagtaaattgctggcggtggccagacctaggggaaggacgaagtctctaggggaggaagcgactcggaccgatg

SEQ ID NO: 9988 - DNA, 203 bp, Homo sapiens
  source 1..203: mol_type = other DNA
ggcgcgccagtccttcgtgcggacagggacctgaaagcgaaagttaatagggactcgaaagcgaaagttccagagaagttctctcgacgcaggactcggcttgctgaggtgcacacagcaagaggcgagagcggcgactggtgagtacgccaaaaattttttgactagcggaggctagaaggagagagcgactcggaccgatg

SEQ ID NO: 9989 - DNA, 203 bp, Homo sapiens
  source 1..203: mol_type = other DNA
ggcgcgccagtcctcgtgcagtacagggaccttaaagcgaaagtaaaagggactcgaaagcggaagttccagagaagatctctcgacgcaggactcggcttgctgagtgcacacagcaagaggcgaggggcggcgactggtgagtacgccaaaaatttttttgactagcggaggctaggaggagagagcgactcggaccgatg

SEQ ID NO: 9990 - DNA, 203 bp, Homo sapiens
  source 1..203: mol_type = other DNA
ggcgcgccagtccttgcgttagacagggacgcgaaagagaaagtgaaaccagggaagaaaacctccgacgcaacgggctcggcttagcggagtgcacctgctaagaggcgagaggaactcacaggggtgagtaaatttgctggcggtggccagacctaggggaagggcgaagtctctaggggaggaagcgactcggaccgatg

SEQ ID NO: 9991 - DNA, 203 bp, Homo sapiens
  source 1..203: mol_type = other DNA
ggcgcgccagtccttatctcgcactagagatccctcagaccactctagacagtgtaaaaatctctagcagtggcgcccgaacagggacctgaaagcgaaagttaatagggactcgaaagcgaaagttccagagaagttctctcgacgcaggactcggctcgctgaaggtgcactcggcgagaggcgagcgactcggaccgatg

SEQ ID NO: 9992 - DNA, 203 bp, Homo sapiens
  source 1..203: mol_type = other DNA
ggcgcgccagtccttttagctaactagagatccctcagaccactctagactgagtaaaaatctctaccagtggcgcccgaacagggcactcgaaagcgaaagttaatagggactcgaaagcgaaagttccagagaagttctctcgacgcaggactcggcttgctgaggtgcacacagcaagaggcgagcgactcggaccgatg

SEQ ID NO: 9993 - DNA, 203 bp, Homo sapiens
  source 1..203: mol_type = other DNA
ggcgcgccagtccttgcctccaactagagatccctcagaccactctagactgagtaaaaatctctagcagtggcgcccgaacagggacttgaaagcgaaagttaatagggactcgaaagcgaaagttccagagaagttctctcgacgcaggactcggcttgctgaggtgcgcaacagcaagaggcgagcgactcggaccgatg

SEQ ID NO: 9994 - DNA, 203 bp, Homo sapiens
  source 1..203: mol_type = other DNA
ggcgcgccagtcctcgcattacactagagatccctcagaccactctagatagtgtaaaaatctctagaagtggcgcccgaacagggacttgaaagcgaaagttaaacgggactcgaaagcgaaagttccagagaagttctctcgacgcaggactcggcttgctgaaggtgcacacagcaagaggcgagcgactcggaccgatg

SEQ ID NO: 9995 - DNA, 203 bp, Homo sapiens
  source 1..203: mol_type = other DNA
ggcgcgccagtcctcataaataactagagatccctcagaccactctagtgagtgtaaaaatctctagcagtggcgcccgaacagggacttgaaagcgaaagttaacagggactcgaaagcgaaagttccagagaagttctctcgacgcaggactcggcttgctgaaggtgcacgcagcaagaggcgagcgactcggaccgatg

SEQ ID NO: 9996 - DNA, 203 bp, Homo sapiens
  source 1..203: mol_type = other DNA
ggcgcgccagtcctgtactttgagacagattcggattggcagagagcctgttggaatcaaaagaaggttgccaaaagattcttaaagttttagaaccattagtaccaacagggtcagaaaatttaaaaagcctttttaataccgtctgcgtcatttggtgcttgcacgcagaagagaaagtgaaagatcgactcggaccgatg

SEQ ID NO: 9997 - DNA, 203 bp, Homo sapiens
  source 1..203: mol_type = other DNA
ggcgcgccagtcctgaacgagcagacagatttggatcggcagaaagcctgttggaaagcaaagaaggatgtcaaagaatattagcagtactagctccattaatgccaacaggctcggaaaatttaaaaagcttgtttagtactgtctgcgtagtttggtgtctgcacgcagaaatgaaagtgaaagaccgactcggaccgatg

SEQ ID NO: 9998 - DNA, 203 bp, Homo sapiens
  source 1..203: mol_type = other DNA
ggcgcgccagtccttttagacgagcagtggcgcctgaacagggacccgaaagcgaaagtaggaccagaggagatctctcgacgcaggactcggcttgctgaagtgcgcacggcaagaggcgaggggacggcggctgggtgagtacgccaaaaataaaattttgactagcggaggctagaaggagagagcgactcggaccgatg

SEQ ID NO: 9999 - DNA, 203 bp, Homo sapiens
  source 1..203: mol_type = other DNA
ggcgcgccagtcctatcttagcatcaattgtgtgactctggtatctagagatccctcagacctctttagtccgggtggaaaatctctagcagtggcgcccgaacagggacgcgaaagcgaaagtagaaccggagaagatctctcgacgcaggactcggcttgctgaagcgcgcacagcaagaggcgagcgactcggaccgatg

SEQ ID NO: 10000 - DNA, 203 bp, Homo sapiens
  source 1..203: mol_type = other DNA
ggcgcgccagtcctctgtgggcatccaatttgtgactctggtatctagagatccctcagatattaagtgtctgtgcggaaaatctctagcagtggcgcccgaacagggacttgaaaacgaaagtgtaaccggagaagttctctcgacgcaggactcgacttgctgagtgcgcaccagcaaggggcgagcgactcggaccgatg

SEQ ID NO: 10001 - DNA, 203 bp, Homo sapiens
  source 1..203: mol_type = other DNA
ggcgcgccagtcctgcaaggttatccattcggtaactctggtacctagagatccctcagaccatctggactgagtagaaaatctctagcagtggcgcccgaacagggacttgaaaacgaaagtagaaccggaggctgaatctctcgacgcaaggactcggctcgttggtgcacacagcgagaggcgagcgactcggaccgatg

SEQ ID NO: 10002 - DNA, 203 bp, Homo sapiens
  source 1..203: mol_type = other DNA
ggcgcgccagtcctggcggtgtatctctagcagtggcgcccgaacagggacccgaaagcgaaagtagaaccagagaagctctctcgacgcaggactcggcttgctgaagcgcgctcggcaagaggcgaggggcggcgactggtgagtacgcctaaaatttttgactagcggaggctagaaggagagagcgactcggaccgatg

SEQ ID NO: 10003 - DNA, 203 bp, Homo sapiens
  source 1..203: mol_type = other DNA
ggcgcgccagtccttgcgtatcatctctagcagtggcgcccgaacagggacccgaaagcgaaagtgagaccagagaagatctctcgacgcaggactcggcttgctgaagtgcactcggcaagaggcgagaggggcggctggtgagtacgccaaattttatttgactagcggaggctagaaggagagagcgactcggaccgatg

SEQ ID NO: 10004 - DNA, 203 bp, Homo sapiens
  source 1..203: mol_type = other DNA
ggcgcgccagtcctttgctttaatctctagcagtggcgcccgaacagggacccgaaagtgaaagtaagaccagaggaggtctctcgacgcaggactcggcttgctgaagtgcactcggcaagaggcgagagcggcgactggtgagtacgccaaattttatttgactagcggaggctagaaggagagagcgactcggaccgatg

SEQ ID NO: 10005 - DNA, 203 bp, Homo sapiens
  source 1..203: mol_type = other DNA
ggcgcgccagtcctgattagatatctctagcagtggcgcccgaacagggacctgaaaagcgaaagtaaaaccagagaagctctctcgacgcaggactcggcttgctgagcgcgcacggcaagaggcgaggggcagcgactggtgagtacgctgaaattttttgactagcggaggctagaaggagagagcgactcggaccgatg

SEQ ID NO: 10006 - DNA, 203 bp, Homo sapiens
  source 1..203: mol_type = other DNA
ggcgcgccagtcctaaatttagatctctagcagtggcgcccgaacagggacctgaaagcgaaagtaagaccagaggagatctctcgacgcaggactcggcttgctgaagtgcactcggcaagaggcgagagcggcggctggtgagtacgccaatttttatttgactagcggaggctagaaggagagagcgactcggaccgatg

SEQ ID NO: 10007 - DNA, 203 bp, Homo sapiens
  source 1..203: mol_type = other DNA
ggcgcgccagtcctgcgttaccatctctagcagtggcgcccgaacagggacgcgaaaagcgaaaataaaaccagagaagatctctcgacgcaggactcggcttgctgaagtgcacacggcaagaggcgaggggagcggcgactggtgagtacgccaatttttgactagcggaggctagaaggagagagcgactcggaccgatg

SEQ ID NO: 10008 - DNA, 203 bp, Homo sapiens
  source 1..203: mol_type = other DNA
ggcgcgccagtcctagcagcttatctctagcagtggcgcccgaacagggacgctgaaagtgaaagagaaaccagaggagctctctcgacgcaggactcggcttgctgcagcgcgcacggcaagaggcgaggggcggcgactggtgagtacgccaaaatttttgactagcggaggctagaaggagagagcgactcggaccgatg

SEQ ID NO: 10009 - DNA, 203 bp, Homo sapiens
  source 1..203: mol_type = other DNA
ggcgcgccagtcctataaagttatctctagcagtggcgcccgaacagggacgtgaaagcgaaagtagaaccagagaagctctctcgacgcgaggactcggcttgctgaagcgcgcacagcaagaggcgaggggcggcgactggtgagtacgccgaattttttgactagcggaggctagaaggagagagcgactcggaccgatg

SEQ ID NO: 10010 - DNA, 203 bp, Homo sapiens
  source 1..203: mol_type = other DNA
ggcgcgccagtcctaaggagcgatctctagcagtggcgcccgaacagggactagaaaacgaaagtaaggccagaggagatctctcgacgcaggactcggcttgctgaagtgcacacggcaagaggcgagagcggcggctggagagtacgccgaattttatttgactagcggaggctagaaggagagagcgactcggaccgatg

SEQ ID NO: 10011 - DNA, 203 bp, Homo sapiens
  source 1..203: mol_type = other DNA
ggcgcgccagtcctctgcaataatctctagcagtggcgcccgaacagggacttgaaaacgaaagtgtaaccggagaagttctctcgacgcaggactcgacttgctgagtgcgcaccagcaaggggcgaggggccggcgactggtgagtacgcctaatttttgactagcgaaagctagaaggagagaggcgactcggaccgatg

SEQ ID NO: 10012 - DNA, 203 bp, Homo sapiens
  source 1..203: mol_type = other DNA
ggcgcgccagtcctacttcgaaatctctagcagtggcgcccgaacagggacttgaaagcgaaagagaaaccagaggagctctctcgacgcaggactcggcttgctgaagcgcgcacggcaagaggcgaggggcggcgactggtgagtacgccaaaattttttgactagcggatgctagaagaaaaaagcgactcggaccgatg

SEQ ID NO: 10013 - DNA, 203 bp, Homo sapiens
  source 1..203: mol_type = other DNA
ggcgcgccagtccttcttcacgatctctagcagtggcgcccgaacagggacttgaaagcgaaagggaaaccagaggagctctctcgacgcaggactcggcttgctgaagcgcgcacggcaagaggcgaggggcggcgactggtgagtacgccgaaaatttttgactagcggaggctagaaggagagagcgactcggaccgatg

SEQ ID NO: 10014 - DNA, 203 bp, Homo sapiens
  source 1..203: mol_type = other DNA
ggcgcgccagtcctcaatgggtatctctagcagtggcgcccgaacagggacttgaaagcgaaagtaaaaccagaggagatctctcgacgcaggactcggcttgctgaagtgcactcggcaagaggcgagagcggcgactggtgagtacgccgaattttatttgactagcggaggctagaaggagagagcgactcggaccgatg

SEQ ID NO: 10015 - DNA, 203 bp, Homo sapiens
  source 1..203: mol_type = other DNA
ggcgcgccagtcctatccttccatctctagcagtggcgcccgaacagggacttgaaagcgaaagtaaaaccagaggagatctctcgacgcaggactcggcttgctgaagtgcactcggcaagaggcgagagcggcggctggtgagtacgccaaattttatttgactagcggaggctagaaggagagagcgactcggaccgatg

SEQ ID NO: 10016 - DNA, 203 bp, Homo sapiens
  source 1..203: mol_type = other DNA
ggcgcgccagtcctttcatcgcatctctagcagtggcgcccgaacagggacttgaaagcgaaagtaagaccagagaagatctctcgacgcaggactcggcttgctgaagtgcactcggcaagaggcgagagcggcgactggtgagtacgccaaattttatttgactggcggaggctagaaggagagagcgactcggaccgatg

SEQ ID NO: 10017 - DNA, 203 bp, Homo sapiens
  source 1..203: mol_type = other DNA
ggcgcgccagtcctaccaactgatctctagcagtggcgcccgaacagggacttgaaagcgaaagtaagaccagagaagatctctcgacgcaggactcggcttgctgaagtgcactcggcaagaggcgagaggggcggctggtgagtacgccaatttttatttgactagcggaggctagaaggagagagcgactcggaccgatg

SEQ ID NO: 10018 - DNA, 203 bp, Homo sapiens
  source 1..203: mol_type = other DNA
ggcgcgccagtcctaggtaactatctctagcagtggcgcccgaacagggacttgaaagcgaaagtaagaccagagcagatctctcgacgcaggactcggcttgctgaagtgcactcggcaagaggcgagagcggcgactggtgagtacgccgaattttatttgactagcggaggctagaaggagagagcgactcggaccgatg

SEQ ID NO: 10019 - DNA, 203 bp, Homo sapiens
  source 1..203: mol_type = other DNA
ggcgcgccagtcctggaatcaaatctctagcagtggcgcccgaacagggacttgaaagcgaaagtaagaccagaggagaactctcgacgcaggactcggcttgctgaagtgcactcggcaagaggcgagagaggcggctggtggagtacgccatttttatttgactagcggaggctagaaggagagagcgactcggaccgatg

SEQ ID NO: 10020 - DNA, 203 bp, Homo sapiens
  source 1..203: mol_type = other DNA
ggcgcgccagtcctaatcacttatctctagcagtggcgcccgaacagggacttgaaagcgaaagtaagaccagaggagatctctcgacgcaggactcggcttgctgaagtgcacacggcaagaggcgagagcggcggctggtgagtacgccaaattttatttgactagcggaggctagaaggagagagcgactcggaccgatg

SEQ ID NO: 10021 - DNA, 203 bp, Homo sapiens
  source 1..203: mol_type = other DNA
ggcgcgccagtccttaacgataatctctagcagtggcgcccgaacagggacttgaaagcgaaagtaagaccagaggagatctctcgacgcaggactcggcttgctgaagtgcactcggcaagaggcgagagcggcgactggtgagtacgccgaattttatttgactagcggaggctagaaggagagagcgactcggaccgatg

SEQ ID NO: 10022 - DNA, 203 bp, Homo sapiens
  source 1..203: mol_type = other DNA
ggcgcgccagtcctacaagcgcatctctagcagtggcgcccgaacagggacttgaaagcgaaagtaagaccagaggagatctctcgacgcaggactcggcttgctgaagtgcactcggcaagaggcgagagcggcggctggtgagtacgccaaattttatttgactagcggaggctaggaggagagagcgactcggaccgatg

SEQ ID NO: 10023 - DNA, 203 bp, Homo sapiens
  source 1..203: mol_type = other DNA
ggcgcgccagtcctcttactagatctctagcagtggcgcccgaacagggacttgaaagtgaaagtaagaccagaggaaatctctcgacgcaggactcggcttgctgaagtgcactcggcaagaggcgagagcggcggctggtgagtacgccaaaatttatttgactagcggaggctagaaggagagagcgactcggaccgatg

SEQ ID NO: 10024 - DNA, 203 bp, Homo sapiens
  source 1..203: mol_type = other DNA
ggcgcgccagtcctagattcgtatctctagcagtggcgcccgaacagggacttgaagcgaaagcgaaagccagagaagttctctcgacgcaggactcggcttgctgagcgcgcacagcaagaggcgaggggcggcggctggtgagtacgccaaatttcttttgactagcggaggctagaaggagagagcgactcggaccgatg

SEQ ID NO: 10025 - DNA, 203 bp, Homo sapiens
  source 1..203: mol_type = other DNA
ggcgcgccagtcctccattagcatctgttcaaccctggtgtctagagatccctcagatcacttagactgaagcagaaaatctctagcagtggcgcccgaacagggacttgaagtgaaagtgaaaccagggaagaaaacctccgacgcaacgggctcggcttagcggagtgcacccgctaagaggcgagcgactcggaccgatg

SEQ ID NO: 10026 - DNA, 203 bp, Homo sapiens
  source 1..203: mol_type = other DNA
ggcgcgccagtcctctatacaaatctgttcgaccctggtatctagagatccctcagatcacttagactgaagcagaaaatctctagcagtggcgcccgaacagggaccggaagagaaagtgaaaccagggaagaaaacctccgacgcgacgggctcggcttagcggagtgcacccgctaagaggcgagcgactcggaccgatg

SEQ ID NO: 10027 - DNA, 203 bp, Homo sapiens
  source 1..203: mol_type = other DNA
ggcgcgccagtcctaacgcggcatctgttgtgtgactctggtaactagagatccctcaaacccttttagtcagtgtgaaaaatctctagcagtggcgcccgaacagggacccgaaagcgaaagtagaaccggaggagctctctcgacgcaggactcggcttgctgaaccgcgcacggcaaaaggcgagcgactcggaccgatg

SEQ ID NO: 10028 - DNA, 203 bp, Homo sapiens
  source 1..203: mol_type = other DNA
ggcgcgccagtcctccagagaaatttgttgtgtgactctggtaactagagatccctcagaccattctagtcagtgtggaaaatctctagcagtggcgcccgaacagggacttgaaagcgaaagtagaaccagaggagatctctcgacgcaggactcggcttgctgaagcgcgcacggcaagaggcgagcgactcggaccgatg

SEQ ID NO: 10029 - DNA, 203 bp, Homo sapiens
  source 1..203: mol_type = other DNA
ggcgcgccagtcctatacaaatcaggctcagaaaatttaaagagtctttataatactgtctgcgtcatttggtgcatacacgcagaaatgaaagtgaaaaatactgaggaagcaaagcagatagtgcagaaacacctagcggtagaaaatgaaactgcagaccaattgcctgccacaagtagaccaaccgactcggaccgatg

SEQ ID NO: 10030 - DNA, 203 bp, Homo sapiens
  source 1..203: mol_type = other DNA
ggcgcgccagtcctatacgtctcagggacctgaaaaagaaagttaatagggactcgaaagcgaaagttccagagaagttctctcgacgcaggactcggcttactgaagtgcacacagtaagaggcgagagcggcgactggtgagtacgccaaaaaattttttgactagcggaggctagaaggagagagcgactcggaccgatg

SEQ ID NO: 10031 - DNA, 203 bp, Homo sapiens
  source 1..203: mol_type = other DNA
ggcgcgccagtcctatggctcccagggacctgaaaaggaaagtgaaaccagggaagaaaacctccgacgcaacgggctcggcttagcggagtgcacctgctaagaggcgagaggactcacagaagggtgagtaaatttgctggcggtggccagacctaggggaagggcgaagtctctaggggaggaagcgactcggaccgatg

SEQ ID NO: 10032 - DNA, 203 bp, Homo sapiens
  source 1..203: mol_type = other DNA
ggcgcgccagtccttgggcaaccagggacctgaaagcgaaagttaatagggactcgaaaacgaaagttccagagaagttctctcgacgcaggactcggcttgctgaggtgcacacagcaagaggcgagagcggcgaactggtgagtacgcctaagattttttgactagcggaggctagaaggagagagcgactcggaccgatg

SEQ ID NO: 10033 - DNA, 203 bp, Homo sapiens
  source 1..203: mol_type = other DNA
ggcgcgccagtcctctccgtgccagggacttgaaagagaaagtgaaaccagggaagaaaacctccgacgcaacgggctcggcttagcggagtgcacccgctgagaggcgagaggaactcacagagggtgagtaaatttgctggcggtggccagacctaggggaagggcgaagtccctaggggaggaagcgactcggaccgatg

SEQ ID NO: 10034 - DNA, 203 bp, Homo sapiens
  source 1..203: mol_type = other DNA
ggcgcgccagtcctaatgctatcaggttcagaaaatttaaaaagtctttttaatactgtctgcgtcatttggtgcatacacgcagaagagaaagtgaaagatactgaaggagcaaaacaaatagtgcggagacatctagtggcagaaacaggaactgcagagaaaatgccaagcacaagtagaccaaccgactcggaccgatg

SEQ ID NO: 10035 - DNA, 203 bp, Homo sapiens
  source 1..203: mol_type = other DNA
ggcgcgccagtcctcccaccgacaggttcagaaaatttaaagagcctttacaatactgtctgcgtcatttggtgtttgcacgcagaagaaaaagtgaaacatactgaggaagcaaagcaagtagtgcagagacatctagtggtggaaacaggaacagcagacaacatgccgaaaacaagtaggccaaccgactcggaccgatg

SEQ ID NO: 10036 - DNA, 203 bp, Homo sapiens
  source 1..203: mol_type = other DNA
ggcgcgccagtccttactctatcaggttcagaaaatttaaagagcctttataatactgtctgcgtcatttggtgcattcacgcagaagagaaagtgaaacatactgaggaagcaaaacaaatagtgcagagacatctagtggtggaaacaggaacagcagacagaatgccagtaacaagcagaccaaccgactcggaccgatg

SEQ ID NO: 10037 - DNA, 203 bp, Homo sapiens
  source 1..203: mol_type = other DNA
ggcgcgccagtcctacgtcgctcaggttcagaaaatttaaagagcctttataatactgtctgcgtcatttggtgcttgcacgcagaagagaaagtgagacatactgaggaagcaaaacaagtagtgcagagacatctagtggtggaaacaggaacagcagacaacatgccgaaaacaagtaggccaaccgactcggaccgatg

SEQ ID NO: 10038 - DNA, 203 bp, Homo sapiens
  source 1..203: mol_type = other DNA
ggcgcgccagtcctgattgcgtcaggttcagaaaatttaaagagcttgtacaatactgtctgcgtcatttggtgcattcacgcagaagagaaagtgaaacatactgaggaagcaagacaaatagtgcagaaacatctagtggtggaaacaggaacagcagacaccatgccaaaaacaagtagaccaaccgactcggaccgatg

SEQ ID NO: 10039 - DNA, 203 bp, Homo sapiens
  source 1..203: mol_type = other DNA
ggcgcgccagtccttaaacgcgcatccattcggtaactctggtacctagagatccctcagaccatctagactgagtgaaaaatctctagcagtggcgcccgaacagggacttgaaaacgaaagtagaaccggaggctgaatctctcgacgcaggactcggctcgttggtgcacacagcgagaggcgagcgactcggaccgatg

SEQ ID NO: 10040 - DNA, 203 bp, Homo sapiens
  source 1..203: mol_type = other DNA
ggcgcgccagtcctgccaagatcatctgttgtgtgactctggtaactagagatccctcagacctctttggtcagtgtagaaaatctctagcagtggcgcccgaacagggacttgaaagcgaaagtagaaccagaggagctctctcgacgcaggactcggcttgctgagcgcgcacagcaagaggcgagcgactcggaccgatg

SEQ ID NO: 10041 - DNA, 203 bp, Homo sapiens
  source 1..203: mol_type = other DNA
ggcgcgccagtcctcgctgtagcattagtaccaacaggatcagaaaatttaaaaagcctttttaatactgtctgcgtcattttctgcctgcacgcagaagagaaagtgaaagatacagaggaggcaaaaaagatagcacagcgacacctagcggacgcagaaaaaatgacagctacaaataaaccaaccgactcggaccgatg

SEQ ID NO: 10042 - DNA, 203 bp, Homo sapiens
  source 1..203: mol_type = other DNA
ggcgcgccagtcctaggtccatcccgaacagggaccgaaagtgaaaccagggaagaaaacctccgacgcaacgggctcggcttagcggagtgcacccgctaagaggcgagaggaactcacaagagggtgagtaattttgctggcggtggccagacctaggggaagggcgaagtctctaggggaggaagcgactcggaccgatg

SEQ ID NO: 10043 - DNA, 203 bp, Homo sapiens
  source 1..203: mol_type = other DNA
ggcgcgccagtccttccaaacgcccgtctgttgtatgactctggtaactagagatccctcagaccactctagacggtgtaaaaaatctctagcagtggcgcccgaacagggacttgaaagcgaaagttccagagaagttctctcgacgcaggactcggcttgctgaggtgcacacagcaagaggcgagcgactcggaccgatg

SEQ ID NO: 10044 - DNA, 203 bp, Homo sapiens
  source 1..203: mol_type = other DNA
ggcgcgccagtcctgttacaatccgaacagggacccgaaagtgaaagttaatagggactcgaaagcggaagttccagagaagttctctcgacgcaggactcggcttgctgaggtgcacacagcaagaggcgagagcggcgactggtgagtacgccaatttttgactagcagaggctagaaggagagagcgactcggaccgatg

SEQ ID NO: 10045 - DNA, 203 bp, Homo sapiens
  source 1..203: mol_type = other DNA
ggcgcgccagtcctgggcatcaccgaacagggacttaaaagcgaaagttaatagggactcgaaagcgaaagttccagaaaagttctctcgacgcaggactcggcttgctgaggtgcacacagcaagaggcgagagcggcgactggtgagtacgccattttttaactagcggaggctagaaagagagagcgactcggaccgatg

SEQ ID NO: 10046 - DNA, 203 bp, Homo sapiens
  source 1..203: mol_type = other DNA
ggcgcgccagtccttaccgcagccgaacagggacttgaaaagcgaaagtaacagggactcgaaagcgaaagttccagagaagttctctcgacgcaggactcggcttgctgaggtgcacacagcaagaggcgagagcggcgactggtgagtacgccattttttgactagcggaggctagaaggagagagcgactcggaccgatg

SEQ ID NO: 10047 - DNA, 203 bp, Homo sapiens
  source 1..203: mol_type = other DNA
ggcgcgccagtccttaagtctaccgaacagggacttgaaagcgaaagctaatagggactcgaaagcgaaagttccagagaagttctctcgacgcaggactcggcttgctgcggtgcacacagcaagaggcgagacgggcgactggtgagtacgccaaattttgactagcggaggctagaaggagagagcgactcggaccgatg

SEQ ID NO: 10048 - DNA, 203 bp, Homo sapiens
  source 1..203: mol_type = other DNA
ggcgcgccagtcctttgacgcaccgaacagggacttgaaagcgaaagtaacagggactcgaaagcgaaagttccagagaagttctctcgacgcaggactcggcttgctgggtgcacacagcaagaggcgagagcggcgactggtgagtacgccataaattttgactagcggaggctagaaggagagagcgactcggaccgatg

SEQ ID NO: 10049 - DNA, 203 bp, Homo sapiens
  source 1..203: mol_type = other DNA
ggcgcgccagtcctacttgggtccgaacagggacttgaaagcgaaagttaacagggactcgaaagcgaaagttccagagaagttctctcgacgcaggactcggcttgctgaaggtgcacacagcaagaggcgagagcggctggtgagtacgccataaattttgactagcggaggctagaaggagagagcgactcggaccgatg

SEQ ID NO: 10050 - DNA, 203 bp, Homo sapiens
  source 1..203: mol_type = other DNA
ggcgcgccagtcctcaaagcacccgaacagggacttgaaagcgaaagttaatagggactcgaaagcgaaagttccagagaagttctctcgacgcaggactcggcttgctgaggtgcacacagcaagaggcgagagcggcggctggtgagtacgccaaattttgactagcggaggctagaaggagagagcgactcggaccgatg

SEQ ID NO: 10051 - DNA, 203 bp, Homo sapiens
  source 1..203: mol_type = other DNA
ggcgcgccagtcctcgcgtggaccgaacagggacttgaaagcgaaagttaatagggactcgaaagcgaaagttccagagaagttctctcgacgcaggactcggcttgctgaggtgcgcaacagcaagaggcgagagcggctactggtgagtacgccaatttttgactagcggaggctagaaggagaggcgactcggaccgatg

SEQ ID NO: 10052 - DNA, 203 bp, Homo sapiens
  source 1..203: mol_type = other DNA
ggcgcgccagtcctcaccctctccgaacagggacttgaaagcgaaagttaatagggactcgaaagcgaaagttccagagaagttctctcgacgcaggactcggcttgctgcggtgcacacagcaagcggcgagagcggcgactggtgagtacgccaagttttgactagcggaggctagaaggagagagcgactcggaccgatg

SEQ ID NO: 10053 - DNA, 203 bp, Homo sapiens
  source 1..203: mol_type = other DNA
ggcgcgccagtcctcggttaatccgaacagggactttaaaagcgaaagtaacagggactcgaaagcggaagttccagagaagatctctcgacgcaggactcggcttgctgaggtgcacacagcaagaggcgagagcggcgactggtgagtacgccaatttttaactagcggaggctagaaggagagagcgactcggaccgatg

SEQ ID NO: 10054 - DNA, 203 bp, Homo sapiens
  source 1..203: mol_type = other DNA
ggcgcgccagtcctctccaaccccgtctgttgtgtgactctggtaactagagatccctcagaccctttagtcagtgtggaaaatctctagcagtggcgcccgaacagggacttgaaagcgaaagagaaaccagaggagctctctcgacgcaggactcggcttgctgagcgcgcacagcaagaggcgagcgactcggaccgatg

SEQ ID NO: 10055 - DNA, 203 bp, Homo sapiens
  source 1..203: mol_type = other DNA
ggcgcgccagtcctttatgtgaccgtctgttgtttgactctggtaactagagatccctcagaccactctagactgtgtaaaaatctctagcagtggcgcccgaacagggactcgaaagcgaaagtgttccagagaagttctctcgacgcaggactcggcttgctgaggtgcacacagcaagaggcgagcgactcggaccgatg

SEQ ID NO: 10056 - DNA, 203 bp, Homo sapiens
  source 1..203: mol_type = other DNA
ggcgcgccagtcctccgctgcccgaacagggacttgaaagtgaaagttaatagggactcgaaagcgaaagttccagagaagttctctcgacgcaggactcggcttgctgaggtgcacacagcaagaggcgagagcggcgactggtgagtacgccaattttttgcctagcggaggctagaaggagagagcgactcggaccgatg

SEQ ID NO: 10057 - DNA, 203 bp, Homo sapiens
  source 1..203: mol_type = other DNA
ggcgcgccagtcctgtggaccacgaacagggacttgaaagtgaaagttaatagggactcgaaagcgaaagttccagagaagttctctcgacgcaggactcggcttgctgaggtgcacacagcaagaggcgaggagcggcgactggtgagtacgccaaattttgactagcggaggctagaaggagagagcgactcggaccgatg

SEQ ID NO: 10058 - DNA, 203 bp, Homo sapiens
  source 1..203: mol_type = other DNA
ggcgcgccagtcctctatagcccgagaaactcgtcttgtcagggaagaaagtagatgaattagaaaaagttaggttacggcccaacggaaagaaaaaatacatgttaaaacatgttgtgtgggcagcgaacgaattggacagatttggattagcagaaagcctgttggaggccaaagaaggatgtcaacgactcggaccgatg

SEQ ID NO: 10059 - DNA, 203 bp, Homo sapiens
  source 1..203: mol_type = other DNA
ggcgcgccagtcctagtttggccgtctgttgtatgactctggtaactagagatccctcagactactctagacagtgtaaaaatctctagcagtggcgcccgaacagggactcgaaagcgaaagtgttccagagaagctctctcgacgcgaggactcggcttgctgaggtgcacacagcaaggggcgagcgactcggaccgatg

SEQ ID NO: 10060 - DNA, 203 bp, Homo sapiens
  source 1..203: mol_type = other DNA
ggcgcgccagtcctcctggcgtcgtctgttgtgtgactctggtaactagagatccctcagaccaatttggtagtgtggaaaatctctagcagtggcgcccgaacagggacgcgaaagcgaaagtagaaccagaggagatctctcgacgcaggactcggcttgctgaagtgcactcggcaagaggcgagcgactcggaccgatg

SEQ ID NO: 10061 - DNA, 203 bp, Homo sapiens
  source 1..203: mol_type = other DNA
ggcgcgccagtcctaccagttacgtctgttgtgtgactctggtaactagagatccctcagacctctgtagtcagtgtgaaaatctctagcagtggcgcccgaacagggacttgaaagcgaaagtagaaccagaggagctctctcgacgcaggactcggcttgctgaagcgcgcacagcaagaggcgagcgactcggaccgatg

SEQ ID NO: 10062 - DNA, 203 bp, Homo sapiens
  source 1..203: mol_type = other DNA
ggcgcgccagtcctcgctgacacgtctgttgtgtgactctggtaactagagatccctcagacctttttggcagtatggaaaatctctagcagtggcgcccgaacagggacttgaaagcgaaagtaagaccagagaagaactctcgacgcaggactcggcttgctgaagtgcactcggcaagaggcgagcgactcggaccgatg

SEQ ID NO: 10063 - DNA, 203 bp, Homo sapiens
  source 1..203: mol_type = other DNA
ggcgcgccagtcctgcccgcttcgtctgttgtgtgactctggtaactagagatccctcagacctttttggtagtgtggaaaatctctagcagtggcgcccgaacagggacttgaaaacgaaagtaagaccagagaagaactctcgacgcaggactcggcttgctgaagtgcactcggcaagaggcgagcgactcggaccgatg

SEQ ID NO: 10064 - DNA, 203 bp, Homo sapiens
  source 1..203: mol_type = other DNA
ggcgcgccagtcctcttcagatcgtctgttgtgtgctctggtaactatagatccctcagacaattctagtcagtgtggaaaatctatagcagtggcgcccgaacagggaccagaaagcgaaagtagaaccagaggagctctctcgacgcaggactcggcttgctgaagcgcgcacggcaagaggcgagcgactcggaccgatg

SEQ ID NO: 10065 - DNA, 203 bp, Homo sapiens
  source 1..203: mol_type = other DNA
ggcgcgccagtcctcggcctcccgtctgttgtgtggctctggtaactagagatccctcagaccattttggtagtgtggaaaatctttagcagtggcgcccgaacagggacttgaaagcgaaagtaagaccagaggagatctctcgacgcaagactcggcttgctgaagcgcactcggcaagaggcgagcgactcggaccgatg

SEQ ID NO: 10066 - DNA, 203 bp, Homo sapiens
  source 1..203: mol_type = other DNA
ggcgcgccagtcctgcgtaattcgtctgttgtgtggctctggtaactagagatccctcagacctttttggtagtgtggaaaatctctagcagtggcgcccgaacagggacttgaaagcgaaagtaagaccagaggagatctctcgacgcaagactcggcttgctgaagtgcactcggcaagaggcgagcgactcggaccgatg

SEQ ID NO: 10067 - DNA, 203 bp, Homo sapiens
  source 1..203: mol_type = other DNA
ggcgcgccagtcctcttccctgctagagatccctcagaccactctagttgttgtaaaaatctctagcagtggcgcccgaacagggacttgaaagcgaaagttaacagggactcgaaagcgaaagttccagagaagttctctcgacgcaggactcggcttgctgaaaggtgcacacggcaagaggcgagcgactcggaccgatg

SEQ ID NO: 10068 - DNA, 203 bp, Homo sapiens
  source 1..203: mol_type = other DNA
ggcgcgccagtcctctttaagcctagagatccctcaggaccactctagacagtgtaaaaatctctagcagtggcgcccgaacagggacttgaaagcgaaagttaatatgggaatggaaagggaaagttcccgagaagttctctcgagccaggactcggcttgctgaagtgcaccagcaagaggcgagacgactcggaccgatg

SEQ ID NO: 10069 - DNA, 203 bp, Homo sapiens
  source 1..203: mol_type = other DNA
ggcgcgccagtcctccgggcccctagcagtggcgcccgaacagggacgcgaaagcgaaagtagaaccagagacgatctctcgacgcaggactcggcttgctgaagtgcgcacggcaagaggcaaggggcggcgactggtgagtacgccaaaaataaagttttgactagcggaggctagaaggaaagagcgactcggaccgatg

SEQ ID NO: 10070 - DNA, 203 bp, Homo sapiens
  source 1..203: mol_type = other DNA
ggcgcgccagtcctgacggcggctatctattcagacactctggtaactagagatccctcagattaaattatagtcaaggaaaatctctagcagtggcgcccgaacagggacctgaagtgaaagtaaccggaggctgaatctcccgacgcacggactcggcttgctgagtgcacacagcaagaggcgagcgactcggaccgatg

SEQ ID NO: 10071 - DNA, 203 bp, Homo sapiens
  source 1..203: mol_type = other DNA
ggcgcgccagtccttatcatagctccggtacttagactctggtaactagagatccctcagaccttttagtcagtgtggaaaatctctagcagtggcgcccgaacagggacttgaaagcgaaagtggtaccggagaagatctctcgacgcaggactcggcttgctgaagcgcgcacggcaagaggcgagcgactcggaccgatg

SEQ ID NO: 10072 - DNA, 203 bp, Homo sapiens
  source 1..203: mol_type = other DNA
ggcgcgccagtcctgacgtgccctctagcagtggcgcccgaacagggacttgaaagcgaaaggaaaaccagaggagctctctcgacgcaggactcggcttgctgaagcgcgcacagcaagaggcgaggggcggcgactggtgagtacgcctaaaaattttttgactagcggaggctagaaggagagagcgactcggaccgatg

SEQ ID NO: 10073 - DNA, 203 bp, Homo sapiens
  source 1..203: mol_type = other DNA
ggcgcgccagtccttgtcccagctctggtaactagagatccctcagaccactctagactgtgtaaaaatctctagcagtggcgcccgaacaggacttgacggtaatagggactcgaaagcgaaagttccagagaagatctctcgacgcaaggactcggcttgctgaggtgcgcacagcaagaggcgagcgactcggaccgatg

SEQ ID NO: 10074 - DNA, 203 bp, Homo sapiens
  source 1..203: mol_type = other DNA
ggcgcgccagtcctgcccttagctggtaactagagatccctcagaccactttcagtttgtgtaaaaatctctagcagtggcgcccgaacagggaccggaagttaatagggactcgaaagcgaaagttccagagaagctctctcgacgcagggactcggcttgctgaggtgcacacagcaagaggcgagcgactcggaccgatg

SEQ ID NO: 10075 - DNA, 203 bp, Homo sapiens
  source 1..203: mol_type = other DNA
ggcgcgccagtcctgtctgcccctggtatctagagatccctcagaccactctagacttagtgaaaaatctctagcagtggcgcccgaacagggaccggaagttaatagggactcgaaagcgaaagttccagagaagctctctcgacgcagggactcggcttgctgaggtgcacacagcaagaggcgagcgactcggaccgatg

SEQ ID NO: 10076 - DNA, 203 bp, Homo sapiens
  source 1..203: mol_type = other DNA
ggcgcgccagtcctaactcctactggtatctagagatccctcagaccactgtagactgtgtaaaaaatctctagcagtggcgcccgaacagggacctgaaattaatagggactcgaaagcgaaagttccagagaagttctctcgacgcaaggactcggcttgctgaggtgcacgcagcaagaggcgagcgactcggaccgatg

SEQ ID NO: 10077 - DNA, 203 bp, Homo sapiens
  source 1..203: mol_type = other DNA
ggcgcgccagtccttattaagtctgttcaaccctggtgtctagagatccctcagatcacttagactgaagcagaaaaatctctagcagtggcgcccgaacagggacgcgaaagcgaaagtgaagccagggaagaaaacctccgacgcaacgggctcggcttagcggagtgcacctgctaagaggcgagcgactcggaccgatg

SEQ ID NO: 10078 - DNA, 203 bp, Homo sapiens
  source 1..203: mol_type = other DNA
ggcgcgccagtcctgccgccacctgttgtgtgactctggtaactagagatccctcagaccaccttagcagagtgaaaaatctctagcagtggcgcccgaacagggactcgaaagcgaaagtaaaagttccagagaagttctctcgacgcaggactcggcttgctgaggtgcacacagcaagaggcgagcgactcggaccgatg

SEQ ID NO: 10079 - DNA, 203 bp, Homo sapiens
  source 1..203: mol_type = other DNA
ggcgcgccagtcctctagttagctgttgtttgactctggtaactagagatccctcagactctcgtagtcagtgtgaaaaatctctagcagtggcgcccgaacagggaccttaaaagcgaaagagaaaccagaggagctctctcgacgcaggactcggcttgctgaaagcgcgcacggcaagaggcgagcgactcggaccgatg

SEQ ID NO: 10080 - DNA, 203 bp, Homo sapiens
  source 1..203: mol_type = other DNA
ggcgcgccagtcctattggaccctttgatgtgtgactctggtaactagagatccctcagaccaattgtggtagtgtggaaaatctctagcagcggcgcccgaacagggacttgaaagcgaaagtaagaccagaggagatctctcgacgcaggactcggcttgctgaagtgcactcggcaagaggcgagcgactcggaccgatg

SEQ ID NO: 10081 - DNA, 203 bp, Homo sapiens
  source 1..203: mol_type = other DNA
ggcgcgccagtcctccaacggcgaaaaactccgtcttgagagggaaaaaggcagatgaattagaaaaaattaggttacggcccggcgggaagaaaaaatacagattaaaacatattgtgtgggcagcgaatgaattggacagattcggattaacagagagcctgttggagtcaaaagaaggttgccaacgactcggaccgatg

SEQ ID NO: 10082 - DNA, 203 bp, Homo sapiens
  source 1..203: mol_type = other DNA
ggcgcgccagtcctaacattgggaaaatctctaccattggcgcccaaccagggactcgaaagcgaaagttacagagaagttctctcgacgcaggactcggcttgctgaggtgcacacagcaagaggcgagagcggcgactggtgagtacgcctaaaatttttgactagcagaggctagaaggagagagcgactcggaccgatg

SEQ ID NO: 10083 - DNA, 203 bp, Homo sapiens
  source 1..203: mol_type = other DNA
ggcgcgccagtccttgttcgcagaaaatctctagcagtggcgcccgaacagggacgcgaaagcgaaagtagaaccagaggagatctctcgacgcaggactcggcttgctgaagtgcactcggcaggaggcgagagcggcggctggtgagtacgccaatttttgactagtggaggctagaaggagagagcgactcggaccgatg

SEQ ID NO: 10084 - DNA, 203 bp, Homo sapiens
  source 1..203: mol_type = other DNA
ggcgcgccagtccttagtaatggaaaatctctagcagtggcgcccgaacagggacttgaaagcgaaagtagaaccagagaagatctctcgacgcaggactcggcttgctgaagtgcacacggcaagaggcgagagcggcgactggtgagtacgccaaattttgactagcagaggctagaaggagagagcgactcggaccgatg

SEQ ID NO: 10085 - DNA, 203 bp, Homo sapiens
  source 1..203: mol_type = other DNA
ggcgcgccagtccttcattcctgaacagggaccggaagagaaagtgaaaccagggaagaaaacctccgacgcgacgggctcggcttagcggagtgcacccgctaagaggcgagaggactcacagaggtgagtagttttgctggcggtggccagacctaggggaagggcgaagtctctaggggaggaggcgactcggaccgatg

SEQ ID NO: 10086 - DNA, 203 bp, Homo sapiens
  source 1..203: mol_type = other DNA
ggcgcgccagtcctgtaaaccggaacagggacctgaaaagcgaaagtaaaagggactcgaaagcggcggttccagagaagttctctcgacgcaagactcggcttgctgagtgcacacggcaagaggcgagaagcggcgactggtgagtacgccaaattttttgactagcggaggctagaaggagagagcgactcggaccgatg

SEQ ID NO: 10087 - DNA, 203 bp, Homo sapiens
  source 1..203: mol_type = other DNA
ggcgcgccagtccttctcagtcgaacagggacttgaaaagcgaaagtaaaagggactcgaaagcggaagttccagagaagttctctcgacgcaggactcggcttgctgagtgcacacagcaagaggcgaggagcggcgactggtgagtacgccaaaatttttgactagcggaggctagaaggagagagcgactcggaccgatg

SEQ ID NO: 10088 - DNA, 203 bp, Homo sapiens
  source 1..203: mol_type = other DNA
ggcgcgccagtcctcgaagatggaacagggacttgaaaagcgaaagtaatagggactcgaaagcggaagttccagagaagttctctcgacgcaggactcggcttgctgaggtgcacaaagcaagaggcgagagcggcgactggtgagtacgccaaaatttttgactagcggaggctagaaggagagagcgactcggaccgatg

SEQ ID NO: 10089 - DNA, 203 bp, Homo sapiens
  source 1..203: mol_type = other DNA
ggcgcgccagtccttcctcttagaacagggacttgaaagcgaaagtaatagggactcgaaaacgaaagttccagagaagaagctctcttgacgcaggactcggcttgctgaggtgcacacagcaagaggcgagagcggcgactggtgagtacgccattttttgactagcggaggctagaaggagagagcgactcggaccgatg

SEQ ID NO: 10090 - DNA, 203 bp, Homo sapiens
  source 1..203: mol_type = other DNA
ggcgcgccagtccttgatggcggaacagggacttgaaagcgaaagttaaaagggactcgaaagcgaaagttccagagaagttctctcgacgcaggactcggcttgctgaggtgcacacagcaagaggcgagagcggcgactggtgagtacgccaaactttttgactagcggaggctagaaggagagagcgactcggaccgatg

SEQ ID NO: 10091 - DNA, 203 bp, Homo sapiens
  source 1..203: mol_type = other DNA
ggcgcgccagtccttttgatgagaacagggacttgaaagtgaaagttaaaagggactcgaaagcggaagttccagagaagttctctcgacgcaggactcggcttgctgaggtgcacacagcaagaggcgagagcggcgactggtgagtacgccaaactttttgactagcggaggctagaaggagagagcgactcggaccgatg

SEQ ID NO: 10092 - DNA, 203 bp, Homo sapiens
  source 1..203: mol_type = other DNA
ggcgcgccagtcctcacgtcaggaacagggacttgaaagtgaaagttaatagggactcgaaagcgaaagttccagagaagttctctcgacgcaggactcggcttgctgaggtgcacacagcaagaggcgagagcggcgactggtgagtacgccaaactttttgactagcggaggctagaaggagagagcgactcggaccgatg

SEQ ID NO: 10093 - DNA, 203 bp, Homo sapiens
  source 1..203: mol_type = other DNA
ggcgcgccagtcctgctaagtagaagaactccgtcctgagagggaaaaaagctgatgaattagaaagaattaggttacggcccggcggaaagaaaaaatacagagtaaaacatgttgtgtgggcagcgaacgaattggacagattcggattaacagaaagcctgttggaatcaaaagagggttgccaacgactcggaccgatg

SEQ ID NO: 10094 - DNA, 203 bp, Homo sapiens
  source 1..203: mol_type = other DNA
ggcgcgccagtcctagtcatctgactctggtaatactctggtaactagagatccctcagacccttgttggttgcgtggaaaatctctagcagtggcgcccgaacagggacttgaaagcgaaagtaaaaccagaggagatctctcgacgcaggactcggcttgctgaagtgcactcggcaagaggcgagcgactcggaccgatg

SEQ ID NO: 10095 - DNA, 203 bp, Homo sapiens
  source 1..203: mol_type = other DNA
ggcgcgccagtcctaaatcgacgagaaactccgtcttgtcagggaagaaagcagatgaattagaaaaaattaggttacggcccaacggaaagaaaaagtacatgttgaagcatgtagtatgggcagcaaacgaattggacagatttggattagcagaaagcctgttggagaccaaagaaggttgtcaacgactcggaccgatg

SEQ ID NO: 10096 - DNA, 203 bp, Homo sapiens
  source 1..203: mol_type = other DNA
ggcgcgccagtccttccgtaatgagaaactccgtcttgtcagggaagaaagcagatgaattagaaaaaattaggttacggcccaacggaaagaaaaagtatatgttgaagcatgtagtatgggcagcaaatgaattggatagatttggattagcagaaagcctgttggataacaaagaaggttgtcaacgactcggaccgatg

SEQ ID NO: 10097 - DNA, 203 bp, Homo sapiens
  source 1..203: mol_type = other DNA
ggcgcgccagtcctgaggcaccgagaaactccgtcttgtcagggaagaaagcagatgaattagaaaaaattaggttacggcccggcggaaagaaaaggtacaagctgaagcatatagtatgggcagcaaatgaattggacagatttggattagcagaaagcctgttggagaacaaagaaggttgtcaacgactcggaccgatg

SEQ ID NO: 10098 - DNA, 203 bp, Homo sapiens
  source 1..203: mol_type = other DNA
ggcgcgccagtccttcgagtctgagaaactccgtcttgtcagggaaggaagcagatgaattagaaaaagttaggttacggcccaacggaaagaaaaagtatatgttgaagcatgtagtatgggcagcaaatgaattggacagatttggattagcagaaagcctgttggataacaaagaaggttgtcaacgactcggaccgatg

SEQ ID NO: 10099 - DNA, 203 bp, Homo sapiens
  source 1..203: mol_type = other DNA
ggcgcgccagtcctattagcgggagaggctccgtcttgtcagggaagaaaacagatgaattagaaaaagttaggttacggcccggcggaaagaaaaaatattgtctaaagcatatagtatgggcagtgaacgaattggacagatatggattagcagagagcctgttggagtcaaaagaaggatgtcaccgactcggaccgatg

SEQ ID NO: 10100 - DNA, 203 bp, Homo sapiens
  source 1..203: mol_type = other DNA
ggcgcgccagtcctagatatcagagaggctccgtcttgtcagggaagaagacagatgaattagaaaaggttaggttacggcccggcggaaagaaaagatacatgctaaaacatatagtatgggcagtgaatgaattagagagatttggattggcagagagccggttgggatcaaaagaaggatgccggcgactcggaccgatg

SEQ ID NO: 10101 - DNA, 203 bp, Homo sapiens
  source 1..203: mol_type = other DNA
ggcgcgccagtcctctccataggcagtggcgcccgaacagggaccggaaatatagggactcgaaagcgaaagttccagagaagatctctcgacgcaggactcggcttgctgaggtgcacgcagcaagaggcgagagcggcgactggtgagtacgccaattttgactagcggaggctagaaggagagagcgactcggaccgatg

SEQ ID NO: 10102 - DNA, 203 bp, Homo sapiens
  source 1..203: mol_type = other DNA
ggcgcgccagtcctttggttgcgcccgaacagggacgttcggactgagagacagggagcgtggcccctggacgcaggactcggcttgtgacagcgcaatcacaagaggcgaggcggactccggtggtgagtactaatttgttgtcggtgggcaaccctagaggaaggacgaagtctctaggtcaggggcgactcggaccgatg

SEQ ID NO: 10103 - DNA, 203 bp, Homo sapiens
  source 1..203: mol_type = other DNA
ggcgcgccagtcctcgaacttagcccgtctgttatttgactctggtaactagagatccctcagaccactatagactgtgtaaaaatctctagcagtggcgcccgaacagggactcgaaagcgaaagttccagagaagttctctcgacgcaggactcggcttgctgaggtgcacacagcaagaggcgagcgactcggaccgatg

SEQ ID NO: 10104 - DNA, 203 bp, Homo sapiens
  source 1..203: mol_type = other DNA
ggcgcgccagtcctgatacttggcccgtctgttgtgtgactctggtaactagagatccctcagaccactctagaaggtgtaaaaatctctagcagtggcgcccgaacagggactcgaaagcgaaagttccagaggagttctctcgacgcaggactcggcttgctgaggtgcacacagcaagaggcgagcgactcggaccgatg

SEQ ID NO: 10105 - DNA, 203 bp, Homo sapiens
  source 1..203: mol_type = other DNA
ggcgcgccagtccttttctgcagcccgtctgttgtgtgactctggtaactagagatccctcagaccactctaggcggtgtaaaaatctctagcagtggcgcccgaacagggacttgaaagcgaaagttccagagaagttctctcgacgcagggctcggcttgctgaggtgcacacagcaagaggcgagcgactcggaccgatg

SEQ ID NO: 10106 - DNA, 203 bp, Homo sapiens
  source 1..203: mol_type = other DNA
ggcgcgccagtcctattagaaaggaaaatctctagcagtggcgcccgaacagggacttgaaagcgaaagtagaaccagagaagatctctcgacgcaggactcggcttgctgaagtgcacacggcaagaggcgagagcggcgactggtgagtacgccaatttttgactagcggaggctagaaggagaggcgactcggaccgatg

SEQ ID NO: 10107 - DNA, 203 bp, Homo sapiens
  source 1..203: mol_type = other DNA
ggcgcgccagtcctaaactaggggacagattcggattaacagagagcctgttggagtcaaaagaaggttgccaaaaaattatttcagttttagaaccattagtaccaacagggtcagaaaatttaaaaagcctttataatactacctgcgtcatttggtgcttgcacgcagaagagaaagtgaaagatcgactcggaccgatg

SEQ ID NO: 10108 - DNA, 203 bp, Homo sapiens
  source 1..203: mol_type = other DNA
ggcgcgccagtcctgacccaacggacagatttggattagcagaaagcctgttggagaccaaagacggttgtcaaagaattctttcagttttagctccattagttccgacaggttcagaaaatttaaagagcctttataatactgtctgcgtcatttggtgcttgcacgcagaagagaaagtgagacatcgactcggaccgatg

SEQ ID NO: 10109 - DNA, 203 bp, Homo sapiens
  source 1..203: mol_type = other DNA
ggcgcgccagtcctatctcaatggacagatttggattggcagaaagcctgttggagtcaaaagaagggtgtcaaaaaattataacggtcttagaaccattagtgccaacaggttcagaaaatttaaagagtctttttaatactgtctgcgtcatttggtgtatccacgcagaagagaaagtgaaacatcgactcggaccgatg

SEQ ID NO: 10110 - DNA, 203 bp, Homo sapiens
  source 1..203: mol_type = other DNA
ggcgcgccagtcctgacgataaggatagatttggattggcagaaagcctgttggaaagtaaagaaggctgtcaaaaaatactttcggttttagctccattagtgccaacaggttcagaaaatttaaagagcctttataatactgtctgcgtcatttggtgcttgcacgcagaagagaaagtgaaacatcgactcggaccgatg

SEQ ID NO: 10111 - DNA, 203 bp, Homo sapiens
  source 1..203: mol_type = other DNA
ggcgcgccagtcctcgttacccggcgcccgaacagggacttggagttaatagggactcgaaagcgaaagtgccagagaagatctctcgacgcagggactcggcttgctgaagtgcacacagcaagaggcgagagcggcgactggtgagtacgccaaaattttgactagcggaggctagaaggagagagcgactcggaccgatg

SEQ ID NO: 10112 - DNA, 203 bp, Homo sapiens
  source 1..203: mol_type = other DNA
ggcgcgccagtccttgtattccgggacttgaaagtgaaagtaaaaccggaggctgaatctctcgacgcacggactcggcttgctgagtgcacgcagcaagaggcgaggcggcgactcaagtggtgagtacgcaattttgctagcggtggctagacctagaggaagggcgaagtctctagggggagaagcgactcggaccgatg

SEQ ID NO: 10113 - DNA, 203 bp, Homo sapiens
  source 1..203: mol_type = other DNA
ggcgcgccagtcctgtcgggagggtaactagagatccctcagaccactctaaatagtgtaaaatctctagcagtggcgcccgaacagggacttgaaagcgaaagtaacagggactcgaaagcgaaagttccagagaagttctctcgacgcaggactcggcttgctgggtgcacacagcaagaggcgagcgactcggaccgatg

SEQ ID NO: 10114 - DNA, 203 bp, Homo sapiens
  source 1..203: mol_type = other DNA
ggcgcgccagtcctcgaaaggagtaaaaatctctagcagtggcgcccgaacagggactcgaaagcgaaagtgttccagagaagttctctcgacgcaggactcggcttgctgaggtgcacacagcaagaggcgagagcggcgactggtgagtacgccttttttgactagcggaggctagaaggagagagcgactcggaccgatg

SEQ ID NO: 10115 - DNA, 203 bp, Homo sapiens
  source 1..203: mol_type = other DNA
ggcgcgccagtcctagaggtccgtaactagagatccctcagaccactctaggtagtgtaaaaatctctagcagtggcgcccgaacagggacttgaaagcgaaagtaaaagggactcgaaagcggaagttccagagaagttctcttgacgcaggactcggcttgctgagtgcacacagcaagaggcgagcgactcggaccgatg

SEQ ID NO: 10116 - DNA, 203 bp, Homo sapiens
  source 1..203: mol_type = other DNA
ggcgcgccagtcctggcgcattgtaactagagatccctcagaccattttggtagtgtggaaaatctctagcagtggcgcccgaacagggacttgaaagcgaaagtaatagggactcgaaagcgaaagttccagagaagttctctcgacgcaggactcggcttgctgaagtgcactcggcagaggcgagcgactcggaccgatg

SEQ ID NO: 10117 - DNA, 203 bp, Homo sapiens
  source 1..203: mol_type = other DNA
ggcgcgccagtcctcgttgtgtgtctggtatttgactctggtaactagagatccctcagacccctttagtcagtgtggaaaatctctagcagtggcgcccgaacagggacccgaaagcgaaagtagaaccagaggagatctctcgacgcaggactcggcttgctgaagcgcgcacagcaagaggcgagcgactcggaccgatg

SEQ ID NO: 10118 - DNA, 203 bp, Homo sapiens
  source 1..203: mol_type = other DNA
ggcgcgccagtcctgaattaatgtctgttgtgtgactctggtaactagagacccctcagacccttttagccagtgtggaaaatctctagcagtggcgcccgaacagggactagaaagcgaaagtagaaccagaggagctctctcgacgcaggactcggcttgctgaagcgcgcacggcaagaggcgagcgactcggaccgatg

SEQ ID NO: 10119 - DNA, 203 bp, Homo sapiens
  source 1..203: mol_type = other DNA
ggcgcgccagtcctccgtccgcgtctgttgtgtgactctggtaactagagatccctcagaacattttagtccgggtggaaaatctctagcagtggcgcccgaacagggacgcgaaagcgaaagtagaaccagagaagatctctcgacgcaggactcggcttgctgaagtgcacacggcaagaggcgagcgactcggaccgatg

SEQ ID NO: 10120 - DNA, 203 bp, Homo sapiens
  source 1..203: mol_type = other DNA
ggcgcgccagtcctcgacggcagtctgttgtgtgactctggtaactagagatccctcagaacctattagtcagtgtggaaaatctctagcagtggcgcccgaacagggacctgaaagcgaaagtgagaccagaggagctctctcgacgcaggactcggcttgctgaagcgcgcacagcaagaggcgagcgactcggaccgatg

SEQ ID NO: 10121 - DNA, 203 bp, Homo sapiens
  source 1..203: mol_type = other DNA
ggcgcgccagtcctgggttgcggtctgttgtgtgactctggtaactagagatccctcagacacattttgtccgtgtggaaaatctctagcagtggcgcccgaacagggacttgaaagcgaaagtaagaccagaggagatctctcgacgcaggactcggcttgctgaagtgcactcggcaagaggcgagcgactcggaccgatg

SEQ ID NO: 10122 - DNA, 203 bp, Homo sapiens
  source 1..203: mol_type = other DNA
ggcgcgccagtcctgctagtatgtctgttgtgtgactctggtaactagagatccctcagacacttgtagtcagtgtggaaaatctctagcagtggcgcccgaacagggacttgaaagcgacagtagaaccagaggagctctctcgacacaggactcggcttgctgaagcgcgcacggcaagaggcgagcgactcggaccgatg

SEQ ID NO: 10123 - DNA, 203 bp, Homo sapiens
  source 1..203: mol_type = other DNA
ggcgcgccagtcctaagcctcggtctgttgtgtgactctggtaactagagatccctcagacatttgtagtcagtgtggaaaatctctagcagtggcgcccgaacagggacttgaaaacgaaagtagaaccagaggagatctctcgacgcaggactcggcttgctgaagcgcgcacagcaagaggcgagcgactcggaccgatg

SEQ ID NO: 10124 - DNA, 203 bp, Homo sapiens
  source 1..203: mol_type = other DNA
ggcgcgccagtcctagggagtcgtctgttgtgtgactctggtaactagagatccctcagaccaactttggtagtgtggaaaatctctagcagtggcgcccgaacagggacttgaaagcgaaagtaagaccagagaagatctctcgacgcaggactcggcttgctgaagtgcactcggcaagaggcgagcgactcggaccgatg

SEQ ID NO: 10125 - DNA, 203 bp, Homo sapiens
  source 1..203: mol_type = other DNA
ggcgcgccagtcctgttggcatgtctgttgtgtgactctggtaactagagatccctcagaccaatttagtcagggtggaaaatctctagcagtggcgcccgaacagggaccggaaagcgaaagtaaaaccagaggagatctctcgacgcaggactcggcttgctgaagtgcgcacagcaagaggcgagcgactcggaccgatg

SEQ ID NO: 10126 - DNA, 203 bp, Homo sapiens
  source 1..203: mol_type = other DNA
ggcgcgccagtcctacacgaccgtctgttgtgtgactctggtaactagagatccctcagaccaatttagtccgtgtggaaaatctctagcagtggcgcccgaacagggacttgaaagcgaaagtagaaccagaggagctctctcgacgcaggactcggcttgctgaagtgcgcacggcaagaggcgagcgactcggaccgatg

SEQ ID NO: 10127 - DNA, 203 bp, Homo sapiens
  source 1..203: mol_type = other DNA
ggcgcgccagtcctcttaccgtgtctgttgtgtgactctggtaactagagatccctcagaccatcttagtcagtgtggaaaatctctagcagtggcgcccgaacagggacctgaaagcgaaagtagaaccagagcagatctctcgacgcaggactcggcttgctgaagtgcacacggcaagaggcgagcgactcggaccgatg

SEQ ID NO: 10128 - DNA, 203 bp, Homo sapiens
  source 1..203: mol_type = other DNA
ggcgcgccagtccttgagataagtctgttgtgtgactctggtaactagagatccctcagaccattcgtggtagtgtggaaaatctctagcagtggcgcccgaacagggacttgaaagtgaaagtaagaccagaggaaatctctcgacgcaggactcggcttgctgaagtgcactcggcaagaggcgagcgactcggaccgatg

SEQ ID NO: 10129 - DNA, 203 bp, Homo sapiens
  source 1..203: mol_type = other DNA
ggcgcgccagtcctaccatcaagtctgttgtgtgactctggtaactagagatccctcagaccatttagtcagtgtggaaaatctctagcagtggcgcccgaacagggacttgaaagcgaaagcagaaccagaggagatctctcgacgcaggactcggcttgctgaaagtgcacgcggcaagaggcgagcgactcggaccgatg

SEQ ID NO: 10130 - DNA, 203 bp, Homo sapiens
  source 1..203: mol_type = other DNA
ggcgcgccagtcctggagactagtctgttgtgtgactctggtaactagagatccctcagaccattttagtcagtgtggaaaatctctagcagtggcgcccgaacagggaccagaaagcgaaagtagaaccagaggagatctctcgacgcaggactcggcttgctgaagcgcgcacagcaagaggcgagcgactcggaccgatg

SEQ ID NO: 10131 - DNA, 203 bp, Homo sapiens
  source 1..203: mol_type = other DNA
ggcgcgccagtcctagcccagagtctgttgtgtgactctggtaactagagatccctcagaccattttagtcagtgtggaaaatctctagcagtggcgcccgaacagggacgcgaaagcgaaagtagaaccagaggagatctctcgacgcaggactcggcttgctgaggtgcacacagcaagaggcgagcgactcggaccgatg

SEQ ID NO: 10132 - DNA, 203 bp, Homo sapiens
  source 1..203: mol_type = other DNA
ggcgcgccagtcctgaaaccctgtctgttgtgtgactctggtaactagagatccctcagacccctttagtcagtgtggaaaatctctagcagtggcgcccgaacagggacttgaaagtgaaagtgagaccagaggagctctctcgacgcaggactcggcttgctgaagcgcgcacagcaagaggcgagcgactcggaccgatg

SEQ ID NO: 10133 - DNA, 203 bp, Homo sapiens
  source 1..203: mol_type = other DNA
ggcgcgccagtcctaagtgctcgtctgttgtgtgactctggtaactagagatccctcagacccttaaagtcaatgtggaaaatctctagcagtggcgcccgaacagggacttgaaagtgaaagtaaaaccagagaagctctcttgacgcaggactcggcttgctgaagcgcgcacggcaagaggcgagcgactcggaccgatg

SEQ ID NO: 10134 - DNA, 203 bp, Homo sapiens
  source 1..203: mol_type = other DNA
ggcgcgccagtcctacggattagtctgttgtgtgactctggtaactagagatccctcagacccttgtagtcagtgtggaaaatctctagcagtggcgcccgaacagggacctgaaagcgaaagagaaaccagaggagctctctcgacgcaggactcggcttgctgaagcgcgcacagcaagaggcgagcgactcggaccgatg

SEQ ID NO: 10135 - DNA, 203 bp, Homo sapiens
  source 1..203: mol_type = other DNA
ggcgcgccagtcctcgatgcgcgtctgttgtgtgactctggtaactagagatccctcagacccttttagtcagtgtggaaaatctctagcagtggcgcccgaacagggacccgaaagcgaaagtagaaccaggggagctctctcgacgcaggactcggcttgctgaaacgcgcgcggcaagaggcgagcgactcggaccgatg

SEQ ID NO: 10136 - DNA, 203 bp, Homo sapiens
  source 1..203: mol_type = other DNA
ggcgcgccagtcctccttatctgtctgttgtgtgactctggtaactagagatccctcagacccttttagtcagtgtggaaaatctctagcagtggcgcccgaacagggacttgaaagcgaaagagaaaccggagaagatctctcgacgcaggactcggcttgctgaagcgcgcacggcaagaggcgagcgactcggaccgatg

SEQ ID NO: 10137 - DNA, 203 bp, Homo sapiens
  source 1..203: mol_type = other DNA
ggcgcgccagtcctatccgcgtgtctgttgtgtgactctggtaactagagatccctcagacccttttagtcagtgtggaaaatctctagcagtggcgcccgaacagggacttgaaagcgaaaggaaaaccagaggagctctctcgacgcaggactcggcttgctgaagcgcgcacggcaagaggcgagcgactcggaccgatg

SEQ ID NO: 10138 - DNA, 203 bp, Homo sapiens
  source 1..203: mol_type = other DNA
ggcgcgccagtcctcacgctgggtctgttgtgtgactctggtaactagagatccctcagacccttttagtcagtgtggaaaatctctagcagtggcgcccgaacagggacttgaaagcgaaagtgagaccagaggagctctctcgacgcagggctcggcttgctgaagcgtgcgcagcaagaggcgagcgactcggaccgatg

SEQ ID NO: 10139 - DNA, 203 bp, Homo sapiens
  source 1..203: mol_type = other DNA
ggcgcgccagtcctcgtcagtagtctgttgtgtgactctggtaactagagatccctcagacccttttagtcagtgtggaaaatctctagcagtggcgcccgaacagggacttgaaagtgaaagtaagaccagaggagctctctcgacgcaggactcggcttgctgaagcgcgcacagcaagaggcgagcgactcggaccgatg

SEQ ID NO: 10140 - DNA, 203 bp, Homo sapiens
  source 1..203: mol_type = other DNA
ggcgcgccagtcctcatcccacgtctgttgtgtgactctggtaactagagatccctcagacccttttagtcagtgtggagaatctctagcagtggcgcccgaacagggacttgaaagcgaaagagaaaccagaggagctctctcgacgcaggactcggcttgctgaaacgcgcgcggcaagaggcgagcgactcggaccgatg

SEQ ID NO: 10141 - DNA, 203 bp, Homo sapiens
  source 1..203: mol_type = other DNA
ggcgcgccagtcctgtattcacgtctgttgtgtgactctggtaactagagatccctcagacccttttagtccgtgtggaaaatctctagcagtggcgcccgaacagggacccgaaagcgaaagtagaaccagaggagctctctcgacgcaggactcggcttgctgaagcgcgcgcggcaagaggcgagcgactcggaccgatg

SEQ ID NO: 10142 - DNA, 203 bp, Homo sapiens
  source 1..203: mol_type = other DNA
ggcgcgccagtcctagaccctggtctgttgtgtgactctggtaactagagatccctcagaccctttttggtagtgtggaaaatctctagcagtggcgcccgaacagggacttgaaagcgaaagtaagaccagagcagatctctcgacgcaggactcggcttgctgaagtgcactcggcaagaggcgagcgactcggaccgatg

SEQ ID NO: 10143 - DNA, 203 bp, Homo sapiens
  source 1..203: mol_type = other DNA
ggcgcgccagtcctagtcgagggtctgttgtgtgactctggtaactagagatccctcagacctcggtagtcagtgtagaaaatctctagcagtggcgcccgaacagggacctgaaagcgaaagtagaaccagaggagctctctcgacgcaggactcggcttgctgaagcgtgcacggcaagaggcgagcgactcggaccgatg

SEQ ID NO: 10144 - DNA, 203 bp, Homo sapiens
  source 1..203: mol_type = other DNA
ggcgcgccagtcctgcaattccgtctgttgtgtgactctggtaactagagatccctcagacctctttagtcagtgtggaaaatctctagcagtggcgcccgaacagggacctgaaaagcgaaagtaaaaccagagaagctctctcgacgcaggactcggcttgctgagcgcgcacggcaagaggcgagcgactcggaccgatg

SEQ ID NO: 10145 - DNA, 203 bp, Homo sapiens
  source 1..203: mol_type = other DNA
ggcgcgccagtccttgaccattgtctgttgtgtgactctggtaactagagatccctcagacctctttagtcagtgtggaaaatctctagcagtggcgcccgaacagggacttgaaagcgaaagtaaaaccagagaagatctctcgacgcaggactcggcttgctgaagcgcgcacagcaagaggcgagcgactcggaccgatg

SEQ ID NO: 10146 - DNA, 203 bp, Homo sapiens
  source 1..203: mol_type = other DNA
ggcgcgccagtcctgcttgagggtctgttgtgtgactctggtaactagagatccctcagactcttttagtcagtgtggaaaatctctagcagtggcgcccgaacagggacttgaaagcgaaagggaaaccagaggagctctctcgacgcaggactcggcttgctgaagcgcgcacggcaagaggcgagcgactcggaccgatg

SEQ ID NO: 10147 - DNA, 203 bp, Homo sapiens
  source 1..203: mol_type = other DNA
ggcgcgccagtcctgttcgcgagtctgttgtgtgactctggtagctagagatccctcagaccatcctagttagtgtagaaaatctctagcagtggcgcccgaacagggaccggaaagcgaaagagaaaccagaggagatctctcgacgcaggactcggcttgctgaagcgcgcacagcaagaggcgagcgactcggaccgatg

SEQ ID NO: 10148 - DNA, 203 bp, Homo sapiens
  source 1..203: mol_type = other DNA
ggcgcgccagtcctccaaccaggtctgttgtgtgactctggtagctagagatccctcagatccttttagttagcgtagaaaatctctagcagtggcgcccgaacagggacgcgaaagcgaaagtagaaccagagaagatctctcgacgcaggactcggcttgctgaagcgcgcacggcaagaggcgagcgactcggaccgatg

SEQ ID NO: 10149 - DNA, 203 bp, Homo sapiens
  source 1..203: mol_type = other DNA
ggcgcgccagtcctaggccaaggtctgttgtgtgactctggtagctagagatccctcatacccttttagtcagtgtggaaaatctctagcagtggcgcccgaacagggaccggaaagcgaaagagaaaccagaggagctctctcgacgcaggactcggcttgctgaagcgcgcacggcaagaggcgagcgactcggaccgatg

SEQ ID NO: 10150 - DNA, 203 bp, Homo sapiens
  source 1..203: mol_type = other DNA
ggcgcgccagtcctctgtcagtgtctgttgtgtgactctggtatctagagatccctcagaccctattagtcagtgtggaaaatctctagcagtggcgcccgaacagggacctaaaagcgaaagtaaaaccagaggagatctctcgacgcaggactcggcttgctgaagcgcgcacggcaagaggcgagcgactcggaccgatg

SEQ ID NO: 10151 - DNA, 203 bp, Homo sapiens
  source 1..203: mol_type = other DNA
ggcgcgccagtcctgtctacttgtctgttgtgtggctctggtaactagagatccctcagacccttgttggtagtgcggaaaatctctagcagtggcgcccgaacagggacctgaaagcgaaagtaagaccagaggagatctctcgacgcagggctcggcttgctgaagtgcactcggcaagaggcgagcgactcggaccgatg

SEQ ID NO: 10152 - DNA, 203 bp, Homo sapiens
  source 1..203: mol_type = other DNA
ggcgcgccagtcctaagaggatgtctgttgtgtggctctggtaactagagatccctcagacccttgttggtattgtggcaaatctctagcagtggcgcccgaacagggacttgaaaacgaaagtagaaccagaggagatctcccgacgcaggactcggcttgctgaagtgcactcggcaagaggcgagcgactcggaccgatg

SEQ ID NO: 10153 - DNA, 203 bp, Homo sapiens
  source 1..203: mol_type = other DNA
ggcgcgccagtcctgagtacctgtctgttgtttgactctggtaactagagatccctcagaccattttagtcagtgtggaaaatctctagcagtggcgcccgaacagggacctgaaagcgaaagtgagaccagagaagctctcttgacgcagtactcggcttgctgaagcgcgcacagcaagaggcgagcgactcggaccgatg

SEQ ID NO: 10154 - DNA, 203 bp, Homo sapiens
  source 1..203: mol_type = other DNA
ggcgcgccagtcctggtagattgtctgttgtttgactctggtaactagagatccctcagaccattttagtcagtgtggaaaatctctagcagtggcgcccgaacagggacttgaaagcgaaagtagaaccagagaagatctctcgacgcaggactcggcttgctgaagtgcacacggcaagaggcgagcgactcggaccgatg

SEQ ID NO: 10155 - DNA, 203 bp, Homo sapiens
  source 1..203: mol_type = other DNA
ggcgcgccagtcctcggccgttgtctgttttgtgactctggtaactagagatccctcagacaccttttgtcagtgtggaaaatctctagcagtggcgcccgaacagggacttgaaagcgaaagtagaaccagagaagatctctcgacgcagggctcggcttgctgaagtgcactcggcaagaggcgagcgactcggaccgatg

SEQ ID NO: 10156 - DNA, 203 bp, Homo sapiens
  source 1..203: mol_type = other DNA
ggcgcgccagtcctgttatccagtgactctggtaactctggtaactagagatccctcagaccctttgtggtagtgtggaaaatctctagcagtggcgcccgaacagggacttgaaagcgaaagtgagaccagagaagatctctcgacgcaggactcggcttgctgaagtgcactcggcaagaggcgagcgactcggaccgatg

SEQ ID NO: 10157 - DNA, 203 bp, Homo sapiens
  source 1..203: mol_type = other DNA
ggcgcgccagtcctccaggctagtggcgcccgaacagggaccggaagttaatagggacgcgaaagcgaaagttccagagaagtatctcgacgcacggactcggcttgctgaggtgcacacagcaagaggcgagagcggcgactggtgagtacgccaatttttgactagcggaggctagaaggagagagcgactcggaccgatg

SEQ ID NO: 10158 - DNA, 203 bp, Homo sapiens
  source 1..203: mol_type = other DNA
ggcgcgccagtcctcgtggaaggtggcgcccgaacagggacttgaaagtaatagggactcgaaagcgaaagttccagagaagttctctcgacgcagggactcggcttgctgagtgcacacggcaagaggcgagcgcggcgactggtgagtacgccaaattttgactagcggaggctagaaggagagagcgactcggaccgatg

SEQ ID NO: 10159 - DNA, 203 bp, Homo sapiens
  source 1..203: mol_type = other DNA
ggcgcgccagtcctctcagctggtgtgcccatctcattccgcgccggccctggggtagagatccctcagatctctgaaggctaagcaaaaatctctaccagtggcgcccgaacagggacttgagaagcaggggacgcggaacccttgacgccaggactcggcttgtgctgcgcaacacaagaggcgagcgactcggaccgatg

SEQ ID NO: 10160 - DNA, 203 bp, Homo sapiens
  source 1..203: mol_type = other DNA
ggcgcgccagtcctgagtaaacgtgtgcccatttcataccgcgtctgccctggggtagagatccctcagatttgtagtggctaagtaaaaatctctaccagtggcgcccgaacagggacttgagaagcagggaacgcggcccctggacgcaggactcggcttgtgacagcgcaatcacaagaggcgagcgactcggaccgatg

SEQ ID NO: 10161 - DNA, 203 bp, Homo sapiens
  source 1..203: mol_type = other DNA
ggcgcgccagtcctctgatattgtgtgcccatttcatatcgcgtttgccctggggtagagatccctcagatttgtagtggctaagtaaaaatctctaccagtggcgcccgaacagggacttgaggagcagggaacgcgacccctggacgcaggactcggcttgtgacagcgcaatcacaagaggcgagcgactcggaccgatg

SEQ ID NO: 10162 - DNA, 203 bp, Homo sapiens
  source 1..203: mol_type = other DNA
ggcgcgccagtcctggcggctctaacagggacttgtaagcggaagttaacggggactcgaaagcgaaagttccagagaagttctctcgacgcaggactcggcttgctgaagtgcacacagcaagaggcgagagcggcgactggtgagtacgccaaactttttgactagcggaggctagaaggagagagcgactcggaccgatg

SEQ ID NO: 10163 - DNA, 203 bp, Homo sapiens
  source 1..203: mol_type = other DNA
ggcgcgccagtcctgtagaggctaactagagatccctcagaccattctaggcagagtaaaaatctctagcagtggcgcccgaacagggacctgaaaagcgaaagtaaaagggactcgaaagcggcggttccagagaagttctctcgacgcaagactcggcttgctgagtgcacacggcaagaggcgagcgactcggaccgatg

SEQ ID NO: 10164 - DNA, 203 bp, Homo sapiens
  source 1..203: mol_type = other DNA
ggcgcgccagtcctctaaatgttactagagatccctcagaccactctagactgtgtaaaaatctctagcagtggcgcccgaacagggactcgaaagcgaaagttaatagggactcgaaagcggaagttccagagaagttctctcgacgcaggactcggcttgctgaggtgcacacagcaagaggcgagcgactcggaccgatg

SEQ ID NO: 10165 - DNA, 203 bp, Homo sapiens
  source 1..203: mol_type = other DNA
ggcgcgccagtcctctgctccttagacagaataaaaatctctagcagtggcgcccgaacagggacttgaaaacgaaagttaacagggacttgtaagcggaagttaacggggactcgaaagcgaaagttccagagaagttctctcgacgcaggactcggcttgctgaagtgcacacagcaagaggcgagcgactcggaccgatg

SEQ ID NO: 10166 - DNA, 203 bp, Homo sapiens
  source 1..203: mol_type = other DNA
ggcgcgccagtccttagctctgtagcagtggcgcccgaacagggacccgaaagcgaaagtagaaccagaggagatctctcgacgcaggactcggcttgctgaagcgcgcacggcaagaggcgaggggcggcgactggtgagtacgccaaaagaaaaatttttgactagcggaggctagaaggagagagcgactcggaccgatg

SEQ ID NO: 10167 - DNA, 203 bp, Homo sapiens
  source 1..203: mol_type = other DNA
ggcgcgccagtcctccagtggttagcagtggcgcccgaacagggacctgaaagcgaaagtagaaccagagaagatctctcgacgcaggactcggcttgctgaaagcgcgctcggcaagaggcgaggggcggcggactggtgagtacgccaaaaataaattttgactagcggaggctagaaggagagagcgactcggaccgatg

SEQ ID NO: 10168 - DNA, 203 bp, Homo sapiens
  source 1..203: mol_type = other DNA
ggcgcgccagtccttatccatgtagcagtggcgcccgaacagggacttgaaaacgaaagtagaaccagaggagatctctcgacgcaggactcggcttgctgaagcgcgcacagcaagaggcgaggggaggcgactggtgagtacgccaaaaataaaatttttgactagcggaggctagaaggagagagcgactcggaccgatg

SEQ ID NO: 10169 - DNA, 203 bp, Homo sapiens
  source 1..203: mol_type = other DNA
ggcgcgccagtcctggaacgcctatccttcagtgactctggtaactagagatccctcagaactcttaaaagtaggtgaaaatctctagcagtggcgcccgaacagggacttgaaaacgaaagtacaaccagaggctgaaacttccgacgcgggactcggctcgctgagtgcacacagcgagaggcgagcgactcggaccgatg

SEQ ID NO: 10170 - DNA, 203 bp, Homo sapiens
  source 1..203: mol_type = other DNA
ggcgcgccagtccttacaggcatccattcggtaactctggtacctagagatccctcagaccacttgggctgagtagaaaatctctagcagtggcgcccgaacagggacttgaaaacgaaagtagaaccggaggctgaaatctctcgacgcaggactcggctcgttgggtgcacacagcgagaggcgagcgactcggaccgatg

SEQ ID NO: 10171 - DNA, 203 bp, Homo sapiens
  source 1..203: mol_type = other DNA
ggcgcgccagtccttggttcaatctagcagtggcgcccgaacagggacttgaagaaagtaaaaccagaggagatctctcgacgcaggactcggcttgctgaagaagaagcgcgcgcggcaagaggcgaggggcggcgactggtgagtacgcctaaaaattttgactagcggaggctagaaggagagagcgactcggaccgatg

SEQ ID NO: 10172 - DNA, 203 bp, Homo sapiens
  source 1..203: mol_type = other DNA
ggcgcgccagtcctaccttacgtctctagcagtggcgcccgaacagggacccgaaagcgaaagtaagaccagagaagatctctcgacgcaggactcggcttgctgaagtgcactcggcaagaggcgaggggcggcggctggtgagtacgccaaattttatttgactagcggaggctagaaggagagagcgactcggaccgatg

SEQ ID NO: 10173 - DNA, 203 bp, Homo sapiens
  source 1..203: mol_type = other DNA
ggcgcgccagtcctgcgaggagtctctagcagtggcgcccgaacagggacccgaaagcgaaagtagaaccagagaagatctctcgacgcaggactcggcttgctgaagtgcactcggcaagaggcgagagcggcggctggtgagtacgccaaatttttatttgactagcggaggctagaaggagagagcgactcggaccgatg

SEQ ID NO: 10174 - DNA, 203 bp, Homo sapiens
  source 1..203: mol_type = other DNA
ggcgcgccagtcctgcacaggatctctagcagtggcgcccgaacagggacctgaaagcgaaagtaagaccggaggagatctctcgacgcaggactcggcttgctgaagtgcactcggcaagaggcgaaaggggcggctggtgagtacgccaaatttttatttgactagcggaggctaaaaggagagagcgactcggaccgatg

SEQ ID NO: 10175 - DNA, 203 bp, Homo sapiens
  source 1..203: mol_type = other DNA
ggcgcgccagtcctgggtccgatctctagcagtggcgcccgaacagggacctgaaagcgaaagtgagaccagaggagctctctcgacgcaggactcggcttgctgaagcgcgcacagcaagaggcgagagcggcgactggtgagtacgccaaaaaattttgtgactagcggaggctagaaggagagagcgactcggaccgatg

SEQ ID NO: 10176 - DNA, 203 bp, Homo sapiens
  source 1..203: mol_type = other DNA
ggcgcgccagtcctatcggtattctctagcagtggcgcccgaacagggacttgaaaacgaaagtaagaccagagaagaactctcgacgcaggactcggcttgctgaagtgcactcggcaagaggcgaggggaggcgactggtgagtacgccaaattttatttgactagcggaggctagaaggagagagcgactcggaccgatg

SEQ ID NO: 10177 - DNA, 203 bp, Homo sapiens
  source 1..203: mol_type = other DNA
ggcgcgccagtcctgtaactgctctctagcagtggcgcccgaacagggacttgaaagcgaaagtaaaaccagaggagatctctcgacgcaggactcggcttgctgaagtgcactcggcgagaggcgagagcggcggctggtgagtacgccaaattttattttgactagcggaggctagaaggagagagcgactcggaccgatg

SEQ ID NO: 10178 - DNA, 203 bp, Homo sapiens
  source 1..203: mol_type = other DNA
ggcgcgccagtcctgatcgccgtctctagcagtggcgcccgaacagggacttgaaagtgaaagtagaaccagaggagctctctcgacgcaggactcggcttgctgaagcgcgcacggcaagaggcgaggggcggcgaccggtgagtacgccaaaaaatttttgactagcggaggctagaaggagagagcgactcggaccgatg

SEQ ID NO: 10179 - DNA, 203 bp, Homo sapiens
  source 1..203: mol_type = other DNA
ggcgcgccagtcctccacaccatctctcgcagtggcgcccgaacagggacttgaaagcgaaagtagaaccagaggagctctcccgacgcaggacttggcttgctgaagcgcgcacagcaagaggcgaggggtagcgactggtgagtacgctaaaaattttttgactagcagaggctagaaggggaaagcgactcggaccgatg

SEQ ID NO: 10180 - DNA, 203 bp, Homo sapiens
  source 1..203: mol_type = other DNA
ggcgcgccagtcctggtatagctctggtaactagagatccctcagaccactttagactgtgtaaaaatctctagcagtggcgcccgaacagggacttgaagttaatagggactcgaaagcgaaagttccagagaagatctctcgacgcacggactcggcttgctgaggtgcacacagcaagaggcgagcgactcggaccgatg

SEQ ID NO: 10181 - DNA, 203 bp, Homo sapiens
  source 1..203: mol_type = other DNA
ggcgcgccagtcctgatcttattctggtaactagagatccctcagaccactttagattgagtaaaaatctctagcagtggcgcccgaacagggacctgaagttaatagggactcgaaagcgaaagttccagagaagatctctcgacgcgaggactcggcttgctgaggtgcacacagcaagaggcgagcgactcggaccgatg

SEQ ID NO: 10182 - DNA, 203 bp, Homo sapiens
  source 1..203: mol_type = other DNA
ggcgcgccagtccttaatccagtctggtaactagagatccctcagaccattctagacggtgtaaaaatctctagcagtggcgcccgaacagggaccggaagttaatagggactcgaaaacgaaagttccagagaagatctctcgacgcacggactcggcttgctgaggtgcacacagcaagaggcgagcgactcggaccgatg

SEQ ID NO: 10183 - DNA, 203 bp, Homo sapiens
  source 1..203: mol_type = other DNA
ggcgcgccagtcctgactaatatctggtaactagagatccctcagaccattttagcttgagtagaaatctctagcagtggcgcccgaacagggacttgaagttaatagggactcgaaagcgaaagttccagagaagctctcttgacgcagagactcggcttgctgaggtgcacacagcaagaggcgagcgactcggaccgatg

SEQ ID NO: 10184 - DNA, 203 bp, Homo sapiens
  source 1..203: mol_type = other DNA
ggcgcgccagtccttttcgtcctctggtaactagagatccctcagacctttgtagtcactgtagaaaatctctagcagtggcgcccgaacagggacttgaaagtaatagggactcgaaagcgaaagttccagagaagttctctcgacgcagggactcggcttgctgagtgcacacggcaagaggcgagcgactcggaccgatg

SEQ ID NO: 10185 - DNA, 203 bp, Homo sapiens
  source 1..203: mol_type = other DNA
ggcgcgccagtcctacgccgactctggtaactagagatccctcagactactttagtcagtgtaaaaatctctagcagtggcgcccgaacagggaccggaagttaatagggactcgaaagcgaaagttccagagaagatctctcgacgcacggactcggcttgctgaggtgcacacagcaagaggcgagcgactcggaccgatg

SEQ ID NO: 10186 - DNA, 203 bp, Homo sapiens
  source 1..203: mol_type = other DNA
ggcgcgccagtcctctcaattatctgttcaaccctggtatctagagatccctcagatcacgtagactgaggcagaaaatctctagcagtggcgcccgaacagggacttgaaaaggaaagtgaaaccagggaagaaaacctccgacgcaacgggctcggcttagcggagtgcacccgctaagaggcgagcgactcggaccgatg

SEQ ID NO: 10187 - DNA, 203 bp, Homo sapiens
  source 1..203: mol_type = other DNA
ggcgcgccagtccttagtttcttctgttcaaccctggtatctagagatccctcagatcacttagactgaagcagaaaatctctagcagtggcgcccgaacagggacttgaaagcgaaagtggaaccagggaagaaaacctccgacgcaacgggctcggcttagcagagtgcacctgctaagaggcgagcgactcggaccgatg

SEQ ID NO: 10188 - DNA, 203 bp, Homo sapiens
  source 1..203: mol_type = other DNA
ggcgcgccagtcctggccaaattctgttcaaccctggtgtctagagatccctcagatcacatagactgaagcagaaaatctctagcagtggcgcccgaacagggacttgaaagagaaagtgaaaccagggaagaaaacctccgacgcaacgggctcggcttagcggagtgcacccgctgagaggcgagcgactcggaccgatg

SEQ ID NO: 10189 - DNA, 203 bp, Homo sapiens
  source 1..203: mol_type = other DNA
ggcgcgccagtcctgtgtcgtctctgttgtgtgactctggtaaactagagatccctcagacctctttagtcagtgtggaaaatctctagcagtggcgcccgaacagggacttgaaagcgaaagtagaaccagaggagctctctcgacgcaggactcggcttgctgaagcgcgcacagcaagaggcgagcgactcggaccgatg

SEQ ID NO: 10190 - DNA, 203 bp, Homo sapiens
  source 1..203: mol_type = other DNA
ggcgcgccagtcctcttgacagtctgttgtgtgactctggtaactagagatccctcagaccattttagtcagagtgtaaaatctctagcagtggcgcccgaacagggacgcgaaaagcgaaaataaaaccagagaagatctctcgacgcaggactcggcttgctgaagtgcacacggcaagaggcgagcgactcggaccgatg

SEQ ID NO: 10191 - DNA, 203 bp, Homo sapiens
  source 1..203: mol_type = other DNA
ggcgcgccagtcctcgagtaactctgttgtgtgactctggtaactagagatccctcagaccattttagtcagtgtggaaaatctctagcagtggcgcccgaacagggacctgaaagcgaaagtagaaccagaggagctctctcgacgcaggactcggcttgctgaaagcgcgcgcagcaagaggcgagcgactcggaccgatg

SEQ ID NO: 10192 - DNA, 203 bp, Homo sapiens
  source 1..203: mol_type = other DNA
ggcgcgccagtcctgtcaaatgtctgttgtgtgactctggtaactagagatccctcagaccattttagtcagtgtggaaaatctctagcagtggcgcccgaacagggacgcgaaagcgaaagtagaaccagaggagatctctcgacgcaggactcggcttgctgaaagcgcgctcggcaagaggcgagcgactcggaccgatg

SEQ ID NO: 10193 - DNA, 203 bp, Homo sapiens
  source 1..203: mol_type = other DNA
ggcgcgccagtccttacgcccttctgttgtgtgactctggtaactagagatccctcagaccattttagtcagtgtggaaaatctctagcagtggcgcccgaacagggacgctgaaagcgaaagtagaaccagaggagatctctcgacgcaggactcggcttgctgaagtgcacacggcaagaggcgagcgactcggaccgatg

SEQ ID NO: 10194 - DNA, 203 bp, Homo sapiens
  source 1..203: mol_type = other DNA
ggcgcgccagtcctgcgcaacgtctgttgtgtgactctggtaactagagatccctcagacccttttagtcagtgtggaaaaatctctagcagtggcgcccgaacagggacgcgaaagcgaaagtagaaccagaggagctctctcgacgcaggactcggcttgctgaagcgcgcacagcaagaggcgagcgactcggaccgatg

SEQ ID NO: 10195 - DNA, 203 bp, Homo sapiens
  source 1..203: mol_type = other DNA
ggcgcgccagtccttacggagttctgttttgtgactctggtaactagagatccctcagacagctttagtccgggtggaaaatctctagcagtggcgcccgaacagggacctgaaagcgaaagtagaaccagaggagatctctcgacgcaggactcggcttgctgaaagcgcgctcggcaagaggcgagcgactcggaccgatg

SEQ ID NO: 10196 - DNA, 203 bp, Homo sapiens
  source 1..203: mol_type = other DNA
ggcgcgccagtcctgtgcagagtgctcatctgttcaaccctggtatctagagatccctcagatcacgtagactgaagcagaaaatctctagcagtggcgcccgaacagggacttgaaagtgaaaccagggaagaaaacctccgacgcaacgggctcggcttagcggagtgcacccgctaagaggcgagcgactcggaccgatg

SEQ ID NO: 10197 - DNA, 203 bp, Homo sapiens
  source 1..203: mol_type = other DNA
ggcgcgccagtcctatacatgatggcgcccgaacagggaccggaagttaatagggactcgaaagcgaaagttccagagaagatctctcgacgcacggactcggcttgctgaggtgcacacagcaagaggcgagagcggcgactggtgagtacgccaatttttgactagcggaggctagaaggagagagcgactcggaccgatg

SEQ ID NO: 10198 - DNA, 203 bp, Homo sapiens
  source 1..203: mol_type = other DNA
ggcgcgccagtccttattgtgctggcgcccgaacagggacctgaaattaatagggactcgaaagcgaaagttccagagaagttctctcgacgcaaggactcggcttgctgaggtgcacgcagcaagaggcgagagcggcgactggtgagtacgccaatttttgactagcggaggctagaaggagagagcgactcggaccgatg

SEQ ID NO: 10199 - DNA, 203 bp, Homo sapiens
  source 1..203: mol_type = other DNA
ggcgcgccagtccttagggcaatggcgcccgaacagggacttgaagttaatagggactcgaaagcgaaagttccagagaagctctcttgacgcagagactcggcttgctgaggtgcacacagcaagaggcgagagcggcgactggtgagtacgccaaattttgactagcggaggctagaaggagagagcgactcggaccgatg

SEQ ID NO: 10200 - DNA, 203 bp, Homo sapiens
  source 1..203: mol_type = other DNA
ggcgcgccagtccttccaattttggcgcccgaacagggacttgagaagcagggaacgcggcccctggacgcaggactcggcttgtgacagcgcaatcacaagaggcgaggcggactccggtggtgagtacaaattttgttgtcggtgggcaaccctagaggaagggcgaagtctctaggtaacaggggcgactcggaccgatg

SEQ ID NO: 10201 - DNA, 203 bp, Homo sapiens
  source 1..203: mol_type = other DNA
ggcgcgccagtcctcattgacttggtaactagagatccctcagacctttttggttgtgtggaaaatctctagcagtggaaaatctctagcagtggcgcccgaacagggacttgaaagcgaaagtaagaccagaggagatctctcgacgcaggactcggcttgctgaagtgcactcggcaaggggcgagcgactcggaccgatg

SEQ ID NO: 10202 - DNA, 203 bp, Homo sapiens
  source 1..203: mol_type = other DNA
ggcgcgccagtccttgaggccttgttatgtgactctggtaactagagatccctcagacccttttagtcagtgtggaaaatctctagcagtggcgcccgaacagggacttgaagaaagtaaaaccagaggagatctctcgacgcaggactcggcttgctgaagaagaagcgcgcgcggcaagaggcgagcgactcggaccgatg

SEQ ID NO: 10203 - DNA, 203 bp, Homo sapiens
  source 1..203: mol_type = other DNA
ggcgcgccagtcctgaccatgtttgagtgctttaagtagtgtgtgcccgtctgttgtgtgactctggtaactagagatccctcagaccttcttagtcagtgtggaaaatctctagcagtggcgcccgaacaggggagctctctcgacgcaggactcggcttgctgaagcgcgcacagcaagaggcgagcgactcggaccgatg

SEQ ID NO: 10204 - DNA, 203 bp, Homo sapiens
  source 1..203: mol_type = other DNA
ggcgcgccagtcctgagcgtaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagccgactcggaccgatg

SEQ ID NO: 10205 - DNA, 203 bp, Homo sapiens
  source 1..203: mol_type = other DNA
ggcgcgccagtcctgtgaataacttctcctcctgcagccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaacgactcggaccgatg

SEQ ID NO: 10206 - DNA, 203 bp, Homo sapiens
  source 1..203: mol_type = other DNA
ggcgcgccagtcctcagaagaagggagcaggagagagaggacaagcggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcgactcggaccgatg

SEQ ID NO: 10207 - DNA, 203 bp, Homo sapiens
  source 1..203: mol_type = other DNA
ggcgcgccagtccttggtataagggagcaggagagagaggacaagtggatccaacagccttcgctccaggggaatcagggcatcacctccttttctgggaggacactcccttctgatggtgaatgggaactcccttcctcctgcagcagcctgcctgcagctgtcctggtagaacagtgtggacattgcgactcggaccgatg

SEQ ID NO: 10208 - DNA, 203 bp, Homo sapiens
  source 1..203: mol_type = other DNA
ggcgcgccagtcctggtcagaagggagcaggagagagaggacaagtggatccaacagccttcgctctaggggaatcagggcatcgcctccttttctgggaggacactcccttctgatggtgaatgggaactcccttcctcctgcagcagcctgcctgcagctgtcctggtagaacagtgtggacattgcgactcggaccgatg

SEQ ID NO: 10209 - DNA, 203 bp, Homo sapiens
  source 1..203: mol_type = other DNA
ggcgcgccagtcctgccgtcaagtgacaaccatagctcttaggggactcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10210 - DNA, 203 bp, Homo sapiens
  source 1..203: mol_type = other DNA
ggcgcgccagtcctgtcgctaagtgacaaccatagctcttaggggattcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10211 - DNA, 203 bp, Homo sapiens
  source 1..203: mol_type = other DNA
ggcgcgccagtcctccgaccaatcggcttactccgcggagttggcctcatttctgcacagagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 10212 - DNA, 203 bp, Homo sapiens
  source 1..203: mol_type = other DNA
ggcgcgccagtcctgcacccacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 10213 - DNA, 203 bp, Homo sapiens
  source 1..203: mol_type = other DNA
ggcgcgccagtcctacctcgacagccacacgccccaaggcctccaagatgagctacacattggactcgctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 10214 - DNA, 203 bp, Homo sapiens
  source 1..203: mol_type = other DNA
ggcgcgccagtccttgcgttacagccacacgccccaaggcctccaagatgagctacacgttggactggctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 10215 - DNA, 203 bp, Homo sapiens
  source 1..203: mol_type = other DNA
ggcgcgccagtcctcgcccgacagccacacgccccaaggcctccaagatgagctacacgttggattcgctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 10216 - DNA, 203 bp, Homo sapiens
  source 1..203: mol_type = other DNA
ggcgcgccagtcctaaggaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggccgactcggaccgatg

SEQ ID NO: 10217 - DNA, 203 bp, Homo sapiens
  source 1..203: mol_type = other DNA
ggcgcgccagtccttccttaacccagccagggcaccacgctgcccggccctgcgccgccaggcacttctttccggggctcctagggacgccagaaggaagccaacctctgctgcttctccttggcctgcgttggaccttcctttttttgttgtttttttttgtttttcccctttcttccttttgaattcgactcggaccgatg

SEQ ID NO: 10218 - DNA, 203 bp, Homo sapiens
  source 1..203: mol_type = other DNA
ggcgcgccagtcctgactacacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattcgactcggaccgatg

SEQ ID NO: 10219 - DNA, 203 bp, Homo sapiens
  source 1..203: mol_type = other DNA
ggcgcgccagtcctccgcatacccctaccccatccccttattcagcacatgaaataaacaaggggcatccaaatcttgcagcaacgcccccgggacatgcatcgtcccctggactctctcaaaccccttatccctctggacagaatgcaggtccaaccacgctggtataccctcaaacccctcagacacgactcggaccgatg

SEQ ID NO: 10220 - DNA, 203 bp, Homo sapiens
  source 1..203: mol_type = other DNA
ggcgcgccagtcctctcagtacctcaatacaagcccactctttcacatatttgaacttttttcacatatcaactttttttgttcactgcgcagggattgttcattgctgctggaggaagatcatggactgtcgcgggaaactgaagtggttgagtatccactagtcgtggatgagggcagtgacttcgcgactcggaccgatg

SEQ ID NO: 10221 - DNA, 203 bp, Homo sapiens
  source 1..203: mol_type = other DNA
ggcgcgccagtccttactgtacctcaatacaagcccactctttcacatgtttgaacttttttcacatatcaactttttttgttcactgtgcagggattgttcattgctgctggaggaagatcatggactgtcgcgggaaactgaagtggttgagtatccactagtcgtggatgagggcagtgacttcgcgactcggaccgatg

SEQ ID NO: 10222 - DNA, 203 bp, Homo sapiens
  source 1..203: mol_type = other DNA
ggcgcgccagtccttgggcaacgccggccaagacagcccagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgcgactcggaccgatg

SEQ ID NO: 10223 - DNA, 203 bp, Homo sapiens
  source 1..203: mol_type = other DNA
ggcgcgccagtcctactgagagacagaacttaacctctgcaagcaagattcgtggaagatagtctccactttttaatgcactaagcaatcggttgctaggagcccatcctgggtcagaggccgatccgcagaaccagaacgttttcccctcctgaactgttagtaacttagtctccctcctcccctaacgactcggaccgatg

SEQ ID NO: 10224 - DNA, 203 bp, Homo sapiens
  source 1..203: mol_type = other DNA
ggcgcgccagtcctcacttgagataactggacaattttttaagtcggaggctgttcttactggtgtgaggatttacacacgtcttcagtttttcagcacagaccagcagaccatcatttttagaggaaatactccctctgccctcctttttggtttccttggtgggctcaactaaaaaactgaatgggcgactcggaccgatg

SEQ ID NO: 10225 - DNA, 203 bp, Homo sapiens
  source 1..203: mol_type = other DNA
ggcgcgccagtccttcagctagcaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggccgactcggaccgatg

SEQ ID NO: 10226 - DNA, 203 bp, Homo sapiens
  source 1..203: mol_type = other DNA
ggcgcgccagtcctatcctaagcgcgggcagcggagcgggcgccaggccggccgggcaggatgcgctaccgggcgtcggccctgggcagtgacggggttcgagtgaccatggagagtgcgctcaccgcccgtgaccgggtgggggtgcaggatttcgtgctgctggagaacttcaccagcgaggccgccgactcggaccgatg

SEQ ID NO: 10227 - DNA, 203 bp, Homo sapiens
  source 1..203: mol_type = other DNA
ggcgcgccagtcctgacacaagcgcgggcagcggagcgggcgccaggccggccgggcaggatgcgctaccgggcgtcggccctgggcagtgacggggttcgggtgaccatggagagtgcgctcaccgcccgtgaccgagtgggggtgcaggatttcgtgctgctggagaacttcaccagcgaggccgccgactcggaccgatg

SEQ ID NO: 10228 - DNA, 203 bp, Homo sapiens
  source 1..203: mol_type = other DNA
ggcgcgccagtccttaacaaagcgcgggcagcggagcgggcgccaggccggccgggcaggatgcgctaccgggcgtcggccctgggcagtgacggggttcgggtgaccatggagagtgcgctcaccgcccgtgaccgggtggggatgcaggatttcgtgctgctggagaacttcaccagcgaggccgccgactcggaccgatg

SEQ ID NO: 10229 - DNA, 203 bp, Homo sapiens
  source 1..203: mol_type = other DNA
ggcgcgccagtcctaattggagctcagtgccagaggaggggattcccggcgccgggggacagagcccctttttttttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 10230 - DNA, 203 bp, Homo sapiens
  source 1..203: mol_type = other DNA
ggcgcgccagtcctcatgcgagctcagtgccagaggaggggattcccggcgccgggggacagagcccctttttttttttgccgaaagaccctttctgctggggagcctcttgtgtccagcctaggcccgcgtgcagcgccgacggatgatcgtcttcttggcaagaaagtgaataaacttaattgagacgactcggaccgatg

SEQ ID NO: 10231 - DNA, 203 bp, Homo sapiens
  source 1..203: mol_type = other DNA
ggcgcgccagtcctgttatgagctcagtgccagaggaggggattcctggcgccgggggacagagcccctttttttttttgccgaaagaccctttctgctggggagcctcttgtgtccagcctaggcccgcgtgcagcgccgacggatgatcgtcttcttggcaagaaagtgaataaacttaattgagacgactcggaccgatg

SEQ ID NO: 10232 - DNA, 203 bp, Homo sapiens
  source 1..203: mol_type = other DNA
ggcgcgccagtccttaaacgaggaagaccagctcggccgagtcctcgtcagcggaatcaggctcaggttctgaggaagaagaggaggaggaggaagaggaggaggaggaagggagcaccagtgaagaatcagaggaggaagaggaagaggaggaggaggagaccggcagcaactctgaggaggcatcacgactcggaccgatg

SEQ ID NO: 10233 - DNA, 203 bp, Homo sapiens
  source 1..203: mol_type = other DNA
ggcgcgccagtcctaataccagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaaccgactcggaccgatg

SEQ ID NO: 10234 - DNA, 203 bp, Homo sapiens
  source 1..203: mol_type = other DNA
ggcgcgccagtcctccgaccagtgacaaccatagcttcttaggggacccccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10235 - DNA, 203 bp, Homo sapiens
  source 1..203: mol_type = other DNA
ggcgcgccagtcctgaagtaagtgacaaccatagcttcttaggggactaccctaaagccttcatccttctgggtgtgtctgacaggccgtggctggaactccctctctttgtggtcctcctgctgtcctatgtgctggccatgttggggaacgtcgccatcatcctggcatcccgggtggatcctcaacgactcggaccgatg

SEQ ID NO: 10236 - DNA, 203 bp, Homo sapiens
  source 1..203: mol_type = other DNA
ggcgcgccagtcctacaacaagtgacaaccatagcttcttaggggactcccctaaagccttcatccttctgggtgtgtctgacaggccgtggctggaactccctctctttgtggtcctcctgctgtcctatgtgctggccatgttggggagcgtcgccatcatcctggcatcccgggtggatcctcaacgactcggaccgatg

SEQ ID NO: 10237 - DNA, 203 bp, Homo sapiens
  source 1..203: mol_type = other DNA
ggcgcgccagtcctcgcaacagtgcattcgagtaaatttaatttccaggcagcttaatacattctttttagccgtgttacttgtaatgtgtatgccctgctttcactcagtgtgtacagggaaacgcacctgattttttacttattagtttgttttttctttaacctttcagcatcacagaggaagtacgactcggaccgatg

SEQ ID NO: 10238 - DNA, 203 bp, Homo sapiens
  source 1..203: mol_type = other DNA
ggcgcgccagtcctatgtacataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgaacagccaccacgactcggaccgatg

SEQ ID NO: 10239 - DNA, 203 bp, Homo sapiens
  source 1..203: mol_type = other DNA
ggcgcgccagtcctggctggataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10240 - DNA, 203 bp, Homo sapiens
  source 1..203: mol_type = other DNA
ggcgcgccagtcctaggacgataccagtgtcagctgcacttgtaggggcccaagtgcctcatgacctactcggcagccttcctctccaggatccccaaggctaggaggccaacctactaacaggtgggtgggtatggtgtgtggtttcactcagttcttctcatggggtttctctgagctccattcatcgactcggaccgatg

SEQ ID NO: 10241 - DNA, 203 bp, Homo sapiens
  source 1..203: mol_type = other DNA
ggcgcgccagtcctcgcccgatacttgatcctaaattcctgtacttcctcaggccatccgagcatgaaacgctgtcacctacccacatccgctggctgtgacgcttgtcagagtgttctctatcggctgcatgcctagaccaccaaagcgttctgaccggacagtgtcactggagaaggcggcgcgaccgactcggaccgatg

SEQ ID NO: 10242 - DNA, 203 bp, Homo sapiens
  source 1..203: mol_type = other DNA
ggcgcgccagtcctaaggaaatcccaaacgcggtacagaccaaaccgcagcccacgttacggatcggcttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10243 - DNA, 203 bp, Homo sapiens
  source 1..203: mol_type = other DNA
ggcgcgccagtcctgcaaggatcccaaacgcggtacagaccaaaccgcagtccacgttacgaatcggcttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10244 - DNA, 203 bp, Homo sapiens
  source 1..203: mol_type = other DNA
ggcgcgccagtcctatcaagatcccaaacgcggtacagaccaaaccgcagtccacgttacggatcggcttactccgcggagttggcctcatttctgcacagagtcggcgctccctgtagtttctcctctcgaacgccaggtggagcaaccggccggataccgccacagccctggcaagaggcgctgtgcgactcggaccgatg

SEQ ID NO: 10245 - DNA, 203 bp, Homo sapiens
  source 1..203: mol_type = other DNA
ggcgcgccagtcctgactacatcccaaacgcggtacagaccaaaccgcagtccacgttacggatcggtttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10246 - DNA, 203 bp, Homo sapiens
  source 1..203: mol_type = other DNA
ggcgcgccagtcctccgcatatcccaaacgcggtacagaccaaaccgcagtccgcgttacggatcggcttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10247 - DNA, 203 bp, Homo sapiens
  source 1..203: mol_type = other DNA
ggcgcgccagtcctcagctcatcccaaacgcggtacagaccaaaccgcagtccgcgttacggatcggtttactccgcggagttggcctcatttctgcacagagtcggcgctccctgtagtttctcctctcgaacgccaggtggagcaaccggccggataccgccacagccctggcaggcggcgctgtgcgactcggaccgatg

SEQ ID NO: 10248 - DNA, 203 bp, Homo sapiens
  source 1..203: mol_type = other DNA
ggcgcgccagtcctcggtgaatgcggatggattatggtcgtcagaggctcccgtagtcttcagcggcgctggcttccgcaggctccgccctctcttgcccacccggaaacagcctcgccccgcctacgcgggacccaaccgcggcgaccggacgtgcactcctccagtagcggctgcacgtcgtgccacgactcggaccgatg

SEQ ID NO: 10249 - DNA, 203 bp, Homo sapiens
  source 1..203: mol_type = other DNA
ggcgcgccagtcctgtccgcatgcggatggattgtggtcgtcagaggctcccgtagtcttcagcggcgctggcttccgcaggctccgccctctcttgcccacccggaaacagcctcgccccgcctacgcgggacccaaccgcggcgaccggacgtgcactcctccagtagcggctgcacgtcgtgccacgactcggaccgatg

SEQ ID NO: 10250 - DNA, 203 bp, Homo sapiens
  source 1..203: mol_type = other DNA
ggcgcgccagtcctactcttcaactgaaaccgcgggaggagaaagcgcggaatcaggaactggccggggtccgcaccgggcctgagtgggtccgaggccgtcccaggagcagctgcccgtgcggaacagcactatgggcttctcttctgagctgtgcagcccccagggccacggggtcctgcagcaaacgactcggaccgatg

SEQ ID NO: 10251 - DNA, 203 bp, Homo sapiens
  source 1..203: mol_type = other DNA
ggcgcgccagtcctcacttgcaactgaaaccgcgggaggaggaagcgcggaatcaggaactggccggggtccgcaccgggcctgagtgggtccgaggccgtcccaggagcagctgcccgtgcggaacagcactatgggcttctcttccgagctgtgcagcccccagggccacggggtcctgcagaaaacgactcggaccgatg

SEQ ID NO: 10252 - DNA, 203 bp, Homo sapiens
  source 1..203: mol_type = other DNA
ggcgcgccagtccttcatgccaagtcaataagactgtggtgagagagttcgtcgtcctcagcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 10253 - DNA, 203 bp, Homo sapiens
  source 1..203: mol_type = other DNA
ggcgcgccagtccttaacaacaagtcaataagactgtggtgagagagtttgtcgtcctcggcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 10254 - DNA, 203 bp, Homo sapiens
  source 1..203: mol_type = other DNA
ggcgcgccagtcctcgtaggcacagtgcctccggaggaaatctgctcagtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 10255 - DNA, 203 bp, Homo sapiens
  source 1..203: mol_type = other DNA
ggcgcgccagtcctcgtctacaccagaatcaagtgttccgcgtgattgaagacaccccctcgtccaagaatgcaaagcacatccaataaaatagctggattataactcctcttctttctctgggggccgtggggtgggagctggggtgagaggtgccgttggcccccgttgcttttcctctgggaaggcgactcggaccgatg

SEQ ID NO: 10256 - DNA, 203 bp, Homo sapiens
  source 1..203: mol_type = other DNA
ggcgcgccagtccttaaacgcagaccgtcgcagctacagggggcctcgagccccggggtgagcgtccccgtcccgctcctgctccttcccatagggacgcgcctgatgcctaggaccggccgctgagcccaaggggaccgaggaggccatggtaggagcgctcgcctgctgcggtgcccgctgaggcccgactcggaccgatg

SEQ ID NO: 10257 - DNA, 203 bp, Homo sapiens
  source 1..203: mol_type = other DNA
ggcgcgccagtcctgcgtagcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacacgactcggaccgatg

SEQ ID NO: 10258 - DNA, 203 bp, Homo sapiens
  source 1..203: mol_type = other DNA
ggcgcgccagtcctgccgtccatggtaacaggttccagggtaacagaggagggagctgggtcctgtttactcccagtcctgccgatgaggattctgaccgtagaaactgaattgtcccgtacctatccgtgctctttctgtgttctcaccagggctgagctcgaactgccacctctgccagcaggacccgactcggaccgatg

SEQ ID NO: 10259 - DNA, 203 bp, Homo sapiens
  source 1..203: mol_type = other DNA
ggcgcgccagtcctttcggacatggtaacaggttccagggtaacagaggagggagctgggtcctgtttactcccagtcctgccgatgaggattctgaccgtagacactgaattgtcccgtacctatccgtgctctttctgtgttctcaccagggctgagctcaaactgccacctctgccagcaggacccgactcggaccgatg

SEQ ID NO: 10260 - DNA, 203 bp, Homo sapiens
  source 1..203: mol_type = other DNA
ggcgcgccagtcctcacggccatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 10261 - DNA, 203 bp, Homo sapiens
  source 1..203: mol_type = other DNA
ggcgcgccagtcctgtcgctcatggtaacaggttccagggtaacagaggagggagctgggtcctgtttactcccagtcctgccgatgaggattctgaccgtagacactgaattgtcccgtacctatccgtgctctttgtgtgttctcaccagggctgagctcgaactgccacctctgccagcaggacccgactcggaccgatg

SEQ ID NO: 10262 - DNA, 203 bp, Homo sapiens
  source 1..203: mol_type = other DNA
ggcgcgccagtcctccgacccatggtaacaggttccagggtaacagaggagggagctgggtcctgtttactcccagtcctgccgatgaggattctgaccgtagacactgaattgtcccgtacctatccgtgttctttctgtgttctcaccagggctgagctcgaactgccacctctgccagcaggacccgactcggaccgatg

SEQ ID NO: 10263 - DNA, 203 bp, Homo sapiens
  source 1..203: mol_type = other DNA
ggcgcgccagtcctagccatccaaggacagcccaagaactggtctagcctggcagccttttccctcgggtagtagaggctgcccctctgacagggagtttgtggtcagcaagtgggcccttgggggtcttgggctgtcacagggactccagaaagccatgcagagccttgtgccatgaaggacttctccgactcggaccgatg

SEQ ID NO: 10264 - DNA, 203 bp, Homo sapiens
  source 1..203: mol_type = other DNA
ggcgcgccagtccttcccagccaaggacagcccaagaactggtctagcctggcagccttttccctcgggtagtagaggctgcccctttgacagggagtttgtggtcagcgagtgggcccttgggggtcttgggctgtcacaggaactccagaaagccatgcagagccttgtgccatgaaggacttctccgactcggaccgatg

SEQ ID NO: 10265 - DNA, 203 bp, Homo sapiens
  source 1..203: mol_type = other DNA
ggcgcgccagtcctcgcccgccatcacccctaaatgtattccaaagaataagaacattgttttatacatagcacacttaacaaaatcaagaaatttaacattaatacagtactgttacctaatccgtagtcgattttcaaattttgtcagttgttccaataatgtcctttatatattccccgcccagccgactcggaccgatg

SEQ ID NO: 10266 - DNA, 203 bp, Homo sapiens
  source 1..203: mol_type = other DNA
ggcgcgccagtcctgcaaggccatgagaagcgaccacccctcgacaacttctccttcacggttcccacccaggagcacggccaactctcccccggaatccataacggctcacgcaaatagatttctttccgttcctcctcggagggctctccacatttatctgctcgagacgtggcagctccagaacccgactcggaccgatg

SEQ ID NO: 10267 - DNA, 203 bp, Homo sapiens
  source 1..203: mol_type = other DNA
ggcgcgccagtcctatcaagccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaacccgactcggaccgatg

SEQ ID NO: 10268 - DNA, 203 bp, Homo sapiens
  source 1..203: mol_type = other DNA
ggcgcgccagtccttccttaccatgagaagcgaccacccctcgacgacttctccttcacggttcccatccaggagcacggccaactctcccccggaatccataacggctcacgcaaatagatttctttccgttcctcctcggagggctctccacatttatctgctcgagacgtggcagctccagaacccgactcggaccgatg

SEQ ID NO: 10269 - DNA, 203 bp, Homo sapiens
  source 1..203: mol_type = other DNA
ggcgcgccagtcctcagctcccatgagaagcgaccacccctcgacgacttctccttcatggttcccacccaggagcacggccaactctcccccggaatccataacggctcacgcaaatagatttctttccgttcctcctcggagggctctccacatttatctgctcaagacgtggcagctccagaacccgactcggaccgatg

SEQ ID NO: 10270 - DNA, 203 bp, Homo sapiens
  source 1..203: mol_type = other DNA
ggcgcgccagtccttactgtcccaggcctcgctggaccacggacccgccaggttctcccgcaacttgcggagctcctggaacggcccttcccagaggcgcagcgctgagtcccaggagcaggacctgaaccaggaaggggaggggcgagcacagtcctgcctcctcctccccgcacagtgctgggggacgactcggaccgatg

SEQ ID NO: 10271 - DNA, 203 bp, Homo sapiens
  source 1..203: mol_type = other DNA
ggcgcgccagtcctcttccccccaggcctcgctggaccacggacccgccaggttctcccgcaacttgcggagctcctggaccggcccttcccagaggcacagcgctgagtcccaggagcaggacctgaaccaggaaggggaggggcgagcacagtcctgcctcctcctccccgcacagtgctgggggacgactcggaccgatg

SEQ ID NO: 10272 - DNA, 203 bp, Homo sapiens
  source 1..203: mol_type = other DNA
ggcgcgccagtccttcggaccccaggcctcgctggaccacggacccgccaggttctcccgcaacttgcggagctcctggaccggcccttcccagaggcgcagcgctgagtcccaggagcaggacctgaaccaggaaggggaggggcgagcacagtcctgcctcttcctccccgcacagtgctgggggacgactcggaccgatg

SEQ ID NO: 10273 - DNA, 203 bp, Homo sapiens
  source 1..203: mol_type = other DNA
ggcgcgccagtcctaccagcccctgagcaaagagtcacagataaaacaggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagaccgactcggaccgatg

SEQ ID NO: 10274 - DNA, 203 bp, Homo sapiens
  source 1..203: mol_type = other DNA
ggcgcgccagtcctagcgccccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagaccgactcggaccgatg

SEQ ID NO: 10275 - DNA, 203 bp, Homo sapiens
  source 1..203: mol_type = other DNA
ggcgcgccagtcctttcaccccgccgggctcagtcccagtgacccccctggtcggggttcgcgcgccctcccccagcacgaccgggcaaggctgccgcggcgtcggagtaatccccaaccctccgccgccgcttcttccctcacccgggcctccagacgtttgccgcggaaacgaaagtaacgctcggcgactcggaccgatg

SEQ ID NO: 10276 - DNA, 203 bp, Homo sapiens
  source 1..203: mol_type = other DNA
ggcgcgccagtcctactgagccgccgggctcagtcccagtgacccccctggtcggggttcgcgcgccctcccccagcacgcccgggcaaggctgccgcggcgtcggagtaatccccaaccctccgccgccgcttcttccctcatccgggcctccagacgtttgccgcggaaacgaaagtaacgctcggcgactcggaccgatg

SEQ ID NO: 10277 - DNA, 203 bp, Homo sapiens
  source 1..203: mol_type = other DNA
ggcgcgccagtcctactcttccgccgggctcagtcccggtgacccccctggtcggggttcgcgcgccctcccccagcacgaccgggcaaggctgccgcggcgtcggagtaatccccaaccctccgccgccgcttcttccctcatccgggcctccagacgtttgccgcggaaacgaaagtaacgctcggcgactcggaccgatg

SEQ ID NO: 10278 - DNA, 203 bp, Homo sapiens
  source 1..203: mol_type = other DNA
ggcgcgccagtccttcagctccgccgggctcagtcccggtgacccccctggtcggggttcgcgcgccctcccccagcacgcccgggcaaggctgccgcggcgtcggagtaatccccaaccctccgccgccgcttcttccctcatccgggcctccagacgtttgccgcggaaacgaaagtaacgctcggcgactcggaccgatg

SEQ ID NO: 10279 - DNA, 203 bp, Homo sapiens
  source 1..203: mol_type = other DNA
ggcgcgccagtcctgacacaccggcttccccgccccatttggtgggggctggcccttggccctccaactcctttaccctacatgcctgagaagccagggaccaagatggatcttctcctcgacatcagctaagcctggaggactcttcccctcagagaccatggagagggacagccacgggaatgtatcgactcggaccgatg

SEQ ID NO: 10280 - DNA, 203 bp, Homo sapiens
  source 1..203: mol_type = other DNA
ggcgcgccagtcctatacctccggcttccccgccccatttggtgggggctggcccttggccctccaactcctttaccctacatgcctgagaagccaggggccaagatggatcttctcctcgacatcagctaagcctggaggactcttcccctcagagaccatggagagggacagccacgggaatgtatcgactcggaccgatg

SEQ ID NO: 10281 - DNA, 203 bp, Homo sapiens
  source 1..203: mol_type = other DNA
ggcgcgccagtcctgagcgtccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgctctggcccagctgcccatgtccgactcggaccgatg

SEQ ID NO: 10282 - DNA, 203 bp, Homo sapiens
  source 1..203: mol_type = other DNA
ggcgcgccagtcctcatgcgccgttccccaacttcctcggcgctccggactcccaagtctccgccggaccctcctttggatattcctcgtgtctccgattctgagacagagggggaagacggtggggcctacccacctgccccgcagaagatgcagttctttggccgcctggtcaataccttcagtggcgactcggaccgatg

SEQ ID NO: 10283 - DNA, 203 bp, Homo sapiens
  source 1..203: mol_type = other DNA
ggcgcgccagtcctcgtctaccgttctccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgactcggaccgatg

SEQ ID NO: 10284 - DNA, 203 bp, Homo sapiens
  source 1..203: mol_type = other DNA
ggcgcgccagtcctggtcagcctgtgaaagatctcacttgttcaaaagtccaagtgtgaattactgtctcacagacaaaccaaagtattttgaaaaacaaaggggagaaaagaaattactccccagaactctcaggcatctagaggacacccaagaacgtgggagtcagctgcttcttgtgtgcagcccgactcggaccgatg

SEQ ID NO: 10285 - DNA, 203 bp, Homo sapiens
  source 1..203: mol_type = other DNA
ggcgcgccagtcctttcggacctgtgaaagatctcacttgttcaaaagtccaagtgtgaattactgtctcacagataaaccaaagtattttgaaaaacaaaggggagaaaagaaattactccccagaactctcaggcatctagaggacacccaagaacctgggagtcagctgcttcttgtgtgcagcccgactcggaccgatg

SEQ ID NO: 10286 - DNA, 203 bp, Homo sapiens
  source 1..203: mol_type = other DNA
ggcgcgccagtcctccaattcgaaactttgcccatagcagcgggcgggcactttgcactggaacttacaacacccgagcaaggacgcgactctcccgacgtggggaggctattctgcccatttggggacacttccccgccgctgccaggacccgcttctctgaaaggctctccttgcagctgcttagacgactcggaccgatg

SEQ ID NO: 10287 - DNA, 203 bp, Homo sapiens
  source 1..203: mol_type = other DNA
ggcgcgccagtcctcattatcgcactaagcaaactgctcggaagtctactggtggcaaggcgccacgcaaacagttagccactaaggcagcccgcaaaagcgctccggccaccggcggcgtgaaaaagccccaccgctaccggccgggcaccgtggctctgcgcgagatccgccgttatcagaagtcccgactcggaccgatg

SEQ ID NO: 10288 - DNA, 203 bp, Homo sapiens
  source 1..203: mol_type = other DNA
ggcgcgccagtcctaaacgccgcactaagcaaactgctcggaagtctactggtggcaaggcgccacgcaaacagttggcgactaaggcagcccgcaaaagcgctccggccaccggcggcgtgaaaaagccccaccgctaccggccgggcaccgtggctctgcgcgagatccgccgttatcagaagtcccgactcggaccgatg

SEQ ID NO: 10289 - DNA, 203 bp, Homo sapiens
  source 1..203: mol_type = other DNA
ggcgcgccagtcctaaggaacgcgctcctagagctcgggccgtggctcgtcggggtctgtgtcttttggctccgagggcagtcgctgggcttccgagaggggttggggctgcgtaggggcgctttgttttgttcggttttgtttttttgagagtgcgagagaggcggtcgtgcagacccgggagaaagcgactcggaccgatg

SEQ ID NO: 10290 - DNA, 203 bp, Homo sapiens
  source 1..203: mol_type = other DNA
ggcgcgccagtcctgactaccgctggtcagcgccaagtgacttacgcccccgaccctgagccgggaccgctaggcgaggaggatcagatctccgctcgagaatctgaaggtgccctggtcctggaggagttccgtcccagcccgcggtctcccgggccgccctcctgaccggccggctcccggttcggcgactcggaccgatg

SEQ ID NO: 10291 - DNA, 203 bp, Homo sapiens
  source 1..203: mol_type = other DNA
ggcgcgccagtccttactgtcggagtgtcagctctccatctgtctctgcctggcaggcgcacgcgcccagcaccctgcctccagcgatgccgccccagcccctctgatggccctcctctctgctgccactcattccagaacaggaggcatgagcccggaacgcgcttgcttttaggagacagccacttcgactcggaccgatg

SEQ ID NO: 10292 - DNA, 203 bp, Homo sapiens
  source 1..203: mol_type = other DNA
ggcgcgccagtcctatcctacgtactaaacagacagctcggaaatccaccggcggtaaagcgccacgcaagcagctggctaccaaagctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 10293 - DNA, 203 bp, Homo sapiens
  source 1..203: mol_type = other DNA
ggcgcgccagtcctgacacacgtactaaacagacagctcggaaatccaccggcggtaaagcgccacgcaagcagctggctaccaaggctgctcgcaagagcgcgccggctaccggcggcgtgaaaaaacctcaccgttaccgcccgggcactgtggctctgcgcgagatccgccgctaccaaaagtcgcgactcggaccgatg

SEQ ID NO: 10294 - DNA, 203 bp, Homo sapiens
  source 1..203: mol_type = other DNA
ggcgcgccagtcctgagcgtcgtactaaacagacagctcggaaatccaccggtggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 10295 - DNA, 203 bp, Homo sapiens
  source 1..203: mol_type = other DNA
ggcgcgccagtcctcaaagacgtactaaacagacagctcggaaatccactggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 10296 - DNA, 203 bp, Homo sapiens
  source 1..203: mol_type = other DNA
ggcgcgccagtcctcatgcgcgtccctggagcgatcagggctcaggagcccgacccggagcccggggcgtccgcgctgacttcgggtccccggagcctggggcacggcagcgagaagacgacggcggagaaggcgacagcggagaaggaaggcaggctgcaggggcgccgtcggcgcagcgggccgggcgactcggaccgatg

SEQ ID NO: 10297 - DNA, 203 bp, Homo sapiens
  source 1..203: mol_type = other DNA
ggcgcgccagtcctattgtccgtccctggagcgatcagggctcaggagcccgacccggagcccggggcgtccgcgctgacttcgggtccccggagcctggggcacggcaggaagaagacgacggcggagaaggcgacagcggagaaggcaggcaggctgcaggggcgccgtcggcgcggcgggccgggcgactcggaccgatg

SEQ ID NO: 10298 - DNA, 203 bp, Homo sapiens
  source 1..203: mol_type = other DNA
ggcgcgccagtcctgcgtagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgtgcggccccgaggaggacgactcggaccgatg

SEQ ID NO: 10299 - DNA, 203 bp, Homo sapiens
  source 1..203: mol_type = other DNA
ggcgcgccagtccttggtatcgttcgggggcggggcctgctccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgacgactcggaccgatg

SEQ ID NO: 10300 - DNA, 203 bp, Homo sapiens
  source 1..203: mol_type = other DNA
ggcgcgccagtcctagaggactaaagggaaaaaggaagaatgcaacaaaactgaagtatgttctgccacgttcctgaactgcagccataggagccctcccagccctacccaaaccagcctactccctctcaagagctcacagctgcaggactagagccagatgtgccccagcaataaggacttcttcccgactcggaccgatg

SEQ ID NO: 10301 - DNA, 203 bp, Homo sapiens
  source 1..203: mol_type = other DNA
ggcgcgccagtcctaataccctactgccttctccgaccgtccgtcctcggggcaggcgtgctctcttccctgagcttttaggggttggcttttccagttccagatcagctacagcaaacatcgttcgagatgtcccaccaagagggcagcacaggtggcttaccagacttagtgactgaaagcctgttcgactcggaccgatg

SEQ ID NO: 10302 - DNA, 203 bp, Homo sapiens
  source 1..203: mol_type = other DNA
ggcgcgccagtcctgaagtactcaataagtctgcttccaccttccagcttactggcttcccaggcatggagaaggcacatcactggatattcatcccattattggcagcctacatctccatacttcttggcaatggcactcttctctttctcatcagaaatgatcataacctccatgagcccatgtaccgactcggaccgatg

SEQ ID NO: 10303 - DNA, 203 bp, Homo sapiens
  source 1..203: mol_type = other DNA
ggcgcgccagtcctacaacactcaataagtctgcttccaccttccagcttactggcttcccaggcatggagaaggcacatcactggatattcatcccattattggcagcctacatctccatacttcttggcagtggcactcttctctttctcatcaggaatgatcataacctccatgagcccatgtaccgactcggaccgatg

SEQ ID NO: 10304 - DNA, 203 bp, Homo sapiens
  source 1..203: mol_type = other DNA
ggcgcgccagtcctagccatctcaatacgtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 10305 - DNA, 203 bp, Homo sapiens
  source 1..203: mol_type = other DNA
ggcgcgccagtccttatttcctcaatacgtctgcttccaccttccagcttactggcttcccaggcatggagaaggcacatcactggatattcatcccattattggcagcctacatctccatacttcttggcagtggcactcttctctttctcatcaggaatgatcataacctccatgagcccatgtaccgactcggaccgatg

SEQ ID NO: 10306 - DNA, 203 bp, Homo sapiens
  source 1..203: mol_type = other DNA
ggcgcgccagtccttcccagctcatccttctactcgtgacacttcccagttctgcctttgtgaaagcaaagatgagcaacactcaagctgagaggtccataataggcatgatcgacatgtttcacaaatacaccggacgtgatggcaagattgagaagccaagcctgctgacgatgatgaaggagaaccgactcggaccgatg

SEQ ID NO: 10307 - DNA, 203 bp, Homo sapiens
  source 1..203: mol_type = other DNA
ggcgcgccagtcctacgggtctcatccttctactcgtgacacttcccagttctgcctttttgaaagcaaagatgagcaacagtcaagctgagaggtccataataggcatgatcgacatgtttcacaaatacaccggacgtgatggcaagattgagaagccaagcctgctgacgatgatgaaggagaaccgactcggaccgatg

SEQ ID NO: 10308 - DNA, 203 bp, Homo sapiens
  source 1..203: mol_type = other DNA
ggcgcgccagtcctgctactctcatccttctactcgtgacacttcccagttctgcgtttttgaaagcaaagatgagcaacactcaagctgagaggtccataataggcatgatcgacatgtttcacaaatacaccggacgtgatggcaagattgagaagccaagcctgctgacgatgatgaaggagaaccgactcggaccgatg

SEQ ID NO: 10309 - DNA, 203 bp, Homo sapiens
  source 1..203: mol_type = other DNA
ggcgcgccagtcctaaacgcctcatccttctactcgtgacacttcccagttctggctttgtgaaagcaaagatgagcaacactcaagctgagaggtccataataggcatgatcgacatgtttcacaaatacaccggacgtgatggcaagattgagaagccaagcctgctgacgatgatgaaggagaaccgactcggaccgatg

SEQ ID NO: 10310 - DNA, 203 bp, Homo sapiens
  source 1..203: mol_type = other DNA
ggcgcgccagtccttttcggctcatccttctactcgtgacacttcccagttctggctttttgaaagcaaagatgagcaacactcaagctgagaggtccataataggcatgatcgacatgtttcacaaatacaccggacgtgatggcaagattgacaagccaagcctgctgacgatgatgaaggagaaccgactcggaccgatg

SEQ ID NO: 10311 - DNA, 203 bp, Homo sapiens
  source 1..203: mol_type = other DNA
ggcgcgccagtcctcgcccgctccaaagaccccgacaggccccggcgggtgggaggcgcgcgccccggggcgggcggggctccccctaccggccagacccagggagaggcgcgcggaggctgcgaaggttccagaagggcggggagggggcgccgcgcgctgaccctccctgggcaccgctggggacgcgactcggaccgatg

SEQ ID NO: 10312 - DNA, 203 bp, Homo sapiens
  source 1..203: mol_type = other DNA
ggcgcgccagtcctgactacctcggtgcccgcagcgccggggcgtggaggcgttaacgcgcacgcgcttaaggatccggccgtggccgagcgcgcggccgtaagaccgcgggtgactagcatgcagatacccatgctctgactttctgcccctccactgacatggcccaccggggtggggagagggaccgactcggaccgatg

SEQ ID NO: 10313 - DNA, 203 bp, Homo sapiens
  source 1..203: mol_type = other DNA
ggcgcgccagtcctcttcccctgcctggcaggcgcacgcgcccagcaccctgcctccagcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 10314 - DNA, 203 bp, Homo sapiens
  source 1..203: mol_type = other DNA
ggcgcgccagtcctactcttcttatctggtcggtcatctctgtaacctccctaccaaggactaattggtctttaaaactcctcaatgcaccgggcgcggtggctcacgcctgtaatcccagcactttgggaggccgagacgggcagatcacgaggtcaggaaatcgagaccatcttggctaacaagaacgactcggaccgatg

SEQ ID NO: 10315 - DNA, 203 bp, Homo sapiens
  source 1..203: mol_type = other DNA
ggcgcgccagtcctttgtcgcttatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggaaatcgaaaccatcttggctaacaagaacgactcggaccgatg

SEQ ID NO: 10316 - DNA, 203 bp, Homo sapiens
  source 1..203: mol_type = other DNA
ggcgcgccagtcctctggtacttccgtccagaccggaacccaagatggctgcgctgttgctgagttggtctcttcccatggcgatgtccatctgccaccgtggcactggtattgctttgagtgcaggggtctctctttttggcatgtcggccctgttactccctgggaactttgagtcttatttggaacgactcggaccgatg

SEQ ID NO: 10317 - DNA, 203 bp, Homo sapiens
  source 1..203: mol_type = other DNA
ggcgcgccagtccttaacaacttttatagctccctggttcaacctcaaggccttgaggttttggcagctctggaggatgagagagaacatggccaggggcccttgcaacacgccgagatgggcgtccctgatggtgctggtcgccataggcaccgccgtgacagcggccgtcaaccctggcgtcgtggcgactcggaccgatg

SEQ ID NO: 10318 - DNA, 203 bp, Homo sapiens
  source 1..203: mol_type = other DNA
ggcgcgccagtcctgtagaccttttatagctccctggttcaacctcaaggccttgaggttttggcagctctggaggatgagagagaacatggccaggggcccttgcaacgcgccgagatgggcgtccctgatggtgctcgtcgccataggcaccgccgtgacagcggccgtcaaccctggcgtcgtggcgactcggaccgatg

SEQ ID NO: 10319 - DNA, 203 bp, Homo sapiens
  source 1..203: mol_type = other DNA
ggcgcgccagtccttgtaaagaacccgggccggacgctgccggcaccgccagcgcacagccccaaccgccgccgccccccccacccgctcccaaggagtccccattctccatcaagaacctgctcaacggagaccaccaccggccgccccctaagcctcagccgcccccacggacgctcttcgcgccacgactcggaccgatg

SEQ ID NO: 10320 - DNA, 203 bp, Homo sapiens
  source 1..203: mol_type = other DNA
ggcgcgccagtcctattgtcgaagaggacgggtcaagtgctggcttccggcggaaaagcgcgcgagcaagatggccaccaccaagcgcgtcttgtacgtgggtggactggcagaggaagtggacgacaaagttcttcatgctgcgttcattccttttggagacatcacagatattcagattcctctggcgactcggaccgatg

SEQ ID NO: 10321 - DNA, 203 bp, Homo sapiens
  source 1..203: mol_type = other DNA
ggcgcgccagtccttggtatgacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagagctgagggacgactcggaccgatg

SEQ ID NO: 10322 - DNA, 203 bp, Homo sapiens
  source 1..203: mol_type = other DNA
ggcgcgccagtcctagaggagacaggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactaccgactcggaccgatg

SEQ ID NO: 10323 - DNA, 203 bp, Homo sapiens
  source 1..203: mol_type = other DNA
ggcgcgccagtcctggtcaggacaggccagtgcctggcgccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactaccgactcggaccgatg

SEQ ID NO: 10324 - DNA, 203 bp, Homo sapiens
  source 1..203: mol_type = other DNA
ggcgcgccagtccttatttcgacgggccagtgcctggcaccccggggttgccagggtccacggggaacccgaagtccgaggagcccgaggtccgggaccgggaggggctgcagcgcatcaccggcctgtctcccggccgttcggctctcatagtggcggtgctgtgctacatcaatctcctgaactaccgactcggaccgatg

SEQ ID NO: 10325 - DNA, 203 bp, Homo sapiens
  source 1..203: mol_type = other DNA
ggcgcgccagtcctccaattgacgggccagtgcctggcaccccggggttgccagggtccacggggaacctgaagtccgaggagcccgaggtcccggaccaggaggggctgcagcgcatcaccggcctgtctcccggccgttcggctctcatagtggcggtgctgtgctacatcaatctcctgaactaccgactcggaccgatg

SEQ ID NO: 10326 - DNA, 203 bp, Homo sapiens
  source 1..203: mol_type = other DNA
ggcgcgccagtcctcgcaacgactacaggggagttttgttgaagttgcaaagtcctggagcctccagagggctgtcggcgcagtagcagcaagcagcagagtccgcacgctccggcgaggggcagaagagcgcgagggagcgcggggcagcagaagcgagagccgagcgcggacccagccaggacccacgactcggaccgatg

SEQ ID NO: 10327 - DNA, 203 bp, Homo sapiens
  source 1..203: mol_type = other DNA
ggcgcgccagtcctggctgggagccgcagtcagatcctagcgtcgagccccctctgagtcaggaaacattttcagacctatggaaactacttcctgaaaacaacgttctgtcccccttgccgtcccaagcaatggatgatttgatgctgtcctcggacgatattgaacaatggttcactgaagacccacgactcggaccgatg

SEQ ID NO: 10328 - DNA, 203 bp, Homo sapiens
  source 1..203: mol_type = other DNA
ggcgcgccagtcctcgacgtgagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 10329 - DNA, 203 bp, Homo sapiens
  source 1..203: mol_type = other DNA
ggcgcgccagtccttttcgggagccgggccccggccgctgtccagccgctccgtgccccgcgcgtcctgcgccgccgccaccgcctcttggggagacgcagccacttgcccgccatggatactcccagggtcctgctctcggccgtcttcctcatcagttttctgtgggatttgcccggtttccagcacgactcggaccgatg

SEQ ID NO: 10330 - DNA, 203 bp, Homo sapiens
  source 1..203: mol_type = other DNA
ggcgcgccagtcctcgatccgatcgacttactccgcggagttggcctcatttctgcacagagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 10331 - DNA, 203 bp, Homo sapiens
  source 1..203: mol_type = other DNA
ggcgcgccagtcctatcaaggatcggcttactccgcggagttggcctcatttctgcacagagtcggcgctccctgtagtttctcctctcgaacgccaggtggagcaaccggccggataccgccacagccctggcaagaggcgctgtgatgcctgagctgatcctgtatgttgcaatcactctatccgtcgactcggaccgatg

SEQ ID NO: 10332 - DNA, 203 bp, Homo sapiens
  source 1..203: mol_type = other DNA
ggcgcgccagtcctgactacgatcggcttactccgcggagttggcctcatttctgcacagagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 10333 - DNA, 203 bp, Homo sapiens
  source 1..203: mol_type = other DNA
ggcgcgccagtcctcggtgagcaaggcgcgcatgcgcaccgagggtggagccgctgagcacagaaccggaaacttagagacaaagttcggagccccgcccccgccgcgcgccgctgagttgtctggccccgccgacccacggctcacgacccaccgacccacgaatcggcccggccgtcgcgtgcacccgactcggaccgatg

SEQ ID NO: 10334 - DNA, 203 bp, Homo sapiens
  source 1..203: mol_type = other DNA
ggcgcgccagtcctgtccgcgcaaggcgcgcatgcgtaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcacccgactcggaccgatg

SEQ ID NO: 10335 - DNA, 203 bp, Homo sapiens
  source 1..203: mol_type = other DNA
ggcgcgccagtcctttgcttgccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 10336 - DNA, 203 bp, Homo sapiens
  source 1..203: mol_type = other DNA
ggcgcgccagtcctgaatctgccgtgctgttcccgccaattcctgtggtaatccttaccgtggcgagttccgcgctcaatggagacgtttgcccccaccgagctgcccgagctgcttaaactttattaccggaggctctttccctactctcagtactatcgctggctcaactacggtggagtgataaacgactcggaccgatg

SEQ ID NO: 10337 - DNA, 203 bp, Homo sapiens
  source 1..203: mol_type = other DNA
ggcgcgccagtcctggtggcgccgtgctgttcccgccagttcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 10338 - DNA, 203 bp, Homo sapiens
  source 1..203: mol_type = other DNA
ggcgcgccagtcctaccagcgcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcagctctttgccctcttccaaccgactcggaccgatg

SEQ ID NO: 10339 - DNA, 203 bp, Homo sapiens
  source 1..203: mol_type = other DNA
ggcgcgccagtcctagcgccgcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcggctctttgccctcttccaaccgactcggaccgatg

SEQ ID NO: 10340 - DNA, 203 bp, Homo sapiens
  source 1..203: mol_type = other DNA
ggcgcgccagtcctactcttgccttcgccagcagcgccgcggcggaaccgggcgcaggggagcgagcccggccccgccagcccagcccagcccagcccagccctactccctccccacgccagggcagcagccgttgctcagagagaaggtggaggaagaaatccagaccctagcacgcgcgcaccatccgactcggaccgatg

SEQ ID NO: 10341 - DNA, 203 bp, Homo sapiens
  source 1..203: mol_type = other DNA
ggcgcgccagtccttcatgcgcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaaccgactcggaccgatg

SEQ ID NO: 10342 - DNA, 203 bp, Homo sapiens
  source 1..203: mol_type = other DNA
ggcgcgccagtccttcgatggcggggcggatggcgagggagcggggcgagctgctttttgaggctgcgcactcgcatggccccacctcgcaggtccatttccggcgccgcggctgttccgggcggagaccgcttgtgctggagtcggagttgtaacgctccactgactgatagagcgaccggccgacccgactcggaccgatg

SEQ ID NO: 10343 - DNA, 203 bp, Homo sapiens
  source 1..203: mol_type = other DNA
ggcgcgccagtcctcagaaggctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 10344 - DNA, 203 bp, Homo sapiens
  source 1..203: mol_type = other DNA
ggcgcgccagtccttggtatgctcgtccgcctaataccgcgcctgcgcaccgcgtctcttcctttctgggctcggacctaggtcgcggcgacatggccaaacgtaccaagaaagttgggatcgtcggtaaatacgggacccgctatggggcctccctccggaaaatggtgaagaaaattgaaatcagccgactcggaccgatg

SEQ ID NO: 10345 - DNA, 203 bp, Homo sapiens
  source 1..203: mol_type = other DNA
ggcgcgccagtcctgtcgctgctgtctgtgtacttccggcagcctccagacagtttcttccgcttcctgtaccacccggctcaagtagcggacacggaacagggaactatcagcccgtcggcctccgggccctgcattctctagctatggaccgggaccttttgcggcagtcgctaaattgccacgggcgactcggaccgatg

SEQ ID NO: 10346 - DNA, 203 bp, Homo sapiens
  source 1..203: mol_type = other DNA
ggcgcgccagtcctccgaccgctgtctgtgtacttccggcagcctccagacagtttcttccgcttcctgtaccacccggctcaagtagcggacacggaacagggaactatcagcccgtcggcctccgggccctgtattctctagccatggaccgggaccttttgcggcagtcgctaaattgccacgggcgactcggaccgatg

SEQ ID NO: 10347 - DNA, 203 bp, Homo sapiens
  source 1..203: mol_type = other DNA
ggcgcgccagtcctgaagtagctgtctgtgtacttccggcagcctccagacagtttcttccgcttcctgtaccaccctgctcaagtagcggacacggaacagggaactatcagcccgtcggcctccgggccctgcattctctagccatggaccgggaccttttgcggcagtcgctaaattgccacgggcgactcggaccgatg

SEQ ID NO: 10348 - DNA, 203 bp, Homo sapiens
  source 1..203: mol_type = other DNA
ggcgcgccagtcctccaattgcttccgcctccttctttctcgacaagatggccacaccggcggtaccagtaagtgctcctctggccacgccaaccccagtcccggcggcggccccagcctcagttccagcgccaacgccagcaccggctgcggctccggttcccgctgcggctccagcctcatcctcacgactcggaccgatg

SEQ ID NO: 10349 - DNA, 203 bp, Homo sapiens
  source 1..203: mol_type = other DNA
ggcgcgccagtccttcccaggcttccgcctccttttttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcacgactcggaccgatg

SEQ ID NO: 10350 - DNA, 203 bp, Homo sapiens
  source 1..203: mol_type = other DNA
ggcgcgccagtcctgtgccagcttccgtctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcacgactcggaccgatg

SEQ ID NO: 10351 - DNA, 203 bp, Homo sapiens
  source 1..203: mol_type = other DNA
ggcgcgccagtcctcattatgcttccgtctccttctttctcgacaagatggccacaccggcggtaccagtaagtgctcctctggccacgccaaccccagtcccggcggcggccccagcctcagttccagcgccaacgccagcaccggctgcggctccggttcccgctgcggctccagcctcatcctcacgactcggaccgatg

SEQ ID NO: 10352 - DNA, 203 bp, Homo sapiens
  source 1..203: mol_type = other DNA
ggcgcgccagtcctacgggtggactggggacctcactcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10353 - DNA, 203 bp, Homo sapiens
  source 1..203: mol_type = other DNA
ggcgcgccagtcctatgtacggactggggacctcgctcaggaccgtggggagttggctgaaggacttggggagcccagaagttgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10354 - DNA, 203 bp, Homo sapiens
  source 1..203: mol_type = other DNA
ggcgcgccagtcctcgacgtggagctcagtgccagaggaggggattcccggcgccgggtcagagccccttttttcttttgccgaaagaccctttctgctggggagcctcttgtgtccagcctaggcccgcgtgcagcgccgacggatgatcgtcttcttggcaagaaagtgaataaacttaattgagacgactcggaccgatg

SEQ ID NO: 10355 - DNA, 203 bp, Homo sapiens
  source 1..203: mol_type = other DNA
ggcgcgccagtccttttcggggagctcagtgccagaggaggggattcccggcgccgggtcagagcccctttttttttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 10356 - DNA, 203 bp, Homo sapiens
  source 1..203: mol_type = other DNA
ggcgcgccagtcctacctcgggagctcagtgccagaggaggggattcctggcgccgggtcagagccccttttttcttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 10357 - DNA, 203 bp, Homo sapiens
  source 1..203: mol_type = other DNA
ggcgcgccagtcctcgcccgggaggccgttcctgcgcggccgccccattcccagaccggccgccagcccatctggttagctcccgccgctccgcgccgcccgggagtcgggagccgcggggaaccgggcacctgcatccgccgctgggagtgagtggctccagctggtgcctggcctgtgtctcttggcgactcggaccgatg

SEQ ID NO: 10358 - DNA, 203 bp, Homo sapiens
  source 1..203: mol_type = other DNA
ggcgcgccagtcctcgatccggagtaagtctgtctgatctaggatgtcttgcttaccacccaggtagggggttatatactcccagcctttctgattccattgtaactcttgccgaaatccgggtgaacggaagtagtctctttaagaactggtatgggcaggcccaagttgtcaaggcttcggaggtacgactcggaccgatg

SEQ ID NO: 10359 - DNA, 203 bp, Homo sapiens
  source 1..203: mol_type = other DNA
ggcgcgccagtcctatcaagggagtaagtctgtctgatctaggatgtcttgcttatcacccaggtagggggttatatactcccagcctttctgattccattgtaactcttgccgaaatccgggtgaacggaagtagtctctttaagaactggtatgggcaggcccaagttgtcaaggcttcggaggtacgactcggaccgatg

SEQ ID NO: 10360 - DNA, 203 bp, Homo sapiens
  source 1..203: mol_type = other DNA
ggcgcgccagtccttccttaggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccgactcggaccgatg

SEQ ID NO: 10361 - DNA, 203 bp, Homo sapiens
  source 1..203: mol_type = other DNA
ggcgcgccagtcctgaggccggccgccggcactggattgcttctgtctggcggcggcagcatggcggcgggggcggctgaggcagctgtagcggccgtggaggaggtcggctcagccgggcactttgaggagctgctgtgcctcaaagccaagtccctccttgtggtccatttctgggcaccatgggccgactcggaccgatg

SEQ ID NO: 10362 - DNA, 203 bp, Homo sapiens
  source 1..203: mol_type = other DNA
ggcgcgccagtcctcttcccggccgccggcactggattgcttctgtctggcggcggcagcatggcggcgggggcggctgaggcagctgtagcggccgtggaggaggtcggctcagccgggcagtttgaggagctgctgtgcctcaaagccaagtccctccttgtggtccatttctgggcaccatgggccgactcggaccgatg

SEQ ID NO: 10363 - DNA, 203 bp, Homo sapiens
  source 1..203: mol_type = other DNA
ggcgcgccagtcctttaataggccgccgggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggccgactcggaccgatg

SEQ ID NO: 10364 - DNA, 203 bp, Homo sapiens
  source 1..203: mol_type = other DNA
ggcgcgccagtcctagcgccggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcgactcggaccgatg

SEQ ID NO: 10365 - DNA, 203 bp, Homo sapiens
  source 1..203: mol_type = other DNA
ggcgcgccagtcctagttctggcgattgcgtcccagaaccgacgtcccaccgccttcccacatcggatcgcagggctcccaaaatggcgagtgaggctgcggggactcgctgagcagcggaaggggagcgtgcagagccgctgcggccctcacagtccggagcccggccgtgccgtgccgtagggaaccgactcggaccgatg

SEQ ID NO: 10366 - DNA, 203 bp, Homo sapiens
  source 1..203: mol_type = other DNA
ggcgcgccagtcctttgtcgggcggccgggactggattgcttctgtctggcggcggcagcatggcggcgggggcggctgaggcagctgtagcggccgtggaggaggtcggctcagccgggcagtttgaggagctgctgcgcctcaaagccaagtccctccttgtggtccatttctgggcaccatgggccgactcggaccgatg

SEQ ID NO: 10367 - DNA, 203 bp, Homo sapiens
  source 1..203: mol_type = other DNA
ggcgcgccagtccttcatgcggctcggccgccagtcggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccacccgactcggaccgatg

SEQ ID NO: 10368 - DNA, 203 bp, Homo sapiens
  source 1..203: mol_type = other DNA
ggcgcgccagtccttgattgggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgcccgactcggaccgatg

SEQ ID NO: 10369 - DNA, 203 bp, Homo sapiens
  source 1..203: mol_type = other DNA
ggcgcgccagtcctatcctaggctgagacctctctcccagagctggggggagaggacaaagccacgccttgccccagcatcctggagctggaggagctcctgcgggcagggaagtcttcttgcagccgtgtggacgaagtttggcccaaccttttcataggagatgtagctggtccttactccctgcccgactcggaccgatg

SEQ ID NO: 10370 - DNA, 203 bp, Homo sapiens
  source 1..203: mol_type = other DNA
ggcgcgccagtcctgacacaggctgagacctctctcctagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgcccgactcggaccgatg

SEQ ID NO: 10371 - DNA, 203 bp, Homo sapiens
  source 1..203: mol_type = other DNA
ggcgcgccagtccttaacaaggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgcccggcgactcggaccgatg

SEQ ID NO: 10372 - DNA, 203 bp, Homo sapiens
  source 1..203: mol_type = other DNA
ggcgcgccagtcctcgtaggggctgccggccggcggccccgcgctcgcccgccccgcttccgcccgctgtcctgctgcacgaacccttccaactctcctttcctcccccacccttgagttacccctctgtctttcctgctgtttcgcgggtgctcccacagcggagcggagattacagagccgccgggcgactcggaccgatg

SEQ ID NO: 10373 - DNA, 203 bp, Homo sapiens
  source 1..203: mol_type = other DNA
ggcgcgccagtcctcaaagaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacgactcggaccgatg

SEQ ID NO: 10374 - DNA, 203 bp, Homo sapiens
  source 1..203: mol_type = other DNA
ggcgcgccagtcctcatgcgggcttactgaggctggtggagggagccactgctgggctcaccatggaccgctggatgtggggggcccacgtcttctgcgtgttgagcccgttaccgaccgtattgggccacatgcacccagaatgtgacttcatcacccagctgagagaggatgagagtgcctgtctacgactcggaccgatg

SEQ ID NO: 10375 - DNA, 203 bp, Homo sapiens
  source 1..203: mol_type = other DNA
ggcgcgccagtccttcgatggggcagccggccgtgcgcctgcgcggtggcccttccatcccggcagtcgtggctgcagcgctgaggcgagaggttgttgggtgtctccggccacaatgacccaggctgagaagggtgatacggagaacggaaaggagaagggcggcgagaaggagaaggagcagcgcgcgactcggaccgatg

SEQ ID NO: 10376 - DNA, 203 bp, Homo sapiens
  source 1..203: mol_type = other DNA
ggcgcgccagtcctcagaaggggcattgcccccagtctcccccaaatttggccattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 10377 - DNA, 203 bp, Homo sapiens
  source 1..203: mol_type = other DNA
ggcgcgccagtcctcgcaacggggtccgtcctggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacgactcggaccgatg

SEQ ID NO: 10378 - DNA, 203 bp, Homo sapiens
  source 1..203: mol_type = other DNA
ggcgcgccagtcctggagcgggtaggcatttaaaaatgtgtgtgtatgtgtatatatgtatgtgtatgtatgtgtatatatgtatatgtatgtatgtatcgcgtgtatgtgtgtatgtatgcatgtgtatgtatgtatatgtatgtatgtgtatgtgtatatatgtatgtgtgtgtatgtatatgtgtcgactcggaccgatg

SEQ ID NO: 10379 - DNA, 203 bp, Homo sapiens
  source 1..203: mol_type = other DNA
ggcgcgccagtcctaaacgcggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaacgactcggaccgatg

SEQ ID NO: 10380 - DNA, 203 bp, Homo sapiens
  source 1..203: mol_type = other DNA
ggcgcgccagtcctggctggggtcccagactccccccagcacagcagagcgcttccctgcccacccgcggaaaccgccccaggtgggccgcgcccccgccccagcagccagcagggcgccagggctgagccggccgtggaggggagcgggtcccgcgggttatacaggcgccggggctccgcggcaggcgactcggaccgatg

SEQ ID NO: 10381 - DNA, 203 bp, Homo sapiens
  source 1..203: mol_type = other DNA
ggcgcgccagtcctgcacccggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggcaggcgactcggaccgatg

SEQ ID NO: 10382 - DNA, 203 bp, Homo sapiens
  source 1..203: mol_type = other DNA
ggcgcgccagtcctacctcgggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtacccgactcggaccgatg

SEQ ID NO: 10383 - DNA, 203 bp, Homo sapiens
  source 1..203: mol_type = other DNA
ggcgcgccagtccttatcctggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtccccgactcggaccgatg

SEQ ID NO: 10384 - DNA, 203 bp, Homo sapiens
  source 1..203: mol_type = other DNA
ggcgcgccagtcctaggacgggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagtggtgcccgcccggccgtcagtacccgactcggaccgatg

SEQ ID NO: 10385 - DNA, 203 bp, Homo sapiens
  source 1..203: mol_type = other DNA
ggcgcgccagtccttgcgttggtcccctccgcctgacgctcctctctgtctcagccaggactggtttctgtaagaaatagcaggagctgtggcagcggcgaaaggaagcggctgaggcgcttggaacccgaaaagtctcggtgctcctggctacctcgcacagcggtgcccgcccggccgtcagtacccgactcggaccgatg

SEQ ID NO: 10386 - DNA, 203 bp, Homo sapiens
  source 1..203: mol_type = other DNA
ggcgcgccagtcctcgcccgggtcgcggcaaaggcggtaaaggtttgggtaagggagatgctaagcgtcaccgaaaagtgctgcgggataacatccaaggcatcaccaaaccggccattcggcgccttgctaggcgtggtggggttaagcgaatttccggtttgatttatgaggagactcgtggcgttcgactcggaccgatg

SEQ ID NO: 10387 - DNA, 203 bp, Homo sapiens
  source 1..203: mol_type = other DNA
ggcgcgccagtcctaaggaaggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttcgactcggaccgatg

SEQ ID NO: 10388 - DNA, 203 bp, Homo sapiens
  source 1..203: mol_type = other DNA
ggcgcgccagtcctatcaagggtcgcggcaaaggcggtaaaggtttgggtaagggaggtgctaagcgtcaccgaaaagtgctgcgggataacatccaaggcatcaccaaaccggccattcggcgccttgctaggcgtggtggggttaagcgaatttccggtttgatttatgaggagactcgtggcgttcgactcggaccgatg

SEQ ID NO: 10389 - DNA, 203 bp, Homo sapiens
  source 1..203: mol_type = other DNA
ggcgcgccagtcctcggtgaggttcgcagcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccacgactcggaccgatg

SEQ ID NO: 10390 - DNA, 203 bp, Homo sapiens
  source 1..203: mol_type = other DNA
ggcgcgccagtccttttgatggttcgcggcgctgggagcggccgtgacgtcaggcgcccggctgctcctcacttgctctgagacaggtgcggcaagtctactgcgggctggtccgggctcctcaggttcagacccgaccgttatccactcggttcgtggagaggagaggtgcactttacaggtccccgcgactcggaccgatg

SEQ ID NO: 10391 - DNA, 203 bp, Homo sapiens
  source 1..203: mol_type = other DNA
ggcgcgccagtccttactgtggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagagcagaggtgcactttacaggtccccacgactcggaccgatg

SEQ ID NO: 10392 - DNA, 203 bp, Homo sapiens
  source 1..203: mol_type = other DNA
ggcgcgccagtccttcggacggttcgcggcgctgggagcggccgtgacgtcaggcgcccggctgctcctcacttgctctgagacaggtgcggcaagtctactgtgggctggtccgggctcctcaggttcagacccgaccgttatccagtcggttcgtggagaggagaggtgcactttacaggtccccacgactcggaccgatg

SEQ ID NO: 10393 - DNA, 203 bp, Homo sapiens
  source 1..203: mol_type = other DNA
ggcgcgccagtcctaccagcgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacacctccaatcccagacgctcgactcggaccgatg

SEQ ID NO: 10394 - DNA, 203 bp, Homo sapiens
  source 1..203: mol_type = other DNA
ggcgcgccagtcctagcgccgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 10395 - DNA, 203 bp, Homo sapiens
  source 1..203: mol_type = other DNA
ggcgcgccagtcctggcgaagtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagatgctcgactcggaccgatg

SEQ ID NO: 10396 - DNA, 203 bp, Homo sapiens
  source 1..203: mol_type = other DNA
ggcgcgccagtcctcacttggtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcgactcggaccgatg

SEQ ID NO: 10397 - DNA, 203 bp, Homo sapiens
  source 1..203: mol_type = other DNA
ggcgcgccagtccttggcgcgtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 10398 - DNA, 203 bp, Homo sapiens
  source 1..203: mol_type = other DNA
ggcgcgccagtccttgattgtaaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcgactcggaccgatg

SEQ ID NO: 10399 - DNA, 203 bp, Homo sapiens
  source 1..203: mol_type = other DNA
ggcgcgccagtcctatcctataaaacggacatctccagcgtgggtggctcctttttctttttctttttttcccacccttcaggaagtggacgtttcgtaatcttctgatccttgcaccttcttttggggcaaacggggcccttctgcccagatcccctctcttttctcggaaaacaaactactaagtccgactcggaccgatg

SEQ ID NO: 10400 - DNA, 203 bp, Homo sapiens
  source 1..203: mol_type = other DNA
ggcgcgccagtccttaacaataaaacggacatctccagcgtgggtggctcctttttctttttctttttttcccacccttcaggaagtggacgtttcgttgtcttctgatccttgcaccttcttttggggcaaacggggcccttctgcccagatcccctctcttttctcggaaaacaaactactaagtccgactcggaccgatg

SEQ ID NO: 10401 - DNA, 203 bp, Homo sapiens
  source 1..203: mol_type = other DNA
ggcgcgccagtcctataccttaacaaacgggaggaggaagcgattctggggtttctgtgttgaacggttcttgtccgcgaagatgcgcttcggcctctgtcaggggacttgaacgggcttagtgggcttcagccagcttttctccaccggttccccacggagacccccccccccccccggccgttgcacgactcggaccgatg

SEQ ID NO: 10402 - DNA, 203 bp, Homo sapiens
  source 1..203: mol_type = other DNA
ggcgcgccagtcctgagcgttacaacacccgagcaaggacgcgactctcccgacgtggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 10403 - DNA, 203 bp, Homo sapiens
  source 1..203: mol_type = other DNA
ggcgcgccagtcctcaaagatacaacacccgagcaaggacgcgactctctcgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 10404 - DNA, 203 bp, Homo sapiens
  source 1..203: mol_type = other DNA
ggcgcgccagtcctgttatgtacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaattactctatccgtcgactcggaccgatg

SEQ ID NO: 10405 - DNA, 203 bp, Homo sapiens
  source 1..203: mol_type = other DNA
ggcgcgccagtcctaatacctcagtgcctgaggcagagactgcgagaaaaaaacgcgcttcattccttcttccaccgccatactgtattttatactaaatctcatttttattccaacattttactcccgctcgatatagcccttggcgaggtgcctggctccatagattaaagcaaggagagccaatccgactcggaccgatg

SEQ ID NO: 10406 - DNA, 203 bp, Homo sapiens
  source 1..203: mol_type = other DNA
ggcgcgccagtcctggagcgtccctactcccagtctccacccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggaccgactcggaccgatg

SEQ ID NO: 10407 - DNA, 203 bp, Homo sapiens
  source 1..203: mol_type = other DNA
ggcgcgccagtcctcattattcccttctgatggtgaatgggaactcccttcctcctgcagcagcctgcctgcagctgtcctggtagaacagtgtggacattgcagaagctgtcactgtcccagaaagaaagcaccccagagccaaggcaaagagtcttgaaagcgccacaagcagcagctgctgagcccgactcggaccgatg

SEQ ID NO: 10408 - DNA, 203 bp, Homo sapiens
  source 1..203: mol_type = other DNA
ggcgcgccagtcctacgggttccgactcgccctcggccttccgcgccagccgcagccacagccgcaacgccacccgcagccacagccacagccacagccccaggcatagccttcggcacagccccggctccggctcctgcgacagctcctctgggcaccgtccctgcgccgacatcctggaggttgggcgactcggaccgatg

SEQ ID NO: 10409 - DNA, 203 bp, Homo sapiens
  source 1..203: mol_type = other DNA
ggcgcgccagtcctgctacttccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggcgactcggaccgatg

SEQ ID NO: 10410 - DNA, 203 bp, Homo sapiens
  source 1..203: mol_type = other DNA
ggcgcgccagtcctaaacgctccgactcgccctcggccttccgcgccagccgcagcgacagccgcaacgccacccgcagccacagccacagccacagccccaggcatagccttcggcacagccccggctccggctcctgcgacagctcctctgggcaccgtccctgcgccgacatcctggaggttgggcgactcggaccgatg

SEQ ID NO: 10411 - DNA, 203 bp, Homo sapiens
  source 1..203: mol_type = other DNA
ggcgcgccagtcctcagctctcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactccgactcggaccgatg

SEQ ID NO: 10412 - DNA, 203 bp, Homo sapiens
  source 1..203: mol_type = other DNA
ggcgcgccagtcctgaggcctcggtgcagactccggttctccccaaccccgggcctgggcagctggacactggggcgccgttccccacccggcgcggacttcggaaccggccctgggactgactggctctaccactcgagcgcgtctccgctggacccggaatcccggtcggtccattccccgcgaagcgactcggaccgatg

SEQ ID NO: 10413 - DNA, 203 bp, Homo sapiens
  source 1..203: mol_type = other DNA
ggcgcgccagtccttactgttcggtgcagactccggttctccccaaccccgggcctgggcagctgggcactggggcgccgttccccacccggcgcggacttcggaaccggccctgggactgactggctctaccactcgagcgcgtctccgctggacccggaatcccggtcggtccattccccgcgaagcgactcggaccgatg

SEQ ID NO: 10414 - DNA, 203 bp, Homo sapiens
  source 1..203: mol_type = other DNA
ggcgcgccagtcctggtggctctgccgccgccgctgccttttttttttctcgagctcttgagatctccggttgggattcctgcggattgacatttctgtgaagcagaagtctgggaatcgatctggaaatcctcctaatttttactccctctccccccgactgctgattcattgggaagtttcaaatccgactcggaccgatg

SEQ ID NO: 10415 - DNA, 203 bp, Homo sapiens
  source 1..203: mol_type = other DNA
ggcgcgccagtcctagcgcctctgtggagagtcctgctgccctccagccgggctcctccaccggcccttgcaggggcgcagagagctcggcgcccgcccttccgctcgcctttttcgtcagccggctggagcagcatgggtccgggaggtctctgggctgaggcggcgacagctcctctagttccacccgactcggaccgatg

SEQ ID NO: 10416 - DNA, 203 bp, Homo sapiens
  source 1..203: mol_type = other DNA
ggcgcgccagtcctactctttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 10417 - DNA, 203 bp, Homo sapiens
  source 1..203: mol_type = other DNA
ggcgcgccagtcctttgtcgtcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggccttgattctacaggttattatgaccaggaacgactcggaccgatg

SEQ ID NO: 10418 - DNA, 203 bp, Homo sapiens
  source 1..203: mol_type = other DNA
ggcgcgccagtcctgtttgttgaaaaactggagcctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcaggccgaacgactcggaccgatg

SEQ ID NO: 10419 - DNA, 203 bp, Homo sapiens
  source 1..203: mol_type = other DNA
ggcgcgccagtccttcgatgtgagggctttttggagctcgctatgcttaacctggagatgattaaggccccgcttcctggcctcccagcctctaatgccaaaagataagggagaggctggcgtgtgaccccgttttgagtcaggtggacagagggctggccaccttcggaaccatgggtgcaatacggcgactcggaccgatg

SEQ ID NO: 10420 - DNA, 203 bp, Homo sapiens
  source 1..203: mol_type = other DNA
ggcgcgccagtcctgcgtagtgaggtgtagacgccaactctccctagctcgctagtgggttgcaggaggtgcttacacatgtttgtttctttgctgccgtcttccagttgctttatctgttcacttgtgccctgactttcaactctgtctccttcctcttcctacagtactcccctgccctcaacaagcgactcggaccgatg

SEQ ID NO: 10421 - DNA, 203 bp, Homo sapiens
  source 1..203: mol_type = other DNA
ggcgcgccagtccttggtattgaggtgtagacgccaactctctctagctcgctagtgggttgcaggaggtgcttacgcatgcttgtttctttgctgccgtcttccagttgctttatctgttcacttgtgccctgactttcaactctgtctccttcctcttcctacagtactcccctgccctcaacaagcgactcggaccgatg

SEQ ID NO: 10422 - DNA, 203 bp, Homo sapiens
  source 1..203: mol_type = other DNA
ggcgcgccagtcctagaggatgaggtgtagacgccaactctctctagctcgctagtgggttgcaggtggtgcttacacatgtttgtttctttgctgccgtcttccagttgctttatctgttcacttgtgccctgactttcaactctgtctccttcctcttcctacagtactcccctgccctcaacaagcgactcggaccgatg

SEQ ID NO: 10423 - DNA, 203 bp, Homo sapiens
  source 1..203: mol_type = other DNA
ggcgcgccagtcctggtcagtgagtcggagctctatggaggcggcagcgggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 10424 - DNA, 203 bp, Homo sapiens
  source 1..203: mol_type = other DNA
ggcgcgccagtcctgccgtctgagtcggggctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 10425 - DNA, 203 bp, Homo sapiens
  source 1..203: mol_type = other DNA
ggcgcgccagtcctcacggctgatccggggctcggccaagctgaggcggcggcgcccggccgtgcgcccagctttcaggcgcctggctctcacgatgatgaagaagaagaagtttaagtttaaggtggacttcgagctcgaggagctctcctcagtgcccttcgtcaatggggtcctcttctgcaagacgactcggaccgatg

SEQ ID NO: 10426 - DNA, 203 bp, Homo sapiens
  source 1..203: mol_type = other DNA
ggcgcgccagtcctggagcgtgctcctctacctgctccaccctcaatccaccagaaccatgggctgctgtggctgctccagaggctgtggctccggctgtgggggctgtggctccagctgtgggggttgtggctctggctgtgggggctgtggctccggccgtgggggctgtggctctggctgtggggcgactcggaccgatg

SEQ ID NO: 10427 - DNA, 203 bp, Homo sapiens
  source 1..203: mol_type = other DNA
ggcgcgccagtcctgctacttggaagcgccccagccccgcagcgatcgcagattcggctttcaaacaaaagaggcgccccggggggtgggaccgggacctcacccggtcctcgcagagttgcggccgccctccccttcagccccggctctccgtatgcgcatgagcagaggcgcctccctctgttcctcgactcggaccgatg

SEQ ID NO: 10428 - DNA, 203 bp, Homo sapiens
  source 1..203: mol_type = other DNA
ggcgcgccagtcctgcaccctggagcctccagagggctgtcggcgcagtagcagcgagcagcagagtccgcacgctccggcgaggggcagaagagcgcgagggagcgcggggcagcagaagcgagagccgagcgcggacccagccaggacccagagccctccccagctgcccaggaagagccccagcccgactcggaccgatg

SEQ ID NO: 10429 - DNA, 203 bp, Homo sapiens
  source 1..203: mol_type = other DNA
ggcgcgccagtcctcgacgttggcgctggcctgctgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagcgactcggaccgatg

SEQ ID NO: 10430 - DNA, 203 bp, Homo sapiens
  source 1..203: mol_type = other DNA
ggcgcgccagtcctgcaaggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 10431 - DNA, 203 bp, Homo sapiens
  source 1..203: mol_type = other DNA
ggcgcgccagtcctcgatcctgttcagtacgccacaagcgacacaaatgaacacgccttctcagccccgccagcacttctaccctagccgggcccagcccccgagcagtgcagcctcccgagtgcagagtgcagcccctgcccgctctggcccagctgcccatgtctaccctgctggatcccaagtaacgactcggaccgatg

SEQ ID NO: 10432 - DNA, 203 bp, Homo sapiens
  source 1..203: mol_type = other DNA
ggcgcgccagtcctcagctctgttgcctgttccactaggaatattgtttgcaaggcacaaggtgtcttttggtagtgagcgcgctctgcgcatgcgcagttccattcgggaattactgcccagcagccgactaagttgcattccttgaatcttcgcagaaaagacaattcttttaatcagagttagtacgactcggaccgatg

SEQ ID NO: 10433 - DNA, 203 bp, Homo sapiens
  source 1..203: mol_type = other DNA
ggcgcgccagtcctgtccgctgtttcccgtcccccgcccgcgagaagtgggggtgaaaagcggcccgacctgcttgcggtgtagtggggggaccgcgcggctggaggtgtgaggatccgaacccaggggtggggggtggaggcggctcctgcgatcgaaggggacttgagactcaccggccgcacgcccgactcggaccgatg

SEQ ID NO: 10434 - DNA, 203 bp, Homo sapiens
  source 1..203: mol_type = other DNA
ggcgcgccagtccttgggcatgtttcccgtcccccgcccgcgagaagtgggggtgaaaagcggcccgacctgcttggggtgtagtggggggaccgcgcggctggaggtgtgaggatccgaacccaggggtggggggtggaggcggctcctgcgatcgaaggggacttgagacttaccggccgcacgcccgactcggaccgatg

SEQ ID NO: 10435 - DNA, 203 bp, Homo sapiens
  source 1..203: mol_type = other DNA
ggcgcgccagtcctggtggcttataaaaaacccagtctttgctgaccagacaaagcataccagatctcaccagagagtcctaggggactacagaaggaaaaagacaagaggcagcaggatatctgtgtgtcctcccgctgaccacacttcctttagtgacccgattgcctcctcaagtcgcagacactcgactcggaccgatg

SEQ ID NO: 10436 - DNA, 203 bp, Homo sapiens
  source 1..203: mol_type = other DNA
ggcgcgccagtcctttgtcgttcaaagtctaactttgacagacaaccttacttccagcgaagtctactcccctccctccggagggaagaatgaatgggctgcggttaagcgtttgccctggtgtcagggccaactgcttcgaagcgccagactttcggagactgtgggtggggagcattaagcgggaacgactcggaccgatg

SEQ ID NO: 10437 - DNA, 203 bp, Homo sapiens
  source 1..203: mol_type = other DNA
ggcgcgccagtcctgctcgattccagggccgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggcactgctgacgactcggaccgatg

SEQ ID NO: 10438 - DNA, 203 bp, Homo sapiens
  source 1..203: mol_type = other DNA
ggcgcgccagtcctgtttgtttccagggccgccgtccacactctcccggtcagagtcctgggaccacatggggacgctgccatggcttcttgccttcttcattctgggtctccaggtttgggatactcccaccatcgtctcccgcaaggagtggggggcaagaccgctcgcctgcagggccctgctgacgactcggaccgatg

SEQ ID NO: 10439 - DNA, 203 bp, Homo sapiens
  source 1..203: mol_type = other DNA
ggcgcgccagtcctatcctattccagggctgccgtccacactctcccggtcagagtcctgggaccacatggggacgctcccatggcttcttgccttcttcattctgggtctccaggcttgggatactcccaccatcgtctcccgcaaggagtggggggcaagaccgctcgcctgcagggccctgctgacgactcggaccgatg

SEQ ID NO: 10440 - DNA, 203 bp, Homo sapiens
  source 1..203: mol_type = other DNA
ggcgcgccagtcctatacctttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgacgactcggaccgatg

SEQ ID NO: 10441 - DNA, 203 bp, Homo sapiens
  source 1..203: mol_type = other DNA
ggcgcgccagtcctccataatttcttggctaagccgcgtttgtattgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaagcgactcggaccgatg

SEQ ID NO: 10442 - DNA, 203 bp, Homo sapiens
  source 1..203: mol_type = other DNA
ggcgcgccagtcctgcgtagtttcttggctaagccgtgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaagcgactcggaccgatg

SEQ ID NO: 10443 - DNA, 203 bp, Homo sapiens
  source 1..203: mol_type = other DNA
ggcgcgccagtccttggtattttgcgaattacacatctctttgattatgttgcgactagttttgttagatagtcatttagtgtttgggatacctgttaagccctttgtccagggactgtggttggatttatgaattatttggacggttgtccacttgaaagaactgacagtagcttcataacaatgttcgactcggaccgatg

SEQ ID NO: 10444 - DNA, 203 bp, Homo sapiens
  source 1..203: mol_type = other DNA
ggcgcgccagtcctttgtcgaaggctctgtggaggcccagggactcctcacccagctccagcgccagcgcagcctcctagcccaccagccctttgaggagcacttggaccactgggtctcggcctaccacctgctggagtggctggtggagcagcagcagccccttcaagagtacaagggcaggcacccgactcggaccgatg

SEQ ID NO: 10445 - DNA, 203 bp, Homo sapiens
  source 1..203: mol_type = other DNA
ggcgcgccagtcctcacttgaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcacccgactcggaccgatg

SEQ ID NO: 10446 - DNA, 203 bp, Homo sapiens
  source 1..203: mol_type = other DNA
ggcgcgccagtcctgctcgaaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgactcggaccgatg

SEQ ID NO: 10447 - DNA, 203 bp, Homo sapiens
  source 1..203: mol_type = other DNA
ggcgcgccagtccttcagctaagtgtctcccactgaaggcatccgtggttgtttttaagccacaaaaaagccacacccaagatcacctgacacccaccctgtcaagtgtccatgatgctgggccctgagggaggtgaaggctttgtggtcaagctccgtggcctgccctggtcctgctctgttgaggacgactcggaccgatg

SEQ ID NO: 10448 - DNA, 203 bp, Homo sapiens
  source 1..203: mol_type = other DNA
ggcgcgccagtcctgtttgtaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgccgactcggaccgatg

SEQ ID NO: 10449 - DNA, 203 bp, Homo sapiens
  source 1..203: mol_type = other DNA
ggcgcgccagtccttgattgacgaggcaggcggaagaggcgggacttcgcgggtgacgtcatcggggcgccggaggcccggggcgcctgggaatttgaagcaaacaggcagcgcgcgacaatggcggtcgctcgtgcagctttggggccattggtgacgggtctgtacgacgtgcaggctttcaagttcgactcggaccgatg

SEQ ID NO: 10450 - DNA, 203 bp, Homo sapiens
  source 1..203: mol_type = other DNA
ggcgcgccagtcctgacacaacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatccgactcggaccgatg

SEQ ID NO: 10451 - DNA, 203 bp, Homo sapiens
  source 1..203: mol_type = other DNA
ggcgcgccagtccttaacaaacgtgggtgggggaagctgagggctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatccgactcggaccgatg

SEQ ID NO: 10452 - DNA, 203 bp, Homo sapiens
  source 1..203: mol_type = other DNA
ggcgcgccagtcctatacctactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagcgactcggaccgatg

SEQ ID NO: 10453 - DNA, 203 bp, Homo sapiens
  source 1..203: mol_type = other DNA
ggcgcgccagtcctcgtaggactctacagctcagaacaccaactgctaaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagtcgactcggaccgatg

SEQ ID NO: 10454 - DNA, 203 bp, Homo sapiens
  source 1..203: mol_type = other DNA
ggcgcgccagtcctattgtcagatgtcagcccaggagagctgcctcagcctcatcaagtcctcggcagcctgatcttctgcttcggcatctggatcctcatcgacaagaccagcttcgtgtcctttgtgggcttggccttcgtgcctctgcagatctggtccaaagtcctggccatctcaggaatcttcgactcggaccgatg

SEQ ID NO: 10455 - DNA, 203 bp, Homo sapiens
  source 1..203: mol_type = other DNA
ggcgcgccagtcctgcgtagagctctaatgccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttccgactcggaccgatg

SEQ ID NO: 10456 - DNA, 203 bp, Homo sapiens
  source 1..203: mol_type = other DNA
ggcgcgccagtcctttcggaaggtacataagttccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactcgactcggaccgatg

SEQ ID NO: 10457 - DNA, 203 bp, Homo sapiens
  source 1..203: mol_type = other DNA
ggcgcgccagtcctgtcgctatcctctctcttgccgttcgagagccccagtgaaacttgagtgagatgagagagcatggagcctgccagtctccccctctgcgcacacacacacgcaaacacatttaactttccacttgcagtgacctgcccttcagtgtgacttatcagctgtttggcttttgtcaccgactcggaccgatg

SEQ ID NO: 10458 - DNA, 203 bp, Homo sapiens
  source 1..203: mol_type = other DNA
ggcgcgccagtcctccgaccatcctctctcttgccgttcgagagccccagtgaaacttgagtgagatgagagagcatggagcctgccagtctccccctctgtgcacacacacacgcaaacacatttaactttccacttgcagtgacctgcccttcagtgtgacttatcagctgtttggcttttgtcaccgactcggaccgatg

SEQ ID NO: 10459 - DNA, 203 bp, Homo sapiens
  source 1..203: mol_type = other DNA
ggcgcgccagtccttcccagcactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagaccgactcggaccgatg

SEQ ID NO: 10460 - DNA, 203 bp, Homo sapiens
  source 1..203: mol_type = other DNA
ggcgcgccagtcctaaacgccagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttcgactcggaccgatg

SEQ ID NO: 10461 - DNA, 203 bp, Homo sapiens
  source 1..203: mol_type = other DNA
ggcgcgccagtcctgcaccccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagacgactcggaccgatg

SEQ ID NO: 10462 - DNA, 203 bp, Homo sapiens
  source 1..203: mol_type = other DNA
ggcgcgccagtccttatcctcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaacacgactcggaccgatg

SEQ ID NO: 10463 - DNA, 203 bp, Homo sapiens
  source 1..203: mol_type = other DNA
ggcgcgccagtcctctctcacatgaactgggaagagtagctgagccccagagcctctctggaagagaaaggaagagccagcagttctttctcccagtgtcccacctcactgtccagcgtcttcctctgcccctgctctgccctccctggctcctggactagagcccggcttccagcaggacgtttccccgactcggaccgatg

SEQ ID NO: 10464 - DNA, 203 bp, Homo sapiens
  source 1..203: mol_type = other DNA
ggcgcgccagtccttgcgttcatgaactgggaagagtagctgagccccagagcctctctggaagagaaaggaagagccagcagttctttctcccagtgtccgacctcactgtccagcgtcttcctctgcccctgctctgccctccctggctcctggactagagcccggcttccagcaggacgtttccccgactcggaccgatg

SEQ ID NO: 10465 - DNA, 203 bp, Homo sapiens
  source 1..203: mol_type = other DNA
ggcgcgccagtcctcgcccgcatgcgcgcttccttgcgcgagccgggctgtcgggtgtgttttgctctccagcctccgtcgtctctgcagcactccgggttctcctccagagcgctagtcccaggagctcggaatgttcgtggaacttaataacctgcttaacaccacccccgacagggcggagcaggcgactcggaccgatg

SEQ ID NO: 10466 - DNA, 203 bp, Homo sapiens
  source 1..203: mol_type = other DNA
ggcgcgccagtcctcagctcccccttggagctctgcatctccaacctggaacccaacccagaagtctcaagtttgacgcatcacgtggcgtgcggatccaccgagggtccacagagaggggcgcccatctcctgcgtctcagttatcctggtgttgggaattctgtgccctaaagaattccgactcagcgactcggaccgatg

SEQ ID NO: 10467 - DNA, 203 bp, Homo sapiens
  source 1..203: mol_type = other DNA
ggcgcgccagtcctcggtgaccctcggctcccacccttgtgtacctgggccgaaccattcaccggagcgcgcagcgggtggagtgtggctcggaggaccgcagcgggtcaagcacctttctcccccatatctgaaagcatgccctttgtccacgtcgtttacgctcattaaaacttccagaatgcaaccgactcggaccgatg

SEQ ID NO: 10468 - DNA, 203 bp, Homo sapiens
  source 1..203: mol_type = other DNA
ggcgcgccagtcctcttcccccgaacctgaaaccgggagcttcctgctcgtgttcgctgttgagaagctacccgcggggttgtagacctcggacctcatggcagagataattcaggaacgcatagaagatcggctcccggaattggaacagctggagcgcattggactgttcagtcatgcggagattacgactcggaccgatg

SEQ ID NO: 10469 - DNA, 203 bp, Homo sapiens
  source 1..203: mol_type = other DNA
ggcgcgccagtccttgggcaccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtccgactcggaccgatg

SEQ ID NO: 10470 - DNA, 203 bp, Homo sapiens
  source 1..203: mol_type = other DNA
ggcgcgccagtcctgaatctccgcgacttcgatccggcgctgctggagttcctggtgtgcccgctctccaagaagccgctcagatatgaagcatcaacaaacgaattgattaatgaagagttgggaatagcttatccaatcattgatgggatccctaatatgataccacaggcagctaggatgacacgcgactcggaccgatg

SEQ ID NO: 10471 - DNA, 203 bp, Homo sapiens
  source 1..203: mol_type = other DNA
ggcgcgccagtcctggtggcccgcgacttcgatccggcgctgctggagttcctggtgtgcccgctctccaagaagccgctcagatatgaagcatcaacaaatgaattgattaatgaagagttgggaatagcttatccaatcattgatgggatccctaatatgataccacaggcagctaggatgacacgcgactcggaccgatg

SEQ ID NO: 10472 - DNA, 203 bp, Homo sapiens
  source 1..203: mol_type = other DNA
ggcgcgccagtcctggcgaaccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctcccgactcggaccgatg

SEQ ID NO: 10473 - DNA, 203 bp, Homo sapiens
  source 1..203: mol_type = other DNA
ggcgcgccagtcctttcaccccgcggctctcccacctgtcaccctggcccttctctgcttggatggtgtcttcctctcctcagccgagaatgacttcgtccgccggatccaggaggaactggaccgctttctgctgcagaagcagctgtcaaaggttcttcttttccccccactctccagtcgcctcccgactcggaccgatg

SEQ ID NO: 10474 - DNA, 203 bp, Homo sapiens
  source 1..203: mol_type = other DNA
ggcgcgccagtcctagttctccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggacgactcggaccgatg

SEQ ID NO: 10475 - DNA, 203 bp, Homo sapiens
  source 1..203: mol_type = other DNA
ggcgcgccagtcctgctcgacctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggctcgactcggaccgatg

SEQ ID NO: 10476 - DNA, 203 bp, Homo sapiens
  source 1..203: mol_type = other DNA
ggcgcgccagtccttcagctcctgatacataaatcagacagcctctgctgcatgacacgaagcttgcttctgcctggcatctgtgagcagctgccaggctctggccaggatcccttccttctcctcattggctgatggatcccaaggggctcctctccttgaccttcgtgctgtttctctccctggctcgactcggaccgatg

SEQ ID NO: 10477 - DNA, 203 bp, Homo sapiens
  source 1..203: mol_type = other DNA
ggcgcgccagtccttcatgcccttggagcgcgcgggaaagagaccaatataaactgtggcgggatagttttcgggtccttgtccagtgaaacaccctcggccgggaagtcagttcgttctctcctctcctctcttcttgtttgaacatggtgcggactaaagcagacagtgttccaggcacttacagacgactcggaccgatg

SEQ ID NO: 10478 - DNA, 203 bp, Homo sapiens
  source 1..203: mol_type = other DNA
ggcgcgccagtcctctggtaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagacgactcggaccgatg

SEQ ID NO: 10479 - DNA, 203 bp, Homo sapiens
  source 1..203: mol_type = other DNA
ggcgcgccagtccttggcgccgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggcttcgactcggaccgatg

SEQ ID NO: 10480 - DNA, 203 bp, Homo sapiens
  source 1..203: mol_type = other DNA
ggcgcgccagtccttgattgcgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttcgactcggaccgatg

SEQ ID NO: 10481 - DNA, 203 bp, Homo sapiens
  source 1..203: mol_type = other DNA
ggcgcgccagtcctatacctcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgcgactcggaccgatg

SEQ ID NO: 10482 - DNA, 203 bp, Homo sapiens
  source 1..203: mol_type = other DNA
ggcgcgccagtcctgtagaccgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgcgactcggaccgatg

SEQ ID NO: 10483 - DNA, 203 bp, Homo sapiens
  source 1..203: mol_type = other DNA
ggcgcgccagtccttaaacgctaggtccccagatggggagactgaggccgtggctgtgtgtccctctgagagttggagcggggctgggcccgaattcgaccccagcaggattctctctcatttctgagccccggaggtggcagagcggcagacccgggcaagtgaaccctagggctgcaggagcccagcgactcggaccgatg

SEQ ID NO: 10484 - DNA, 203 bp, Homo sapiens
  source 1..203: mol_type = other DNA
ggcgcgccagtcctccataactaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccagcgactcggaccgatg

SEQ ID NO: 10485 - DNA, 203 bp, Homo sapiens
  source 1..203: mol_type = other DNA
ggcgcgccagtcctattagactgaagccagtgaaggctctctcgcctcgccctctagcgttcgtctggagtagcgccaccccggcttcctggggacacaggtttggcaccatggggcccaccagcgtcccgctggtcaaggcccaccgcagctcggtctctgactacgtcaactatgatatcatcgtccgactcggaccgatg

SEQ ID NO: 10486 - DNA, 203 bp, Homo sapiens
  source 1..203: mol_type = other DNA
ggcgcgccagtcctctagggctgtggtgggcgctgcgggtgtttgcaggaggttgcagtactcgctgggctgaggtcgtctcgggtgaggaggtcgcgccgaaagtggctctagccgtggcgcttcggcgtagtaaggagcctgcaacagagttttgttgtttagggggcgcggcaccgcaccgctcccgactcggaccgatg

SEQ ID NO: 10487 - DNA, 203 bp, Homo sapiens
  source 1..203: mol_type = other DNA
ggcgcgccagtcctaatacccttcctctgcctgcccctcctcctccttccacgttgtctcctccacctagcagttggttggcaaccccttcctcagtccccggctgaaaaccctccagtcagcgcttatcccttctgctctctcccctcacccagagaaatacatggagtttgaccttaatggaaatgcgactcggaccgatg

SEQ ID NO: 10488 - DNA, 203 bp, Homo sapiens
  source 1..203: mol_type = other DNA
ggcgcgccagtcctagaatccttgaggaccaagtttgcggccacttctgcaggcgtcccttcttagctctcgcccgcccctttctgcagcctaggcggcccaggttctcttctcttcctcgcgcgcccagccgcctcggttcccggcgaccatggtgacgatggaggagctgcgggagatggactgcacgactcggaccgatg

SEQ ID NO: 10489 - DNA, 203 bp, Homo sapiens
  source 1..203: mol_type = other DNA
ggcgcgccagtcctacaacacttgaggaccaagtttgcggccacttctgcaggcgtcccttcttagctctcgcccgcccctttctgcagcctaggcggcccgggttctcttctcttcctcgcgcgcccagccgcctcggttcccggcgaccatggtgacgatggaggagctgcgggagatggactgcacgactcggaccgatg

SEQ ID NO: 10490 - DNA, 203 bp, Homo sapiens
  source 1..203: mol_type = other DNA
ggcgcgccagtcctccaattcttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcgactcggaccgatg

SEQ ID NO: 10491 - DNA, 203 bp, Homo sapiens
  source 1..203: mol_type = other DNA
ggcgcgccagtcctggagcggaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatcgactcggaccgatg

SEQ ID NO: 10492 - DNA, 203 bp, Homo sapiens
  source 1..203: mol_type = other DNA
ggcgcgccagtcctcattatgacctagaccatgcaacccagctgatcctacgatggaaccaaggtgccagtgagatgacaacagccctgctctggtcactccggaagctgaccagtccacacacggctgaagcttgaggagacaacagccctgctctagtcaccccagaagctgactagtctatgcaccgactcggaccgatg

SEQ ID NO: 10493 - DNA, 203 bp, Homo sapiens
  source 1..203: mol_type = other DNA
ggcgcgccagtcctacgggtgacctagaccatgcaacccagctgatcctacgatggaaccaaggtgccagtgagatgacaacagccctgctctggtcactctggaagctgaccagtccacacacggctgaagcttgaggagacaacagccctgctctagtcaccccagaagctgactagtctatgcaccgactcggaccgatg

SEQ ID NO: 10494 - DNA, 203 bp, Homo sapiens
  source 1..203: mol_type = other DNA
ggcgcgccagtcctggctgggagagccaggcgagcgcggactggggcggccacgccactccgccagaaggtcgccaggagcctccgcccttcaccttcctcggaaatccgccaggccacgccaagctccctgcccaacccttactgacgggggccacattttcccggcctccgcagccagaccttgaccgactcggaccgatg

SEQ ID NO: 10495 - DNA, 203 bp, Homo sapiens
  source 1..203: mol_type = other DNA
ggcgcgccagtcctgcacccgaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcccgactcggaccgatg

SEQ ID NO: 10496 - DNA, 203 bp, Homo sapiens
  source 1..203: mol_type = other DNA
ggcgcgccagtccttatcctgagttccgctcctctctccaaccggggtccccctccagcgaccctaaagcttcccagacttccgcttcaattcctgtccgcaccccacgcccacctcaacgtggagcgcagtggtctccgaggagcgccggagctgccccgcctgcccagcggggtcagcacttcgcacgactcggaccgatg

SEQ ID NO: 10497 - DNA, 203 bp, Homo sapiens
  source 1..203: mol_type = other DNA
ggcgcgccagtcctaggacggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcggggtcagcacttcgcacgactcggaccgatg

SEQ ID NO: 10498 - DNA, 203 bp, Homo sapiens
  source 1..203: mol_type = other DNA
ggcgcgccagtccttgcgttgattctgattagttcactactgctactttccctgtggcctaggctttgcctatttccagtgggcgagctagctagatcctcgtcccttaaataagccagtgtttttaagacagaatactacttgcatagtggacaataatatcttaaagaactgagcaggatgaaaagcgactcggaccgatg

SEQ ID NO: 10499 - DNA, 203 bp, Homo sapiens
  source 1..203: mol_type = other DNA
ggcgcgccagtcctaaggaagatttgcaaaggtttttggagaggaataaatttaatgaaagatgtacatgacttctaaaaactataagcagtgctgggtaatattaaacacatgatgttcacggaagaccagggtgtagatgacaggctgctctatgacattgtattcaagcacttcaaaagaaataacgactcggaccgatg

SEQ ID NO: 10500 - DNA, 203 bp, Homo sapiens
  source 1..203: mol_type = other DNA
ggcgcgccagtcctatcaaggcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgccgactcggaccgatg

SEQ ID NO: 10501 - DNA, 203 bp, Homo sapiens
  source 1..203: mol_type = other DNA
ggcgcgccagtcctccgcatgcatctgcccggcccgggggcggaggcgcccattattcctttggctcctccgaagcgccgtaggggtgtttgttgttagagttggaagcttggcagttggcctcccttcttcccatggaggacgggggcttaacagcctttgaagaggaccagagatgcctttcccagcgactcggaccgatg

SEQ ID NO: 10502 - DNA, 203 bp, Homo sapiens
  source 1..203: mol_type = other DNA
ggcgcgccagtcctcagctcgccagggcgcctgcgcggcggggttctcggtcgccagccattcctgaggaggactgccggtcgttcggacgtcttgcctgtagctggaggagaggtccgggctctccaggaaggtggctgcggcgacaaaatgaagatattcgtgggcaacgtcgacggggcggataccgactcggaccgatg

SEQ ID NO: 10503 - DNA, 203 bp, Homo sapiens
  source 1..203: mol_type = other DNA
ggcgcgccagtcctgaggccgccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttcgactcggaccgatg

SEQ ID NO: 10504 - DNA, 203 bp, Homo sapiens
  source 1..203: mol_type = other DNA
ggcgcgccagtcctgtccgcgccccacgctgctttcccagaaggctgtgcgtgctcctcgcttcctccgcggtctttcgagcggtcgcgtgaactgcttcctgcaggctggccatggcgcttcacgttcccaaggctccgggctttgcccagatgctcaaggagggagcgaaacacttttcaggattacgactcggaccgatg

SEQ ID NO: 10505 - DNA, 203 bp, Homo sapiens
  source 1..203: mol_type = other DNA
ggcgcgccagtccttcggacgccgggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaacgactcggaccgatg

SEQ ID NO: 10506 - DNA, 203 bp, Homo sapiens
  source 1..203: mol_type = other DNA
ggcgcgccagtcctgaatctgcttctgtcctgcgcgcgcagattctcgcaaatctggaagcggatcgcgtggagtgacggtcacaccgcggcgaattaattcccaaagactcatgttacatgagaaagccaccaagaagaccaaagaaaaggagacaaggatggctcttcctcagggatgcttgacttcgactcggaccgatg

SEQ ID NO: 10507 - DNA, 203 bp, Homo sapiens
  source 1..203: mol_type = other DNA
ggcgcgccagtcctagcgccggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctcgactcggaccgatg

SEQ ID NO: 10508 - DNA, 203 bp, Homo sapiens
  source 1..203: mol_type = other DNA
ggcgcgccagtcctggcgaaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatcgactcggaccgatg

SEQ ID NO: 10509 - DNA, 203 bp, Homo sapiens
  source 1..203: mol_type = other DNA
ggcgcgccagtcctttcaccggacacgtggtacggaaccggcgccgcgcttgctgctggtaacagggccttgcctagtgggccttccttcccaggtcgcccgtcagtctccactagagacaggactgaccagttgctcttccttccaagaaccttcgagatctgcggtctggggtctggttgaaagatcgactcggaccgatg

SEQ ID NO: 10510 - DNA, 203 bp, Homo sapiens
  source 1..203: mol_type = other DNA
ggcgcgccagtcctagttctggagagggagaacacagttggagaaaatcggcagctgagacggccttggccggacttagcactcaggcctgtgaatcaggaaatacaaagacctccaaaaaaggaccagttcctcggatgtgccccctcacagagagatgaaggggcagcagaaaacagctgaaacggcgactcggaccgatg

SEQ ID NO: 10511 - DNA, 203 bp, Homo sapiens
  source 1..203: mol_type = other DNA
ggcgcgccagtcctactcttggagcagtgcggggtttaaatctgaggctaggctggctcttctcggcgtgctgcggcggaacggctgttggtttctgctggttgtaggtccttggctggtcgggcctccggtgttctgcttctccccgctgagctgctgcctggtgaagaggaagccatggcgctccgcgactcggaccgatg

SEQ ID NO: 10512 - DNA, 203 bp, Homo sapiens
  source 1..203: mol_type = other DNA
ggcgcgccagtcctgctcgaggcaacaggcagatttgcctgctgagggtggagacccacgagccgaggcctcctgcagtgttccgcacagcaaaccgcacgctatggctgacagccgggatcccgccagcgaccagatgcagcactggaaggagcagcgggccgcgcagaaagctgatgtcctgaccacgactcggaccgatg

SEQ ID NO: 10513 - DNA, 203 bp, Homo sapiens
  source 1..203: mol_type = other DNA
ggcgcgccagtccttcatgcggccgccgcccgctctcccggcgcggcagctgtctgggctgctgcgcgccgcctaggtgtctgggcgatctatgggcaagaacaagggccacgatgacagattacggcgaggagcagcgcaacgagctggaggccctggagtccatctaccctgactccttcacagctcgactcggaccgatg

SEQ ID NO: 10514 - DNA, 203 bp, Homo sapiens
  source 1..203: mol_type = other DNA
ggcgcgccagtcctgacacaggcgtccgcgtccccgcgccgagctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctcgactcggaccgatg

SEQ ID NO: 10515 - DNA, 203 bp, Homo sapiens
  source 1..203: mol_type = other DNA
ggcgcgccagtcctcgtagggggcactttcgtcttagcttttggacaagacgcaggcgcaacccacggctgctgcggggatccttgtggcccttccggtcgatggaaccaatccgtgcacagagaagcggggcgaactgaggcgagtgaagtggactctgagggctaccgctaccgccactgctgcggcgactcggaccgatg

SEQ ID NO: 10516 - DNA, 203 bp, Homo sapiens
  source 1..203: mol_type = other DNA
ggcgcgccagtcctcatgcgggtctttgcgtctggctactaccagaccgcgggttaggggcttcatctctctgcgtcctcagttgtgggaggccttggtgattcggccacagctcagcctccgtcgctctgtgacctgcgggtattggatgattggtagctaagactcccgaatacttcagaagtgggcgactcggaccgatg

SEQ ID NO: 10517 - DNA, 203 bp, Homo sapiens
  source 1..203: mol_type = other DNA
ggcgcgccagtccttcgatggtcacttcctggagactggttgaatccggaagtgaccctagagaaatgagttgtggctgaggaccccggcggcagacgcaggttcgggaccatgagctggattccttttaagattgggcagcccaagaaacagattgtgcccaaaacagtggagagagactttgaaagcgactcggaccgatg

SEQ ID NO: 10518 - DNA, 203 bp, Homo sapiens
  source 1..203: mol_type = other DNA
ggcgcgccagtcctgccgtctaatgaatcattgattgaccagcactattttaccagttggaatgaatgatcagaaatgggcatagtgctcttagatccaacatgtaacagatggatgttactccatgctgattacttcttcaagccagtacttttttgattgtgtaggatctttgtctcttcatctttcgactcggaccgatg

SEQ ID NO: 10519 - DNA, 203 bp, Homo sapiens
  source 1..203: mol_type = other DNA
ggcgcgccagtcctaatacctacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgacgactcggaccgatg

SEQ ID NO: 10520 - DNA, 203 bp, Homo sapiens
  source 1..203: mol_type = other DNA
ggcgcgccagtcctccaatttagggcttgaactgagagcctggcctcccagaaggttttaatagacctacggcacagaaattgacacagcccggaaaaggcccacaaagagaagcccaaccagccagcccccaggccgccccgccagggacccaccaatgaggcacagatggcagccgctgccgccctcgactcggaccgatg

SEQ ID NO: 10521 - DNA, 203 bp, Homo sapiens
  source 1..203: mol_type = other DNA
ggcgcgccagtcctcgcaactatttcaaggcgcgcgcctcgtggtggactcaccgctagcccgcagcgctcggcttcctggtaattcttcacctcttctctcagctccctgcagcatgggtgctgggccctccttgctgctcgccgccctcctgctgcttctctccggcgacggcgccgtgcgctgcgcgactcggaccgatg

SEQ ID NO: 10522 - DNA, 203 bp, Homo sapiens
  source 1..203: mol_type = other DNA
ggcgcgccagtcctggctggtcccgagggctggcctgagacgggactcccggttctcccgctgcgaagcagcgcggccccccggggccggggcagcggcgctggcatgtcgtctggcaccatgaagttcaatggctatttgagggtccgcatcggtgaggcagtggggctgcagcccacccgctggtccgactcggaccgatg

SEQ ID NO: 10523 - DNA, 203 bp, Homo sapiens
  source 1..203: mol_type = other DNA
ggcgcgccagtcctacctcgtcctcttctgtctgctgtctatgagggtcatgtttcctgtgtgaaattgcttctgtcaaagggtgctgataagactgtgaagggcccagatggactgaccgcctttgaagccactgacaaccaggcaatcaaagctcttctccagtgatggatggatggactgataaccgactcggaccgatg

SEQ ID NO: 10524 - DNA, 203 bp, Homo sapiens
  source 1..203: mol_type = other DNA
ggcgcgccagtcctaggacgtccttataaagacaaaatctttttctttcctggctgatgatttgtcattctagtcacttcctgccttgtgaccacacacccgggcttgacaaagctgttctgcagatcagaaagaaggggttcctggtcatacaccagtactaccaaggacagcttttttcctgcaagcgactcggaccgatg

SEQ ID NO: 10525 - DNA, 203 bp, Homo sapiens
  source 1..203: mol_type = other DNA
ggcgcgccagtcctctctcatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagcgactcggaccgatg

SEQ ID NO: 10526 - DNA, 203 bp, Homo sapiens
  source 1..203: mol_type = other DNA
ggcgcgccagtccttccttatcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcgcgactcggaccgatg

SEQ ID NO: 10527 - DNA, 203 bp, Homo sapiens
  source 1..203: mol_type = other DNA
ggcgcgccagtcctgactactcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatctcgactcggaccgatg

SEQ ID NO: 10528 - DNA, 203 bp, Homo sapiens
  source 1..203: mol_type = other DNA
ggcgcgccagtcctccgcattcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatctcgactcggaccgatg

SEQ ID NO: 10529 - DNA, 203 bp, Homo sapiens
  source 1..203: mol_type = other DNA
ggcgcgccagtcctctcagttgagaccaagggctaaagctgggaggtgagtctgtcaccttgagccgggcgagcgctgtgggccaagcaggggttgcagggtagtaggagtgcagactgaaaaaatgcagaccgccggggcattattcatttctccagctctgatccgctgttgtaccaggggtctaacgactcggaccgatg

SEQ ID NO: 10530 - DNA, 203 bp, Homo sapiens
  source 1..203: mol_type = other DNA
ggcgcgccagtcctgtccgctgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgacgactcggaccgatg

SEQ ID NO: 10531 - DNA, 203 bp, Homo sapiens
  source 1..203: mol_type = other DNA
ggcgcgccagtcctttgctttgcgcgaccggaaaattcgcgaaggttcctgaaacgcaacggatcgtttccggaagccggtagccgcctcagtcgtcagactggtgctagcgacacgggagtggcaaacgcatcctcttgccgttcccggtgtttgggccttgcctgtgacggtgggaaaagaaaatgcgactcggaccgatg

SEQ ID NO: 10532 - DNA, 203 bp, Homo sapiens
  source 1..203: mol_type = other DNA
ggcgcgccagtcctgaatcttggaggtgggctagaggccgacgccagccagagagcgaaatgttcttttggggccagagtctgggcatatatgaatgcaaacccgtgtttgttcacaactaagcccagctgagacgatcacttttctgtaggccatttgtccaggtacagaatgagcacatgttgttgcgactcggaccgatg

SEQ ID NO: 10533 - DNA, 203 bp, Homo sapiens
  source 1..203: mol_type = other DNA
ggcgcgccagtcctgggatatgggactttttggacacccagagaacaggtcccagataccgagtccgcaaccccaaacatcgcgattaataggaggcctctggtctctgcctgccctgggtgctcatggaaccagctgctgctctgcacttctccctgccagcctccctcctcctcctcctgctcctccgactcggaccgatg

SEQ ID NO: 10534 - DNA, 203 bp, Homo sapiens
  source 1..203: mol_type = other DNA
ggcgcgccagtccttcatgcttgaacaaatttgatttccggagtcagtcattttactgtcaagacatttcttcggcattctgcaacagtttccaacatggccagatccatcagaaactgaagccgtggagaacgctctcggggcctttgccacttcttggagtagaagccgacagagagctgtttggacgactcggaccgatg

SEQ ID NO: 10535 - DNA, 203 bp, Homo sapiens
  source 1..203: mol_type = other DNA
ggcgcgccagtcctatacctttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcccgactcggaccgatg

SEQ ID NO: 10536 - DNA, 203 bp, Homo sapiens
  source 1..203: mol_type = other DNA
ggcgcgccagtcctctgtgaagaaaaactggagcctgttcttggcaagaagattctaatgccagaatttgaaagcgtgctctgggggctcctggtgctcagctggtcctgcctgcaaggcccctgctccgtgttctcccctgtgagcgccatggagcccttgggccggcagctaactagcgggccgaacgactcggaccgatg

SEQ ID NO: 10537 - DNA, 203 bp, Homo sapiens
  source 1..203: mol_type = other DNA
ggcgcgccagtccttcgttataaaaaactggagcctgttcttggcaagaagattctaatgcccaggaacatggcgccctgaacaacctatctggtgctcagctggtcctgcctgcaaggcccctgctccgtgttctcccctgtgagcgccatggagcccttgggccggcagctaactagcgggccgaacgactcggaccgatg

SEQ ID NO: 10538 - DNA, 203 bp, Homo sapiens
  source 1..203: mol_type = other DNA
ggcgcgccagtcctttgcgctcaaaaactggagcctgttcttggcaagcctgcgtcccgcgacaggaacatggcgctgctctgggggctcctggtgctcagctggtcctgcctgcaaggcccctgctccgtgttctcccctgtgagcgccatggagcccttgggccggcagctaactagcgggccgaacgactcggaccgatg

SEQ ID NO: 10539 - DNA, 203 bp, Homo sapiens
  source 1..203: mol_type = other DNA
ggcgcgccagtcctctctctcgaaaaataataattaggcctagggaacaaatccctctcagcgaaggccgaaaagaggctagccatgccccagcacatcggttgataatgaggggggtagcaacagtggtgagttcgttggatggcttaagccctgagtacagggtagtcgtcagtggttcgacgcctcgactcggaccgatg

SEQ ID NO: 10540 - DNA, 203 bp, Homo sapiens
  source 1..203: mol_type = other DNA
ggcgcgccagtcctacggattaaaaaataataattaggcctagggaacaaatccctctcagcgaaggccgaaaagaggctagccatgcccttagtaggactagcataatgaggggggttaatcgtcgttaatgttcgttggatggcttaagccctgagtacagggtagtcgtcagtggttcgacgcctcgactcggaccgatg

SEQ ID NO: 10541 - DNA, 203 bp, Homo sapiens
  source 1..203: mol_type = other DNA
ggcgcgccagtcctggcagtaaaaaaattcaaattttaaaaatttccaggtctattacagagaaggcagagatcagctgtggaaaggacctggtgaactactgtggaagggagaaggacagaggccgcgtgcggtagggacagacataaaagtagtaccaagaaggaaggccaagattatcagggactcgactcggaccgatg

SEQ ID NO: 10542 - DNA, 203 bp, Homo sapiens
  source 1..203: mol_type = other DNA
ggcgcgccagtcctcgatgcgcaaaaattcaaattttaaaaatttccaggtctattacagagggcatcacctagctctgtggaaaggacctggtgaactactgtggaagggagaaggagcagtcatagtcaaggtagggacagacataaaagtagtaccaagaaggaaggccaagattatcagggactcgactcggaccgatg

SEQ ID NO: 10543 - DNA, 203 bp, Homo sapiens
  source 1..203: mol_type = other DNA
ggcgcgccagtccttcccacctaaaaattcaaattttaaaaatttccataagacacttgtgaaaggcagagatcagctgtggaaaggacctggtgaactactgtggaagggagaaggagcagtcatagtcaaggtagggacagacataaaagtagtaccaagaaggaaggccaagattatcagggactcgactcggaccgatg

SEQ ID NO: 10544 - DNA, 203 bp, Homo sapiens
  source 1..203: mol_type = other DNA
ggcgcgccagtcctcggcgtgaaaaacgcgtataaattaagttacaaaaaaacatgggacaagtgaaaatgtctcttcaagggattcacctgagtgatctatcatacaagcatgctatattaaaagagtctcagtatacaataaagagagatgtaggcacaacaacagcagtgatcaagcttcatacccgactcggaccgatg

SEQ ID NO: 10545 - DNA, 203 bp, Homo sapiens
  source 1..203: mol_type = other DNA
ggcgcgccagtcctcagggtgcaaaacgcgtataaattaagttacaaaaaaacatgggacaagtgaaaatgtctcttcaagggattcacctgagtgatctatcatacaagcatgctatattaaaagagtctcgcctgcgccggcgtagagatgtaggcacaacaacagcagtgacaccctcatcattgcgactcggaccgatg

SEQ ID NO: 10546 - DNA, 203 bp, Homo sapiens
  source 1..203: mol_type = other DNA
ggcgcgccagtcctactatgacaaaagacgcagtcgacaagaacagtttcgactcggaagcttgcttaacgtagtgctgacagttttttattagagagcagatctctgatgaacaaccaacggaagaagacgggaaaaccgtctatcaatatgctgaaacgcgtgagaaaccgtgtgtcaactggatccgactcggaccgatg

SEQ ID NO: 10547 - DNA, 203 bp, Homo sapiens
  source 1..203: mol_type = other DNA
ggcgcgccagtcctccttatctaaaaggagtagtaagtatgggcctaatgtgtgacctgcaggcattttgtgaaaagggtaaagtatgaaagctactctcagaaaagtacttatgtattgatgagagccttaaaatgactttatattcacaaaactgctggaagacaatgatctggggtatcacattccgactcggaccgatg

SEQ ID NO: 10548 - DNA, 203 bp, Homo sapiens
  source 1..203: mol_type = other DNA
ggcgcgccagtcctccgaacttaaaaggagtagtggtctaatatagtctgtgtgacctgcaggcattttgtgaaaagggtaaagtatgaaagctactctcagaaaagtacttatgtatgccgatcttaggggaaatgactttatattcacaaaactgctggaagacaatgatctggggtatcacattccgactcggaccgatg

SEQ ID NO: 10549 - DNA, 203 bp, Homo sapiens
  source 1..203: mol_type = other DNA
ggcgcgccagtcctttagttcaaaaaggagtagtggtctaatatagtctgtgtgacctgcaggcattttgtgaaaagggtaaagtatgaaagctactctcagaaaagtacttatgtattgatgagagccttaaaatgactttatatggtgtgttgctgcagaagacaatgatctggggtatcacattccgactcggaccgatg

SEQ ID NO: 10550 - DNA, 203 bp, Homo sapiens
  source 1..203: mol_type = other DNA
ggcgcgccagtcctcgggtttgaaaattcttctggccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtccgactcggaccgatg

SEQ ID NO: 10551 - DNA, 203 bp, Homo sapiens
  source 1..203: mol_type = other DNA
ggcgcgccagtcctagtcgaggaaacaacacctcacatcaatagaaggtgaatgtgtgcgggtttaataaaaaaagaaaagaagttaagtaaaatttaaaggacacaatagagaaaatctaggtccgaaagcttgcctctcagacagatcccaaaatcatagtccaaaccccaaacacagcagcagaccgactcggaccgatg

SEQ ID NO: 10552 - DNA, 203 bp, Homo sapiens
  source 1..203: mol_type = other DNA
ggcgcgccagtcctgcaattccaaaccaagtttaaagaaaacttaaaaaggtctcccggcccaaccaagtttaaagaaaacttaaaatcaagaaaacttaaaaccaagtttaaagaaaactcaaaatcaagaaaacttaaagccaaaataagctagaaaactaaaagacatcatggcagtcccacaaccgactcggaccgatg

SEQ ID NO: 10553 - DNA, 203 bp, Homo sapiens
  source 1..203: mol_type = other DNA
ggcgcgccagtcctccttcctaaaaccaagtttaaagaaaacttaaaatcaagaaaacttaatgatctaagcgtgaaaaacttaaaatcaagaaaacttaaaaccaagtttaaagaaaactcaaaatcaagaaaacttaaagccaaaataagctagaaaactaaaagacatcatggcagtcccacaaccgactcggaccgatg

SEQ ID NO: 10554 - DNA, 203 bp, Homo sapiens
  source 1..203: mol_type = other DNA
ggcgcgccagtcctcgagcccgaaacccatctggagcctcagatcatcccaagtcattgttcatcagatctagtactcaaataagttaataaaaatatccacatggggcaaataatcattggaggaaatccaactaatcacaatatctgtcaacatagacgttggcgatgtagtggcaaaatcaaccacgactcggaccgatg

SEQ ID NO: 10555 - DNA, 203 bp, Homo sapiens
  source 1..203: mol_type = other DNA
ggcgcgccagtcctgcttgaggaaacccatctggagcctcagatcatcccaagtcattgttcccagccggatccggtcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 10556 - DNA, 203 bp, Homo sapiens
  source 1..203: mol_type = other DNA
ggcgcgccagtcctcacatgtaaaacccatctggagcctcagatcatcgatgtagtaaaccgatcagatctagtactcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 10557 - DNA, 203 bp, Homo sapiens
  source 1..203: mol_type = other DNA
ggcgcgccagtccttccacgtgaaacccatctggtatacggctatgaaccaagtcattgttcatcagatctagtactcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 10558 - DNA, 203 bp, Homo sapiens
  source 1..203: mol_type = other DNA
ggcgcgccagtcctcccttcgtaaacctttagcacgtgacgcggtgcctggcgccgagcctcccaagatggcggtgtgcatcgcggtgattgccaaggagaatcctaatgtctacattcgcagcacccctacggagaacgagctgaagttccactacatggtgcacacatctctggacgtggtggatgcgactcggaccgatg

SEQ ID NO: 10559 - DNA, 203 bp, Homo sapiens
  source 1..203: mol_type = other DNA
ggcgcgccagtcctgcctaagcaaacctttagcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 10560 - DNA, 203 bp, Homo sapiens
  source 1..203: mol_type = other DNA
ggcgcgccagtcctacggttataaacggagggacgcagttccacttatagctccctgggtggtctaagtcctgagtacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 10561 - DNA, 203 bp, Homo sapiens
  source 1..203: mol_type = other DNA
ggcgcgccagtccttgctcaaaaaacggagggactagccatagtggcgagctccctgggtggatctttaaacccacacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 10562 - DNA, 203 bp, Homo sapiens
  source 1..203: mol_type = other DNA
ggcgcgccagtcctgcgatgcaaaacggagggactagccatagtggcgagctccctgggtggtctaagtcctgagtacaggacagtcgtcagtagttcgacgtgagcagaagcccacctcgagatgctacgtggacgagggcatgccaagacacaccttaaccctagcgggggtgagcccccaaggcccgactcggaccgatg

SEQ ID NO: 10563 - DNA, 203 bp, Homo sapiens
  source 1..203: mol_type = other DNA
ggcgcgccagtcctccaaccagaaacggagggactagccatagtggcgagctccctgggtggtctaagtcctgagtacaggacagtcgtcagtagttcgacgtgtaggccccatggagtcgagatgctacgtggacgagggcatgccaagacacaccttaaccctagcgggggtcgctagggtgaaatcgactcggaccgatg

SEQ ID NO: 10564 - DNA, 203 bp, Homo sapiens
  source 1..203: mol_type = other DNA
ggcgcgccagtcctaggccaagaaacggagggactagccatagtggcgagctccctgggtggtctaagtcctgagtacaggacagtcgtctccctcggagacatagcagaagcccacctcgagatgctacgtggacgagggcatgccaagacacaccttaaccctagcgggggtcgctagggtgaaatcgactcggaccgatg

SEQ ID NO: 10565 - DNA, 203 bp, Homo sapiens
  source 1..203: mol_type = other DNA
ggcgcgccagtcctcgttctacaaacggagggactagccatagtggcgtcgctagcataacttctaagtcctgagtacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 10566 - DNA, 203 bp, Homo sapiens
  source 1..203: mol_type = other DNA
ggcgcgccagtcctgtcgatccaaacgtgcctttttagataagttagatgttaatagtggttcgcgcaacacgccgaagtctaaagttggtaactatcgtttaccgtctagtaaacctagtggtatggatactgccttgttaagagcttaaatctaaactattaggatgtcttatactcccggtcattcgactcggaccgatg

SEQ ID NO: 10567 - DNA, 203 bp, Homo sapiens
  source 1..203: mol_type = other DNA
ggcgcgccagtcctgagtacctaaacgtgcctttttagataagttagatgttaatagtggttttgctgtttttgttaagtctaaagttggtaactatcgtttaccgtctagtaaacctagtggtatggatactgccttgttaagagcttaaatctaaactccatactctaggactactcccggtcattcgactcggaccgatg

SEQ ID NO: 10568 - DNA, 203 bp, Homo sapiens
  source 1..203: mol_type = other DNA
ggcgcgccagtcctttcgctttaaactacggattgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgcccgactcggaccgatg

SEQ ID NO: 10569 - DNA, 203 bp, Homo sapiens
  source 1..203: mol_type = other DNA
ggcgcgccagtcctacgtcaggaaagcgccgagccgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcgactcggaccgatg

SEQ ID NO: 10570 - DNA, 203 bp, Homo sapiens
  source 1..203: mol_type = other DNA
ggcgcgccagtcctacctatgaaaaggcccagggaggctgaatgaatgtatttcaccagtagcaaatgagatgaaccatcttcctgcacacagccacgatttgcaaaggtttttggagaggaataaatttaatgaaagatgtacatacagcaggcgcgacataagcagtgctgggtaaaattaaacaccgactcggaccgatg

SEQ ID NO: 10571 - DNA, 203 bp, Homo sapiens
  source 1..203: mol_type = other DNA
ggcgcgccagtcctttacaatgaaaggcccaggggtaggcttaacgcctatttcaccagtagcaaatgagatgaaccatcttcctgcacacagccacgatttgcaaaggtttttggagaggaataaatttaatgaaagatgtacatgacttctaaaaactataagcagtgctgggtaaaattaaacaccgactcggaccgatg

SEQ ID NO: 10572 - DNA, 203 bp, Homo sapiens
  source 1..203: mol_type = other DNA
ggcgcgccagtcctgtaccgttaaagtattccacgacaaaaccaaattcacgcattatctctccacgaatccagcccttcaaaggataataacagaaaaaaaccaatacaagaacgggaacaacgccctagaaaaaacaagaaggtgcggtgatgctttccctaaaagaagacagccacaagaacagacgactcggaccgatg

SEQ ID NO: 10573 - DNA, 203 bp, Homo sapiens
  source 1..203: mol_type = other DNA
ggcgcgccagtccttcgtagccaaagtattccacgacaaaaccaaattggattccctcactaccacgaatccagcccttcaaaggataataacagaaaaaaaccaatacaagaacgggaacaacgccctagaaaaaacaagaaggtaatccctcaacaaacctaaaagaagacagccacaagaacagacgactcggaccgatg

SEQ ID NO: 10574 - DNA, 203 bp, Homo sapiens
  source 1..203: mol_type = other DNA
ggcgcgccagtccttgggctcgaaatcaaaagataataacaattggctctgtctctctcaccattgcaacagtatgcttcctcatgcagattgccatcctggtaactactgtgacattgcattttaagcaacatgagtgcgactcccccgcgagcaaccattagggctgcctcaaaccaataataatacgactcggaccgatg

SEQ ID NO: 10575 - DNA, 203 bp, Homo sapiens
  source 1..203: mol_type = other DNA
ggcgcgccagtcctcttataccaaatgaaaagagcaggctagcgtttggactgttttgtttttggcggaactaccgggcaggaagattgcacaagtcagggggcgtttccaatcgggtgtcaattttggatctccccccccccacccccctttggatcttgtcgggctttccacgtttcacttaaaaacgactcggaccgatg

SEQ ID NO: 10576 - DNA, 203 bp, Homo sapiens
  source 1..203: mol_type = other DNA
ggcgcgccagtcctccgcaggtaaatgcgtacaacaaacttgcgtaaaccaaaaaaatggggcaaataagaatttgataagtaccacttaaatttaactcccttggttagagatgggcagcaattcattgagtatgataaaagttatgcacgcttgaccctttgacaatgatgaagtagcattgttaacgactcggaccgatg

SEQ ID NO: 10577 - DNA, 203 bp, Homo sapiens
  source 1..203: mol_type = other DNA
ggcgcgccagtccttggttcaaaaatgcgtacaacaaacttgcgtaaagtgttgttgaacaccaaataagaatttgataagtaccacttaaatttaactcccttggttagagatgggcagcaattcattgagtatgataaaagttagattacaaaatttgtttgacaatgatgaagtagcattgttaacgactcggaccgatg

SEQ ID NO: 10578 - DNA, 203 bp, Homo sapiens
  source 1..203: mol_type = other DNA
ggcgcgccagtcctcacgcctcaaatgcgtacaatcggtgaataagctccaaaaaaatggggcaaataagaatttgataagtaccacttaaatttaactcccttggttagagatgggcagcaattcattgagtatgataaaagttagattacaaaatttgtttgacaatgatgaagtagcattgttaacgactcggaccgatg

SEQ ID NO: 10579 - DNA, 203 bp, Homo sapiens
  source 1..203: mol_type = other DNA
ggcgcgccagtcctgtcgcagcaaatgcgtactacaaacttgcacattcggaaaaaatggggcaaataagaatttgataagtgctatttaagtctaaccttttcaatcagaaatggggtgcaattcactgagcatgataaaggttagattacaaaatttatttgacaatgacgattagcacgaaagcgcgactcggaccgatg

SEQ ID NO: 10580 - DNA, 203 bp, Homo sapiens
  source 1..203: mol_type = other DNA
ggcgcgccagtcctattcagggaaatgcttctctagataatgcttaaaggaccctgcagcagttcttggtattggacatagcatctcagcacaccgtcttaatcccgtgactaccagatttgactcatttgtgattccttcgagaatctcccatgatttgcaatggttacatgaatgtttgggaaggacgactcggaccgatg

SEQ ID NO: 10581 - DNA, 203 bp, Homo sapiens
  source 1..203: mol_type = other DNA
ggcgcgccagtccttctagttgaaatgttaggagccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagaccgactcggaccgatg

SEQ ID NO: 10582 - DNA, 203 bp, Homo sapiens
  source 1..203: mol_type = other DNA
ggcgcgccagtcctcaactgacaaattccagttgttagtcgaatccaacaagctgagtaaaagggatttcaggcctttgaatcgctatacatcttgctaaccgaacctctccactcagtccctctagacaataaagtccgagatgtcctaaagtcaacatgaaaaaaacaggcaacaccactgataaacgactcggaccgatg

SEQ ID NO: 10583 - DNA, 203 bp, Homo sapiens
  source 1..203: mol_type = other DNA
ggcgcgccagtccttgagcgtgaaattccagttgttagtcgaatccaacaagctgagtaaaatcatgcaagatgacttgaatcgctatacatcttgctaaccgaacctctccactcagtccctctagacaataaagtccgagatgtcctaaagtcaacatgaaaaaaacaggcaacaccactgataaacgactcggaccgatg

SEQ ID NO: 10584 - DNA, 203 bp, Homo sapiens
  source 1..203: mol_type = other DNA
ggcgcgccagtcctgactaataaaattctgatgcagaacgtatcagtgaaactccctcccactgtctcttgtattagcatcaaggaagcgagaaaaaataagcaccctgagaatggagacagtgtttgaagagatggatgaagaaagcacaggaggagttaggcggattttttcagaaatagtccttgcgactcggaccgatg

SEQ ID NO: 10585 - DNA, 203 bp, Homo sapiens
  source 1..203: mol_type = other DNA
ggcgcgccagtccttttcgtccaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagaagaaatagtccttgcgactcggaccgatg

SEQ ID NO: 10586 - DNA, 203 bp, Homo sapiens
  source 1..203: mol_type = other DNA
ggcgcgccagtcctatcctaagaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagatccccacaggtgcacgactcggaccgatg

SEQ ID NO: 10587 - DNA, 203 bp, Homo sapiens
  source 1..203: mol_type = other DNA
ggcgcgccagtcctcctcgcaaaacaaagaagtacttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 10588 - DNA, 203 bp, Homo sapiens
  source 1..203: mol_type = other DNA
ggcgcgccagtccttagtttctaacaacatagattcaagacttgattgatgcaattcaaaattttctacaacatctaggtattactgatgatatatacacaatatatatattagtgtcataacactcaatcctaatgcttaccacatcatcaaactattaactcaaacaattcaagccatgggacaaacgactcggaccgatg

SEQ ID NO: 10589 - DNA, 203 bp, Homo sapiens
  source 1..203: mol_type = other DNA
ggcgcgccagtcctggccaaataacaagggatgtcagcaagctacacaaagtatagatatttccaatgcgacggggaagctatatttacacatttcaagagagggtgcacttgctggggggaggacatgggccgggaaggattggaagaccaaggacctccccctcctccccctccaggtctagtctacgactcggaccgatg

SEQ ID NO: 10590 - DNA, 203 bp, Homo sapiens
  source 1..203: mol_type = other DNA
ggcgcgccagtcctaccgcacaaacaagggatgtcagcaagctacacaaagtatagatatttgtgcctaatgcaaaaagctatatttacacatttcaagagagggtgcacttgctggggggaggacatgggccgggaaggattggagttatcgtacaggacccctcctccccctccaggtctagtctacgactcggaccgatg

SEQ ID NO: 10591 - DNA, 203 bp, Homo sapiens
  source 1..203: mol_type = other DNA
ggcgcgccagtcctcttgacagaacaagggatgttgcggcatccatataagtatagatatttgtgcctaatgcaaaaagctatatttacacatttcaagagagggtgcacttgctggggggaggacatgggccgggaaggattggaagaccaaggacctccccctcctccccctccaggtctagtctacgactcggaccgatg

SEQ ID NO: 10592 - DNA, 203 bp, Homo sapiens
  source 1..203: mol_type = other DNA
ggcgcgccagtcctcccggaacaaccgcgtctccttagcttgccttaagcagtctttatatcttctgtatattattttaaagtttataggagcaaagttcgctttactcgcaatagctattttatttattttaggaatattatcacctcgtaattatttaattataacattagctttatctatttatacgactcggaccgatg

SEQ ID NO: 10593 - DNA, 203 bp, Homo sapiens
  source 1..203: mol_type = other DNA
ggcgcgccagtcctgcgcaacgaaccggtacctaatgtgtatgtgtatatatgtatgtgtgtgtatgtatatgtgtgtgtatgtgtatgtgtgtgtgtatgtgtgtgtgtatgtatgtatgtatgtatatgtattatacacatatacacatattggtttttttaatcatttgagagttagttgaagatcgactcggaccgatg

SEQ ID NO: 10594 - DNA, 203 bp, Homo sapiens
  source 1..203: mol_type = other DNA
ggcgcgccagtcctaaggcatgaaccttcggggacctcccacctgcattgctctacaatctgtggcctcagcccttgccaactctgcctcttcccccgctgactgggcctctgcagagatgtgggcagctggtcaggatggccattcgggctcagcacagcaacgcagcccagactcagactggggaacgactcggaccgatg

SEQ ID NO: 10595 - DNA, 203 bp, Homo sapiens
  source 1..203: mol_type = other DNA
ggcgcgccagtcctgtggcttaaacgctactgcactgcctcccctctcctgtattgaaagcgtttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 10596 - DNA, 203 bp, Homo sapiens
  source 1..203: mol_type = other DNA
ggcgcgccagtcctcgtgcagtaacggcgagggatctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggacgactcggaccgatg

SEQ ID NO: 10597 - DNA, 203 bp, Homo sapiens
  source 1..203: mol_type = other DNA
ggcgcgccagtcctcgcaaagcaacggtcactctgaaaacagggtgggagagctgcctctctttgaacctctcccactctagtggactgaccagggaggcaaacttggtcgatgtaagcggtggcttggagacagaatcatctaatggaaaagatacactagaaggtgctggggatacatcagaggtgcgactcggaccgatg

SEQ ID NO: 10598 - DNA, 203 bp, Homo sapiens
  source 1..203: mol_type = other DNA
ggcgcgccagtccttccaatttaacggtcactctgaaaacagggtgggagagctgcctctctttgaacctctcccaggaccaactctaacccagggaggcaaacttggtcgatgtaagcggtggcttggagaacctcagtcagtcaggaaaagatacactagaaggtgctggggatacatcagaggtgcgactcggaccgatg

SEQ ID NO: 10599 - DNA, 203 bp, Homo sapiens
  source 1..203: mol_type = other DNA
ggcgcgccagtcctttatttataacggtcactctgaaaacagggtgggagagctgcctctctttgaacctctcccaggaccaactctaacccagggaggcaaacttggtcgatgtaagcggtggcttggagaagagtagcaaactcggaaaagatacactagaaggtgctggggatacatcagaggtgcgactcggaccgatg

SEQ ID NO: 10600 - DNA, 203 bp, Homo sapiens
  source 1..203: mol_type = other DNA
ggcgcgccagtccttatctcgcaacggtcactctgaaaacagggtgggagagctgcctctctttgaacctctcccaggaccaactctaacccagggaggcaaacttggtcgatgtaagcggtggcttggagacagaatcatctaatggaaaagatacactgcgccaccagtcacatacatcagaggtgcgactcggaccgatg

SEQ ID NO: 10601 - DNA, 203 bp, Homo sapiens
  source 1..203: mol_type = other DNA
ggcgcgccagtcctgaccatgtaacggtcactctgaaaacagggtgggagagctgcctctctttgaacctctcccaggaccaactctaacggtcctcaagtccattggtcgatgtaagcggtggcttggagacagaatcatctaatggaaaagatacactagaaggtgctggggatacatcagaggtgcgactcggaccgatg

SEQ ID NO: 10602 - DNA, 203 bp, Homo sapiens
  source 1..203: mol_type = other DNA
ggcgcgccagtcctgccgcgggaacggtcactctgaaaacagggtggggattgcttagtatcttgaacctctcccaggaccaactctaacccagggaggcaaacttggtcgatgtaagcggtggcttggagacagaatcatctaatggaaaagatacactagaaggtgctggggatacatcagaggtgcgactcggaccgatg

SEQ ID NO: 10603 - DNA, 203 bp, Homo sapiens
  source 1..203: mol_type = other DNA
ggcgcgccagtccttcgccaataactattatctcgcctgcacgcccgcctcgcgtcccgggggggtcccgcctcccaccccgcctctggacttgtctctttccccgcgcgcgcggacagagccggcgtttaggcccgagcgagcccgggggccgccggccgggaagacaacgcgggcaccgattcgcccgactcggaccgatg

SEQ ID NO: 10604 - DNA, 203 bp, Homo sapiens
  source 1..203: mol_type = other DNA
ggcgcgccagtccttcacccgcaactcgaccgaggcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtggcgactcggaccgatg

SEQ ID NO: 10605 - DNA, 203 bp, Homo sapiens
  source 1..203: mol_type = other DNA
ggcgcgccagtcctgtactttgaagaacaaaagcaaaaacaaaaacaagaacaaaaaagggaagaaaaacaaaagtatacacaaaaaccaaaaaagaaaaaaggccagagacaaaaacggaggcaagaacaaaaatttaaacaaaaacagaatttaaattcataataaacaccaagatagagacaaaacgactcggaccgatg

SEQ ID NO: 10606 - DNA, 203 bp, Homo sapiens
  source 1..203: mol_type = other DNA
ggcgcgccagtcctgcagcctgaagaacaaaagcaaaaacaaaaacaagaacaaaaaagggactctttcagggtaaatacacaaaaaccaaaaaagaaaaaaggccagagacaaaaacggaggcaagaacaaaaatttaaacaaaaacagaatttaaattcataataaacaccaagatagagacaaaacgactcggaccgatg

SEQ ID NO: 10607 - DNA, 203 bp, Homo sapiens
  source 1..203: mol_type = other DNA
ggcgcgccagtcctgtgatctcaagacaaaaaccattcaacgccggagacgacttgtcttaacagtggatgcattgagtggattgactgtcagggctgtctttaggcttaattccagacctctctgtgcttagggcaaacatcatttggccttaaatgggattctgtgagaggggatccctccattgacgactcggaccgatg

SEQ ID NO: 10608 - DNA, 203 bp, Homo sapiens
  source 1..203: mol_type = other DNA
ggcgcgccagtcctgcccgtgaaagacaaaaaccattcaacgccggaggactgactctcatccagtggatgcattgagtggattgactgtacatctaaagcgggggcttaattccagacctctctgtgcttagggcaaacatcatttggccttaaatgggattctgtgagaggggatccctccattgacgactcggaccgatg

SEQ ID NO: 10609 - DNA, 203 bp, Homo sapiens
  source 1..203: mol_type = other DNA
ggcgcgccagtcctgcgtgtaaaagacaaaaaccattcaacgccggaggactgactctcatccagtggatgcattgagtggattgactgtcagggctgtctttaggcttaattccagacctctctgtgcttattaacctgccgccgtggccttaaatgggattctgtgagaggggatccctccattgacgactcggaccgatg

SEQ ID NO: 10610 - DNA, 203 bp, Homo sapiens
  source 1..203: mol_type = other DNA
ggcgcgccagtcctctcgttgtaagacaaaaaccattcaacgccggaggactgactctcatcggacttgatatgatagtggattgactgtcagggctgtctttaggcttaattccagacctctctgtgcttagggcaaacatcatttggccttaaatgggattctgtgagaggggatccctccattgacgactcggaccgatg

SEQ ID NO: 10611 - DNA, 203 bp, Homo sapiens
  source 1..203: mol_type = other DNA
ggcgcgccagtccttcagaagaaagacaaaaacccaagtcgcatcctagactgactctcatccagtggatgcattgagtggattgactgtcagggctgtctttaggcttaattccagacctctctgtgcttagggcaaacatcatttggccttaaatgggattctgtgagaggggatccctccattgacgactcggaccgatg

SEQ ID NO: 10612 - DNA, 203 bp, Homo sapiens
  source 1..203: mol_type = other DNA
ggcgcgccagtcctatcttagcaagatgcggcatatcattctcaaattcttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 10613 - DNA, 203 bp, Homo sapiens
  source 1..203: mol_type = other DNA
ggcgcgccagtcctctgtgggcaagattgcgtggccgaccgaatcgtgtgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10614 - DNA, 203 bp, Homo sapiens
  source 1..203: mol_type = other DNA
ggcgcgccagtccttggactgaaagattgcgtgggttctgcctaaagccatgacaagcctcttttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10615 - DNA, 203 bp, Homo sapiens
  source 1..203: mol_type = other DNA
ggcgcgccagtccttctaacgaaagattgcgtgggttctgcctaaagctgaattcccagcgctttggcttctctgagttggggttgtgtactctatggggactgcagttccggaaccagccagcagcctttaattcttgggcggaccacggccggttctgtgttcttggctaagatgagcagccaccacgactcggaccgatg

SEQ ID NO: 10616 - DNA, 203 bp, Homo sapiens
  source 1..203: mol_type = other DNA
ggcgcgccagtcctgcagattcaagattgcgtgggttctgcctaaagctgaattcccagcgctttggcttctctgagttggggttgtgtataggggtcttcgaacagttccggaaccagccagcagcctttaattcttgggcggacattaattctgcgaatgttcttggctaagatgagcagccaccacgactcggaccgatg

SEQ ID NO: 10617 - DNA, 203 bp, Homo sapiens
  source 1..203: mol_type = other DNA
ggcgcgccagtcctggctttcaaagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 10618 - DNA, 203 bp, Homo sapiens
  source 1..203: mol_type = other DNA
ggcgcgccagtcctgctctataaagattgcgtgggttctgcctaaagctgaattcccagcgctttggcttctctgagttggggttgtgtataggggtcttcgaacagttccggaaccagccagcagcctttacacgactttttcgacacggccggttctgtgttcttggctaagatgagcagccaccacgactcggaccgatg

SEQ ID NO: 10619 - DNA, 203 bp, Homo sapiens
  source 1..203: mol_type = other DNA
ggcgcgccagtcctggcggtgtaagattgcgtgggttctgcctaaagctgaattcccagcgctttggcttctctgagttggggttgtgtataggggtcttcgaagtcagttcctcgtcgccagcagcctttaattcttgggcggaccacggccggttctgtgttcttggctaagatgagcagccaccacgactcggaccgatg

SEQ ID NO: 10620 - DNA, 203 bp, Homo sapiens
  source 1..203: mol_type = other DNA
ggcgcgccagtccttgcgtatcaagatttcatttgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 10621 - DNA, 203 bp, Homo sapiens
  source 1..203: mol_type = other DNA
ggcgcgccagtcctaaatttagaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagagttcacactagaagcgactcggaccgatg

SEQ ID NO: 10622 - DNA, 203 bp, Homo sapiens
  source 1..203: mol_type = other DNA
ggcgcgccagtcctactaatcgaagcaattactcaaaaacggagaaaacatcagctgatgcgtgccctactctcccacccctttatatagttccttcagtatttacttgaggcagacaggaagacttctgaagaacaaatcagcctggtcaccagcttttgcccttgagtagatcacagagggcagtccgactcggaccgatg

SEQ ID NO: 10623 - DNA, 203 bp, Homo sapiens
  source 1..203: mol_type = other DNA
ggcgcgccagtcctgcgttaccaagcccaacacgacgcatcagatgaccaattcagttcactggtgcaatgagggtattggggctttttgaacgtgggaataacttgaatttcgcagatacctacgtatatacatggaaccaacagtactcgtatcatgaaaatgcattcctaatttcaaatcaagtacgactcggaccgatg

SEQ ID NO: 10624 - DNA, 203 bp, Homo sapiens
  source 1..203: mol_type = other DNA
ggcgcgccagtcctccatgtttaagcccaacacgcaatgcgtttattgcaattcagttcactggtgcaatgagggtattggggctttttgaacgtgggaataacttgaatttcgcagagttgcttcaggtatcatggaaccaacagtactcgtatcatgaaaatgcattcctaatttcaaatcaagtacgactcggaccgatg

SEQ ID NO: 10625 - DNA, 203 bp, Homo sapiens
  source 1..203: mol_type = other DNA
ggcgcgccagtcctaagtctgaaagcccaacacgcaatgcgtttattgcaattcagttcactggtgcaatgagggtattggggctttttgaacgtgggaataacttgaatttcgcagatacctacgtatatacatggaaccaacagggtgacatagcctcaaatgcattcctaatttcaaatcaagtacgactcggaccgatg

SEQ ID NO: 10626 - DNA, 203 bp, Homo sapiens
  source 1..203: mol_type = other DNA
ggcgcgccagtcctagtctacaaagcccaacacgcaatgcgtttattgcaattcagttcactggtgcaatgagggtattggggctttttgaacgtgggaataacttgaatttcgcagatacctacgtatatacatggaaccaacagtactcgtatcatgaaaatgcattcctaatttcaaatcaagtacgactcggaccgatg

SEQ ID NO: 10627 - DNA, 203 bp, Homo sapiens
  source 1..203: mol_type = other DNA
ggcgcgccagtcctactgccctaagcccaacacgcaatgcgtttattgcaattcagttcactggtgcaatgagggtattggggctttttgaacgtgggaataacttgaatttcgcagatacctacgtatatacatggaaccaacagtactcgtatcatgactcctggagagcggtttcaaatcaagtacgactcggaccgatg

SEQ ID NO: 10628 - DNA, 203 bp, Homo sapiens
  source 1..203: mol_type = other DNA
ggcgcgccagtcctaaggagcgaagcccaacacgcaatgcgtttattgtttgaagtggggtaggtgcaatgagggtattggggctttttgaacgtgggaataacttgaatttcgcagatacctacgtatatacatggaaccaacagtactcgtatcatgaaaatgcattcctaatttcaaatcaagtacgactcggaccgatg

SEQ ID NO: 10629 - DNA, 203 bp, Homo sapiens
  source 1..203: mol_type = other DNA
ggcgcgccagtcctggacccataagcccacctcgagatgctacgtggaacgacaatgagacggacacaccttaaccctagcgggggtcgctagggtgaaatcacaccacgtgatgggagtacgacctgatagggcgctgcagaggcccactattaggctagtataaaaatctctgctgtacatggcaccgactcggaccgatg

SEQ ID NO: 10630 - DNA, 203 bp, Homo sapiens
  source 1..203: mol_type = other DNA
ggcgcgccagtcctgtcattctaagcccacctcgagatgctacgtggacgagggcatgccaagacacaccttaaccctagcgggggtcgccttctaccgtggggaccacgtgatgggagtacgacctgatagggcgctgcagaggcccactattaggctagtataaaaatctctgctgtacatggcaccgactcggaccgatg

SEQ ID NO: 10631 - DNA, 203 bp, Homo sapiens
  source 1..203: mol_type = other DNA
ggcgcgccagtcctgaattccgaagcccacctcgagatgctacgtggacgagggcatgccaagacacaccttaaccctagcgggggtcgctagggtgaaatcacaccacgtgatgggagtacgacctgatagacatgccattcctaccactattaggctagtataaaaatctctgctgtacatggcaccgactcggaccgatg

SEQ ID NO: 10632 - DNA, 203 bp, Homo sapiens
  source 1..203: mol_type = other DNA
ggcgcgccagtcctcggatcgcaagcccacctcgagatgctacgtggacgagggcatgccaagacacaccttaaccctagcgggggtcgctagggtgaaatcacaccacgtgatgggagtacgacctgatagggcgctgcagaggcagcagtaagtctcggtataaaaatctctgctgtacatggcaccgactcggaccgatg

SEQ ID NO: 10633 - DNA, 203 bp, Homo sapiens
  source 1..203: mol_type = other DNA
ggcgcgccagtcctacttcgaaaagcccacctcgagatgctacgtggacgagggcatgccaagacacaccttaaccctagcgggggtcgctagggtgaaatcacaccacgtgatgggagtacgacctgatagggcgctgcagaggcccactattaggctacataccctgcaatcgctgtacatggcaccgactcggaccgatg

SEQ ID NO: 10634 - DNA, 203 bp, Homo sapiens
  source 1..203: mol_type = other DNA
ggcgcgccagtcctggatgggaaagcccacctcgagatgctacgtggacgagggcatgccaagacacaccttaaccctagcgggggtcgctagggtgaaatcacaccacgtgatgggataggcggtaagcgaggcgctgcagaggcccactattaggctagtataaaaatctctgctgtacatggcaccgactcggaccgatg

SEQ ID NO: 10635 - DNA, 203 bp, Homo sapiens
  source 1..203: mol_type = other DNA
ggcgcgccagtcctacgctttcaagcccacctcgagatgctacgtggacgagggcatgccaatggcataacacttactagcgggggtcgctagggtgaaatcacaccacgtgatgggagtacgacctgatagggcgctgcagaggcccactattaggctagtataaaaatctctgctgtacatggcaccgactcggaccgatg

SEQ ID NO: 10636 - DNA, 203 bp, Homo sapiens
  source 1..203: mol_type = other DNA
ggcgcgccagtcctaatcacttaagcggcagcgcatagacgaaagaacggtggcaggaggctgcgaggagccggcgcggtcgcagtctccacggcgcaggcccacggtagcgcagccgctctgagaacttcatggaggaacacggagtgacccaaaccgaacatatggctaccatagaagcacatgcacgactcggaccgatg

SEQ ID NO: 10637 - DNA, 203 bp, Homo sapiens
  source 1..203: mol_type = other DNA
ggcgcgccagtcctcttactagaagcggcagcgctcgccattgccgctggtggcaggaggctgcgaggagccggcggatagaggactgatacggcgcaggcccacggtagcgcagccgctctgagaacttcatggaggaacacggagtgacccaaaccgaacatatggctaccatagaagcacatgcacgactcggaccgatg

SEQ ID NO: 10638 - DNA, 203 bp, Homo sapiens
  source 1..203: mol_type = other DNA
ggcgcgccagtcctccattagcaagctggggccgccaggagtgcgatcgcctgcggatctgcagctgggcaccggccgcaacgcccgccccgcgacggcagggaataaaggctcagggaccggcagttctactctagagcccaccagcctctcagagcctccggtgactggcctgtgtctccccctggcgactcggaccgatg

SEQ ID NO: 10639 - DNA, 203 bp, Homo sapiens
  source 1..203: mol_type = other DNA
ggcgcgccagtcctctatacaaaagctggggccgccaggagtgcgatcgcctgcggatctgcagctgggcaccggccgcaacgcccgccccgcgacggcagggaataaaggctcagggaccggcagttctactctagagcccaccataaatagctcttgcccggtgactggcctgtgtctccccctggcgactcggaccgatg

SEQ ID NO: 10640 - DNA, 203 bp, Homo sapiens
  source 1..203: mol_type = other DNA
ggcgcgccagtcctaacgcggcaagctggggccgccaggagtgcgatcgcctgcggatctgcagctgggcaccggccgcaacgcccgccccgcgacggcagggaataaaggctcagggtttacagcctctactctagagcccaccagcctctcagagcctccggtgactggcctgtgtctccccctggcgactcggaccgatg

SEQ ID NO: 10641 - DNA, 203 bp, Homo sapiens
  source 1..203: mol_type = other DNA
ggcgcgccagtcctcccatttgaagctggggccgccaggagtgcgatcgcctgcggatctgcagctgggctagctttctaacgcccgccccgcgacggcagggaataaaggctcagggtttacagcctctactctagagcccaccagcctctcagagcctccggtgactggcctgtgtctccccctggcgactcggaccgatg

SEQ ID NO: 10642 - DNA, 203 bp, Homo sapiens
  source 1..203: mol_type = other DNA
ggcgcgccagtcctaatctttaaagctggggccggaccactgcgtcatgcctgcggatctgcagctgggcaccggccgcaacgcccgccccgcgacggcagggaataaaggctcagggaccggcagttctactctagagcccaccagcctctcagagcctccggtgactggcctgtgtctccccctggcgactcggaccgatg

SEQ ID NO: 10643 - DNA, 203 bp, Homo sapiens
  source 1..203: mol_type = other DNA
ggcgcgccagtccttggagtagaaggagccaacgatcttgccaagttccaccagatgctgatgaagataataatgaagtagctacagctcaacttacctgccaaccccatgccagtcgacctaattagtacaacctaaatccattactctcttagcgtcggcaaagtgattgcctcctaagttccacacgactcggaccgatg

SEQ ID NO: 10644 - DNA, 203 bp, Homo sapiens
  source 1..203: mol_type = other DNA
ggcgcgccagtcctgagaaagaaaggagccaacgatcttgccaagttccaccagatgctgatgaagataataatgaagtagctacagctcaacttacctgccaaccccatgccagtcgacctaattagtacaacctaaatccattataaaaaacttaggagcaaagtgattgcctcctaagttccacacgactcggaccgatg

SEQ ID NO: 10645 - DNA, 203 bp, Homo sapiens
  source 1..203: mol_type = other DNA
ggcgcgccagtcctcgcactgtaaggagccaacgatcttgccaagttccaccagatgctgatgaagataataatgagccgttatttaggaaacttacctgccaaccccatgccagtcgacctaattagtacaacctaaatccattataaaaaacttaggagcaaagtgattgcctcctaagttccacacgactcggaccgatg

SEQ ID NO: 10646 - DNA, 203 bp, Homo sapiens
  source 1..203: mol_type = other DNA
ggcgcgccagtccttacataacaaggagccaacgcgtggagttgtgcgcaccagatgctgatgaagataataatgaagtagctacagctcaacttacctgccaaccccatgccagtcgacctaattagtacaacctaaatccattataaaaaacttaggagcaaagtgattgcctcctaagttccacacgactcggaccgatg

SEQ ID NO: 10647 - DNA, 203 bp, Homo sapiens
  source 1..203: mol_type = other DNA
ggcgcgccagtccttcagtgccaaggagccagggagtacttagccggagtggggcagcaccgctccttgggtccccactccccatttctcattgcttggaaatccatgccaagatgcctgccttccttggtctaaagtgtctggggaaattgtgcagctctgagaaaagcaaagtcacctcatctgagcgactcggaccgatg

SEQ ID NO: 10648 - DNA, 203 bp, Homo sapiens
  source 1..203: mol_type = other DNA
ggcgcgccagtcctgaatgttaaaggagccaggggaacagagagaattgtggggcagcaccgctccttgggtccccactccccatttctcattgcttggaaatccatgccaagatgcctgccttccttggtctaaagtgtctggggaaattgtgcagctcaattgggctgggtctcacctcatctgagcgactcggaccgatg

SEQ ID NO: 10649 - DNA, 203 bp, Homo sapiens
  source 1..203: mol_type = other DNA
ggcgcgccagtcctcccaggccaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagcgcgggtcgacatccgactcggaccgatg

SEQ ID NO: 10650 - DNA, 203 bp, Homo sapiens
  source 1..203: mol_type = other DNA
ggcgcgccagtccttgggcaacaaggagccaggggaacagagagaattgtggggcagcaccgctccttgggtccccactccccatttctccggctcgacttccacatgccaagatgcctgccttccttggtctaaagtgtctggggaaattgtgcagctctgagaaaagcaaagtcacctcatctgagcgactcggaccgatg

SEQ ID NO: 10651 - DNA, 203 bp, Homo sapiens
  source 1..203: mol_type = other DNA
ggcgcgccagtcctggtgatataaggagccaggggaacagagagaattgtggggcagcaccgctccttgggtccccgtcattgtccgaggattgcttggaaatccatgccaagatgcctgccttccttggtctaaagtgtctggggaaattgtgcagctctgagaaaagcaaagtcacctcatctgagcgactcggaccgatg

SEQ ID NO: 10652 - DNA, 203 bp, Homo sapiens
  source 1..203: mol_type = other DNA
ggcgcgccagtcctgcacgatgaagggacggcggcgattggcggacgctcctggcaggagagcgcggattggtcaggcacggagcaggaggcggggctgatagcccagcagcagcagcggcggcggcggctgcggagcgggtgtgaggcggctggaccgcagaatgaatcgatacagggcgcggcaagcgactcggaccgatg

SEQ ID NO: 10653 - DNA, 203 bp, Homo sapiens
  source 1..203: mol_type = other DNA
ggcgcgccagtcctcccaccgaaaggtcagtggtaggtaaggaaggggccttaacctctgctggtgaccagaagcctgcatttctgcattctgcttaattccctttccttagatttgaaagaagccaacactaaaccacaaatatatcgtctacgagcaatctcaaacgagagtcagcctttaacgaacgactcggaccgatg

SEQ ID NO: 10654 - DNA, 203 bp, Homo sapiens
  source 1..203: mol_type = other DNA
ggcgcgccagtcctagacaataaaggtcagtggtaggtaaggaaggggccttaacctctgctggtgaccagaagcctgcatttctgcattctgcttaattccctttccttagatttgactacttgttgtctgaaaccacaaatatacaacaaggccattttctcaaacgagagtcagcctttaacgaacgactcggaccgatg

SEQ ID NO: 10655 - DNA, 203 bp, Homo sapiens
  source 1..203: mol_type = other DNA
ggcgcgccagtcctccggctgaaaggtcagtggtaggtaaggaaggggtagcgcgtctacggggtgaccagaagcctgcatttctgcattctgcttaattccctttccttagatttgaaagaagccaacactaaaccacaaatatacaacaaggccattttctcaaacgagagtcagcctttaacgaacgactcggaccgatg

SEQ ID NO: 10656 - DNA, 203 bp, Homo sapiens
  source 1..203: mol_type = other DNA
ggcgcgccagtccttactctataagtacggttttcggagggatcagactcagactcacgtcgcactcctcgcagttggactggtgggaactgggaacactggagacctgatttctaactgacgctaccgtcgaacgtttatgtcccgacgacttcagcatgtctcaggccaccaagaggaagcatgtgcgactcggaccgatg

SEQ ID NO: 10657 - DNA, 203 bp, Homo sapiens
  source 1..203: mol_type = other DNA
ggcgcgccagtcctggcacggaaagtacggttttcggagggatcagactcagactcacgtcgcactcctcgcagttggactggtgggaactgggaacactggagacctgatttctaactgacgctaccgtcgcggccgccgtgtggctacggcgtttgtagtctcaggccaccaagaggaagcatgtgcgactcggaccgatg

SEQ ID NO: 10658 - DNA, 203 bp, Homo sapiens
  source 1..203: mol_type = other DNA
ggcgcgccagtcctactggtttaagtacggttttcggagggatcagactcagactcacgtcgcactcctcgcagttggactggtgggaactgggaacactggagacctgatttctaactgacgctaccgtcgcggccgccgtgtgggacgacttcagcatccgcgtttggggatagaggaagcatgtgcgactcggaccgatg

SEQ ID NO: 10659 - DNA, 203 bp, Homo sapiens
  source 1..203: mol_type = other DNA
ggcgcgccagtcctacgtcgctaagtacggttttcggagggatcagactcagactcacgtcgcactcctcgcagttggactggtgggaactgggaacactggagacctgatttctaactgacgctaccgtcgcggccgccgtgtgggacgacttcagcatgtctcaggccaccaagaggaagcatgtgcgactcggaccgatg

SEQ ID NO: 10660 - DNA, 203 bp, Homo sapiens
  source 1..203: mol_type = other DNA
ggcgcgccagtcctgattgcgtaagtacggttttcggagggatcagactcagactcacgtcgcactcctcgcagtttatgctcactactatgggaacactggagacctgatttctaactgacgctaccgtcgcggccgccgtgtgggacgacttcagcatgtctcaggccaccaagaggaagcatgtgcgactcggaccgatg

SEQ ID NO: 10661 - DNA, 203 bp, Homo sapiens
  source 1..203: mol_type = other DNA
ggcgcgccagtccttaaacgcgaagttgggtaaggatagatcaatcaatgatcatattctagtacacttaggattcaagatcctattatcagggacaagagcaggattagggatatccgagatggccacacttttgaggagcttagcattgttcaaaagaccgtccacttgcagacccattacatcagcgactcggaccgatg

SEQ ID NO: 10662 - DNA, 203 bp, Homo sapiens
  source 1..203: mol_type = other DNA
ggcgcgccagtcctcattcaggaagttgggtaaggatagatcaatcaatgatcatattctagtacacttaggattcttcgaggccaccgaagggacaagagcaggattagggatatccgagatggccacacttttgaggagcttagcattgttcaaaagaaacaaggacaaaccacccattacatcagcgactcggaccgatg

SEQ ID NO: 10663 - DNA, 203 bp, Homo sapiens
  source 1..203: mol_type = other DNA
ggcgcgccagtcctgtcctggcaagttgggtaagtccttcggcggacctgatcatattctagtacacttaggattcaagatcctattatcagggacaagagcaggattagggatatccgagatggccacacttttgaggagcttagcattgttcaaaagaaacaaggacaaaccacccattacatcagcgactcggaccgatg

SEQ ID NO: 10664 - DNA, 203 bp, Homo sapiens
  source 1..203: mol_type = other DNA
ggcgcgccagtcctgccaagataataacggtatagcagcgctctcctaagctctcgcggctgcgcttcggtcccggacccgggccacccacggggtagtgggtgctcctcggccccggacattgcaagccccagaaggcaagactaactcggtgttgctcctcccggcgctgacttcgaggcccggctcgactcggaccgatg

SEQ ID NO: 10665 - DNA, 203 bp, Homo sapiens
  source 1..203: mol_type = other DNA
ggcgcgccagtcctacccaagtaataattaggccgctcatgtgccgttctctcagcgaaggccgaaaagaggctagccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 10666 - DNA, 203 bp, Homo sapiens
  source 1..203: mol_type = other DNA
ggcgcgccagtcctcctataataataattaggcctagggaacaaatccctctcagcgaaggcactgtgattctctcccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 10667 - DNA, 203 bp, Homo sapiens
  source 1..203: mol_type = other DNA
ggcgcgccagtcctaggtccataataattaggcctagggaacaaatccctctcagcgaaggccgaaaagaggctagccatgcccttagtaggactagcataatgaggggggtagcaacagtggtgagttcgttggatggcttaagccctgagtacagggtagtcgtcagtggttatcatgagcaatgacgactcggaccgatg

SEQ ID NO: 10668 - DNA, 203 bp, Homo sapiens
  source 1..203: mol_type = other DNA
ggcgcgccagtcctgcatcgataataattaggcctagggaacaaatccctctcagcgaaggccgaaaagaggctagccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 10669 - DNA, 203 bp, Homo sapiens
  source 1..203: mol_type = other DNA
ggcgcgccagtcctagtagttcaatacaattttgagaggttaataaattacaagtagtgctatttttgtatttaggttagctatttagctttacgttccaggatgcctagtggcagccccacaatatccaggaagccctctctgcggtttttcagattaggtagtcgaaaaaccaccagttcgacttgcgactcggaccgatg

SEQ ID NO: 10670 - DNA, 203 bp, Homo sapiens
  source 1..203: mol_type = other DNA
ggcgcgccagtcctttgacgcaaatactcctaaacaactgctaggaccacggaactcagaaacacagcaagcgatcatattggaaatatggcccaaagtgacttcctttacccagagaacccaaaaaggcgggaagaagtaaatcgtcttcaccagcagcttcttgattgcttatctgacagcttcgacgactcggaccgatg

SEQ ID NO: 10671 - DNA, 203 bp, Homo sapiens
  source 1..203: mol_type = other DNA
ggcgcgccagtcctcgacacagaatactcctaaacaactgctaggaccacggaactcagaaacacagcaagcgatcatattggaaatatgttgtgggcccgtcgcctttacccagagaacccaaaaaggcgggaagaagtaaatcgtcttcaccagcagcttcttgattgcttatctgacagcttcgacgactcggaccgatg

SEQ ID NO: 10672 - DNA, 203 bp, Homo sapiens
  source 1..203: mol_type = other DNA
ggcgcgccagtcctcaaagtcgaatagtatgttcgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcgcgactcggaccgatg

SEQ ID NO: 10673 - DNA, 203 bp, Homo sapiens
  source 1..203: mol_type = other DNA
ggcgcgccagtcctagcgcgagaatataccctacgtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattacgactcggaccgatg

SEQ ID NO: 10674 - DNA, 203 bp, Homo sapiens
  source 1..203: mol_type = other DNA
ggcgcgccagtcctctttggcgaatatctgggagacctcgggctcttgatctccgagacaccccgtttcgtagtggagaacagtccagatcggggaagtttattttgcccaaagccggttagaggccccctggccctcgattcccacacttactagacttgctcccctgaacagcagctgcagcagcccgactcggaccgatg

SEQ ID NO: 10675 - DNA, 203 bp, Homo sapiens
  source 1..203: mol_type = other DNA
ggcgcgccagtcctaagagacaaatatctgggagacctcgggctcttgatctccgagacaccccgtttcgtagtggtatcgtaaagtctccggggaagtttattttgcccaaagccggttagaggccccctggccctcgattcccagtgcggggctcagagctcccctgaacagcagctgcagcagcccgactcggaccgatg

SEQ ID NO: 10676 - DNA, 203 bp, Homo sapiens
  source 1..203: mol_type = other DNA
ggcgcgccagtcctctcaacataatatctgggagacctcgggctcttggcggatacttttttccgtttcgtagtggagaacagtccagatcggggaagtttattttgcccaaagccggttagaggccccctggccctcgattcccagtgcggggctcagagctcccctgaacagcagctgcagcagcccgactcggaccgatg

SEQ ID NO: 10677 - DNA, 203 bp, Homo sapiens
  source 1..203: mol_type = other DNA
ggcgcgccagtcctaaagcactaatatgttcattaccaacactgcagattcccattgagttggtgggggttttgttacctttgttttttttctcagcaaaataattctataactttttgtttgtgacaagaaatggactttcagtttacttaagattaattgaagggtggattaaaaatcattttgcccgactcggaccgatg

SEQ ID NO: 10678 - DNA, 203 bp, Homo sapiens
  source 1..203: mol_type = other DNA
ggcgcgccagtcctgcacctcaaatattcacggcgttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 10679 - DNA, 203 bp, Homo sapiens
  source 1..203: mol_type = other DNA
ggcgcgccagtcctaggaacggaatatttctattgcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagaccgactcggaccgatg

SEQ ID NO: 10680 - DNA, 203 bp, Homo sapiens
  source 1..203: mol_type = other DNA
ggcgcgccagtcctagtttggcaatcactattttgtactactaactcacccgtttttctccgggatccaagagatttactctaggatctcctattaagcttagcagtcattagttgagagttcaacttgcaaaactctaaccttcactctaataacaattcatccaatggataaattggaactagtcacgactcggaccgatg

SEQ ID NO: 10681 - DNA, 203 bp, Homo sapiens
  source 1..203: mol_type = other DNA
ggcgcgccagtcctatcgggtcaatcactattttgtactactaactcattaagaaaaacttaggatccaagagatttactctaggatctcaggcatcatgggatagtcattagttgagagttcaacttgcaaaactctaaccttcactctaataacaattcatccaatggataaattggaactagtcacgactcggaccgatg

SEQ ID NO: 10682 - DNA, 203 bp, Homo sapiens
  source 1..203: mol_type = other DNA
ggcgcgccagtcctgttgtaacaatcccaacctcggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagccgtactagagacgacgactcggaccgatg

SEQ ID NO: 10683 - DNA, 203 bp, Homo sapiens
  source 1..203: mol_type = other DNA
ggcgcgccagtcctcctgggtcaatcccaacctcggagcaggtggtcacaaaccagtgattggcctgtcgtaacgcgcaagtccgtggcggaaccgactactttgggtgtccgtgtttccttttattttatttgaaggaggcggcctgacaatcacagattgttatcataaagcgaattggattggcccgactcggaccgatg

SEQ ID NO: 10684 - DNA, 203 bp, Homo sapiens
  source 1..203: mol_type = other DNA
ggcgcgccagtcctgggctcccaatcccaacctcggagcaggtggtcacaaaccagtgattggcctgtcgtaacgcttcgcattcgatttgaaccgactactttgggtgtccgtgtttccttttattttattgtggctgcttatggtgacaatcacagattgttatcataaagcgaattggattggcccgactcggaccgatg

SEQ ID NO: 10685 - DNA, 203 bp, Homo sapiens
  source 1..203: mol_type = other DNA
ggcgcgccagtccttttagggtaatcccaacctcggagcaggtggtcaggtctgtagtccatgcctgtcgtaacgcgcaagtccgtggcggaaccgactactttgggtgtccgtgtttccttttattttattgtggctgcttatggtgacaatcacagattgttatcataaagcgaattggattggcccgactcggaccgatg

SEQ ID NO: 10686 - DNA, 203 bp, Homo sapiens
  source 1..203: mol_type = other DNA
ggcgcgccagtcctaccagttaaatcccactcaaaatccaaaatcactaccagccactatctgctagacctagagtgcgaataggtaaataaaaccaaaatatgctcagccatacgtgtagttagagttcaatcaatctcaacaaccatttataccgccaattcaatacatatactataaatcttaaacgactcggaccgatg

SEQ ID NO: 10687 - DNA, 203 bp, Homo sapiens
  source 1..203: mol_type = other DNA
ggcgcgccagtcctcgtgtcataatcccactcaaaatccaaaatcactaccagccactatctgctagacctagagtgcgaataggtaaatcgcggagtgccgatgggtaaatagacattagttagagttcaatcaatctcaacaaccatttataccgccaattcaatacatatactataaatcttaaacgactcggaccgatg

SEQ ID NO: 10688 - DNA, 203 bp, Homo sapiens
  source 1..203: mol_type = other DNA
ggcgcgccagtcctcctaattcaatcccagtcctaacagaagtactgcgaatcttgtggcctcattctgaacaaaagggattagagaagaaaaatctcttgatataaggcttgaaagcaagggcaggcaatcaactggtcaccgtatttctgatttttccagaaatcaagcagaagattgagctgctgcgactcggaccgatg

SEQ ID NO: 10689 - DNA, 203 bp, Homo sapiens
  source 1..203: mol_type = other DNA
ggcgcgccagtcctgaatatccaatcccagtcctaacagaagtactgcgaatcttgtggcctcattctgaacaaaagggattagagaagatttgatctacatgctaaggcttgaaagcaagggcaggcaatcttggttgtgaatattttctgatttttccagaaatcaagcagaagattgagctgctgcgactcggaccgatg

SEQ ID NO: 10690 - DNA, 203 bp, Homo sapiens
  source 1..203: mol_type = other DNA
ggcgcgccagtcctcttcagataatcccagtcctaacagaagtactgcgaatcttgtggccttccaggtggttgttgggattagagaagaaaaatctcttgatataaggcttgaaagcaagggcaggcaatcttggttgtgaatattttctgatttttccagaaatcaagcagaagattgagctgctgcgactcggaccgatg

SEQ ID NO: 10691 - DNA, 203 bp, Homo sapiens
  source 1..203: mol_type = other DNA
ggcgcgccagtcctaaccgacgaatccccgcgcgccggccggccccgggcacgcaggcagggcggcgcaggatccagggcgtctgggatgcagtggagctcagagagaggagaacggctcctcacgcctggggcctgctcttcagaagtccccagcgccgcataggaagttcacggacctcagcagcccgactcggaccgatg

SEQ ID NO: 10692 - DNA, 203 bp, Homo sapiens
  source 1..203: mol_type = other DNA
ggcgcgccagtcctcgagatgcaatccccgcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcatcgagatgaggtgtcgactcggaccgatg

SEQ ID NO: 10693 - DNA, 203 bp, Homo sapiens
  source 1..203: mol_type = other DNA
ggcgcgccagtccttccgacggaatcgcgatcagagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 10694 - DNA, 203 bp, Homo sapiens
  source 1..203: mol_type = other DNA
ggcgcgccagtcctgtctgagtaatctctagcagtggcgcccgaacagggacctgaaagcgaaagggaaaccagaggagctctctcgacgtgctgagacaacccctgaagcgcgcacggcaagaggcgaggggcggcgactggtgagtacgccaaaaattttgactagcggaggctagaaggagagagcgactcggaccgatg

SEQ ID NO: 10695 - DNA, 203 bp, Homo sapiens
  source 1..203: mol_type = other DNA
ggcgcgccagtcctgtctgcccaatggaagaaagcagggcataagatcacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagagcgactcggaccgatg

SEQ ID NO: 10696 - DNA, 203 bp, Homo sapiens
  source 1..203: mol_type = other DNA
ggcgcgccagtccttattaagtaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaattccatcaatggggtgaagaatcagagcgactcggaccgatg

SEQ ID NO: 10697 - DNA, 203 bp, Homo sapiens
  source 1..203: mol_type = other DNA
ggcgcgccagtcctctgaagtcaatggaagaaagggacctgctgtccgacttacaggacatcagcgacagcgagaggaagaccagctcggggccagggaatgtcgcagaatcaggctcaggttctgaggaagaagaggaggaggaggaagaggaggaggaggaagggagcaccagtgaagaatcagagcgactcggaccgatg

SEQ ID NO: 10698 - DNA, 203 bp, Homo sapiens
  source 1..203: mol_type = other DNA
ggcgcgccagtcctaacattggaatggcataggtgcccgcgtgcgccatcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 10699 - DNA, 203 bp, Homo sapiens
  source 1..203: mol_type = other DNA
ggcgcgccagtcctgaaagctgaatggcttcgctcatttatagacaattgctcacgaattcttatacagtagatttatccgatgagatacaagagattggatcaactaaatcacaaaatgtcacaattaatctctacagccaaaaccaaacaggttatgctccagttaactggggacctggagaaattcgactcggaccgatg

SEQ ID NO: 10700 - DNA, 203 bp, Homo sapiens
  source 1..203: mol_type = other DNA
ggcgcgccagtccttagtaatgaatggcttcgctcatttatagacaattgctcacgaattcttatacagtagatttatccgatgagatacgctgtggcaatcgcactaaatcacaaaatgtcacaattaatcctggaccatttgcgcaaacaggttatgctccagttaactggggacctggagaaattcgactcggaccgatg

SEQ ID NO: 10701 - DNA, 203 bp, Homo sapiens
  source 1..203: mol_type = other DNA
ggcgcgccagtcctggagccgcaatgtgatcttgcttgtaaatacaattttgagaggttaataaattacaagtagtgctatttttgtatttaggttagctatttagctttacgttccaggatgcctagtggcagccccacaatatccaggaagccctctcgcgtaggccatgtgttaggtagtcgaaacgactcggaccgatg

SEQ ID NO: 10702 - DNA, 203 bp, Homo sapiens
  source 1..203: mol_type = other DNA
ggcgcgccagtcctcgcgactgaatgtgatcttgcttgtaaatacaattttgagaggttaataaattacaagtagtgctatttttgtatttaggttagctatttagctttacgttccaggatgcctagtggcagccccacaatatccaggaagccctctctgcggtttttcagacggctagcagatcgcgactcggaccgatg

SEQ ID NO: 10703 - DNA, 203 bp, Homo sapiens
  source 1..203: mol_type = other DNA
ggcgcgccagtcctcggtcgagaatgtgatcttgcttgtaaatacaattttgagaggttaatccggcgttgtctaagctatttttgtatttaggttagctatttagctttacgttccaggatgcctagtggcagccccacaatatccaggaagccctctctgcggtttttcagattaggtagtcgaaacgactcggaccgatg

SEQ ID NO: 10704 - DNA, 203 bp, Homo sapiens
  source 1..203: mol_type = other DNA
ggcgcgccagtcctagtcatctaatgttgtacccctaagagtcataaactctggaattactcagtttcaaaagggaaaggagtttgagtttgtagaaggacaaggtgtgcctattgcaccaggagtcccagctactgaagctaaggggtactggtacagacacaacagacgttcttttaaaacagccgcgactcggaccgatg

SEQ ID NO: 10705 - DNA, 203 bp, Homo sapiens
  source 1..203: mol_type = other DNA
ggcgcgccagtcctattccttcaatgttgtaccctactattcttggttctctggaattactcagtttcaaaagggaaaggagtttgagtttgtagaaggacaaggtgtgcctattgcaccaggagtcccagccgaccggttcctctggtactggtacagacacaacagacgttcttttaaaacagccgcgactcggaccgatg

SEQ ID NO: 10706 - DNA, 203 bp, Homo sapiens
  source 1..203: mol_type = other DNA
ggcgcgccagtcctatgcatttaatgttgtaccctactattcttggttctctggaattactcagtttcaaaagggagtatttaacttagatgtagaaggacaaggtgtgcctattgcaccaggagtcccagctactgaagctaaggggtactggtacagacacaacagacgttcttttaaaacagccgcgactcggaccgatg

SEQ ID NO: 10707 - DNA, 203 bp, Homo sapiens
  source 1..203: mol_type = other DNA
ggcgcgccagtccttccgtaataattatagaaagttctgaacctaggggtctttctgtctctgctgtgtggtgggaatcacacggtctccactaatcacatacgaatctgtaaaagaacggtgctgccgcttttgctttaattcaaatgaagaatatgaagtgcactttgaaagtcgaggaaacaactcgactcggaccgatg

SEQ ID NO: 10708 - DNA, 203 bp, Homo sapiens
  source 1..203: mol_type = other DNA
ggcgcgccagtcctattagcggaattccagacctctctgtgcttagggcaaacatcatttggccttaaatgggattctgtgagaggggatccctccattgacagctggactgttctttggggccttatgtggtgtttgcctctgaggtactcaggggcataccctcagagtactattcttaaataatacgactcggaccgatg

SEQ ID NO: 10709 - DNA, 203 bp, Homo sapiens
  source 1..203: mol_type = other DNA
ggcgcgccagtcctcgcctactaattccagacctctctgtgcttagggcaaacatcatttggccttaaatgggattctgtgagaggggatccctccattgacagctggactgttctttggggccttatgtggtgtttgcctctgagtagacggctacgtgttaggtttttcctcattcttaaataatacgactcggaccgatg

SEQ ID NO: 10710 - DNA, 203 bp, Homo sapiens
  source 1..203: mol_type = other DNA
ggcgcgccagtcctccggcactaattccagacctctctgtgcttagggtcgggccagggaccccttaaatgggattctgtgagaggggatccctccattgacagctggactgttctttggggccttatgtggtgtttgcctctgaggtactcaggggcatttaggtttttcctcattcttaaataatacgactcggaccgatg

SEQ ID NO: 10711 - DNA, 203 bp, Homo sapiens
  source 1..203: mol_type = other DNA
ggcgcgccagtcctgcaccagtaattcttgagaggttcttggagagattctgggagccaaacactccattgggatcctagctggaatataaagaatggcttatcagtggagaccatcgacagttgagaaaagaagaagcccaaaaagtacaagaatgaaagctaccttcacgccgagaacaacttgtacgactcggaccgatg

SEQ ID NO: 10712 - DNA, 203 bp, Homo sapiens
  source 1..203: mol_type = other DNA
ggcgcgccagtcctcctacgcaaattgcaattgagacttgactcccctttgtacctccagagacctcctagagccagaacccggctggcttgctgtttcctttagagcagcgcatatcattatttggtgttctggtggaggacttttctgatggcagaaattagtttctctgggttcatcaggacgggcgactcggaccgatg

SEQ ID NO: 10713 - DNA, 203 bp, Homo sapiens
  source 1..203: mol_type = other DNA
ggcgcgccagtcctctgaggctaattgcaattgatcaggtttatattattgtacctccagagacctcctagagccacgtggtacgaacgatgctgtttcctttagagcagcgcatatcattatttggtgttctggtggaggacttttctgatggcagaaattagtttctctgggttcatcaggacgggcgactcggaccgatg

SEQ ID NO: 10714 - DNA, 203 bp, Homo sapiens
  source 1..203: mol_type = other DNA
ggcgcgccagtcctccctcaagaattgcaattgatcaggtttatattattgtacctccagagacctcctagagccagaacccggctggcttgctgtttcctttagagcagcgcatatcattatttggtgttctggtggaggacttttctgatggcagaaaccgtggagcaatatttcatcaggacgggcgactcggaccgatg

SEQ ID NO: 10715 - DNA, 203 bp, Homo sapiens
  source 1..203: mol_type = other DNA
ggcgcgccagtcctcggcagcgaatttaacaggatacttggacaatagaagccagatcaaaagtaagaaaaacttaactgcggattggcgtcacagatcagctcaaccagacaccaccagcatacacgaaaccaaccttcacagtggatacctcagcatccaaaactctccttcccgaatggatcaggcgactcggaccgatg

SEQ ID NO: 10716 - DNA, 203 bp, Homo sapiens
  source 1..203: mol_type = other DNA
ggcgcgccagtcctagtggccaaatttaacaggatacttggacaatagtctttcttagtttggtaagaaaaacttagggtgaatgacaattcacagatcagctcaaccagacaccaccagcatacacgaaaccaaccttcacagtggatacctcagcatccaaaactctccttcccgaatggatcaggcgactcggaccgatg

SEQ ID NO: 10717 - DNA, 203 bp, Homo sapiens
  source 1..203: mol_type = other DNA
ggcgcgccagtccttcgtatgtaatttgttctcctgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcgactcggaccgatg

SEQ ID NO: 10718 - DNA, 203 bp, Homo sapiens
  source 1..203: mol_type = other DNA
ggcgcgccagtccttcataaataattttgccttaaacagaaagacttgaccctcttaggtgtcatacctaagatcagtgtgttttttgtgatatcaaagcagtacaccaaaaaagagaagaaatattgcagtgaatgaagattcctctgcattttagcactgctttttcaactgtagttggcttttgacgactcggaccgatg

SEQ ID NO: 10719 - DNA, 203 bp, Homo sapiens
  source 1..203: mol_type = other DNA
ggcgcgccagtccttgtcaagcaattttgccttaaacagaaagacttgaccctcttaggtgtcatacctaagatcagtgtgttttttgtgtccaattcttttatagtgtgttcccgcgagaaatattgcagtgaatgaagattcctctgcattttagcactgctttttcaactgtagttggcttttgacgactcggaccgatg

SEQ ID NO: 10720 - DNA, 203 bp, Homo sapiens
  source 1..203: mol_type = other DNA
ggcgcgccagtcctactaacataattttgccttaaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgggacaatacccgagcgactcggaccgatg

SEQ ID NO: 10721 - DNA, 203 bp, Homo sapiens
  source 1..203: mol_type = other DNA
ggcgcgccagtccttgcgtcgtaattttgccttaaacagaaagacttgaccctcttaggtgtcatacctaagatcagtgtgttttttgtgtccaattcttttatcaccaaaaaagagagatcgctggaagacgaatgaagattcctctgcattttagcactgctttttcaactgtagttggcttttgacgactcggaccgatg

SEQ ID NO: 10722 - DNA, 203 bp, Homo sapiens
  source 1..203: mol_type = other DNA
ggcgcgccagtcctgatttctaaattttgccttaaacagaaagacttgcatagggcgttgtccatacctaagatcagtgtgttttttgtgtccaattcttttatcaccaaaaaagagaagaaatattgcagtgaatgaagattcctctgcattttagcactgctttttcaactgtagttggcttttgacgactcggaccgatg

SEQ ID NO: 10723 - DNA, 203 bp, Homo sapiens
  source 1..203: mol_type = other DNA
ggcgcgccagtcctatctcaatacaaaatcaaaccagcatctcagacttcctgctcctgggcctgcccatccaaccagagcagcaaaaccgcccaatatatagtttcttggccatgtatcttaccaccctcctggggaacctcctcatcattgtcctcattcgactggactcccatctccacacgcctcgactcggaccgatg

SEQ ID NO: 10724 - DNA, 203 bp, Homo sapiens
  source 1..203: mol_type = other DNA
ggcgcgccagtcctactgtaagacaaaatcaaaccagcatctcagacttcctgctcctgggcctgcccatccaaccagagcagcaaaacctgtgctatgccctgttcttggccatgtatcttaccaccctcctggggaacctcctcatcattgtcctcatctagtacacagattatctccacacgcctcgactcggaccgatg

SEQ ID NO: 10725 - DNA, 203 bp, Homo sapiens
  source 1..203: mol_type = other DNA
ggcgcgccagtcctaatttaccacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctcgactcggaccgatg

SEQ ID NO: 10726 - DNA, 203 bp, Homo sapiens
  source 1..203: mol_type = other DNA
ggcgcgccagtccttcgggcttacaaaatcaaaccagcatctcagacttcctgctcctgggctaatgggcgacggaagagcagcaaaacctgtgctatgccctgttcttggccatgtatcttaccaccctcctggggaacctcctcatcattgtcctcattcgactggactcccatctccacacgcctcgactcggaccgatg

SEQ ID NO: 10727 - DNA, 203 bp, Homo sapiens
  source 1..203: mol_type = other DNA
ggcgcgccagtccttacccggaacaaaccagtgggtggtgtgtcgtaacgggcaactctgcagcggaaccgactactttgggtgtccgtgtttccttttattcctatattggctgcttcgaaaactttcatgaaagttgttaccatatagctattggattggccatccggtgtgcaacagggcaattgcgactcggaccgatg

SEQ ID NO: 10728 - DNA, 203 bp, Homo sapiens
  source 1..203: mol_type = other DNA
ggcgcgccagtccttcggtaggacacaaggaggaatggtgacaatcaaaaagttgttaccatatagctattggattggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 10729 - DNA, 203 bp, Homo sapiens
  source 1..203: mol_type = other DNA
ggcgcgccagtccttcggcccaacaccaaaacgcatccacctaactggctgacgctacaccttggtctttccgggtatgccgcacacggcctccaactcctgcagagctgagccggaggggaatccggaagggacacgctgaacaggaacagaaatgaataaaagtcgctggcagagtagaagacgaccgactcggaccgatg

SEQ ID NO: 10730 - DNA, 203 bp, Homo sapiens
  source 1..203: mol_type = other DNA
ggcgcgccagtcctgacagggtacaccaaaacgcatccacctaactggctgacgctacaccttggtctttccgggtccttgcacgcttcgctccaactcctgcagagctgagccggaggggaatccggaaggccggacaactgattgaacagaaatgaataaaagtcgctggcagagtagaagacgaccgactcggaccgatg

SEQ ID NO: 10731 - DNA, 203 bp, Homo sapiens
  source 1..203: mol_type = other DNA
ggcgcgccagtcctgaattaatacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcatctgtctgtcttcgcgactcggaccgatg

SEQ ID NO: 10732 - DNA, 203 bp, Homo sapiens
  source 1..203: mol_type = other DNA
ggcgcgccagtcctgcgggatcacaccaaaacgcatccacctaactggctgacgctacaccttggtctttccgggtccttgcacgcttcgctccaactcctgcagagctgagccggaggggaatccggaagggacacgctgaacagtttgttctcctgcaaaaagtcgctggcagagtagaagacgaccgactcggaccgatg

SEQ ID NO: 10733 - DNA, 203 bp, Homo sapiens
  source 1..203: mol_type = other DNA
ggcgcgccagtcctcaaatcggacagagcagaggaccagcagatgaatcttgcaacctccatagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 10734 - DNA, 203 bp, Homo sapiens
  source 1..203: mol_type = other DNA
ggcgcgccagtcctaacgttcaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 10735 - DNA, 203 bp, Homo sapiens
  source 1..203: mol_type = other DNA
ggcgcgccagtcctcagacgtgacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagacattgccatgagagcgactcggaccgatg

SEQ ID NO: 10736 - DNA, 203 bp, Homo sapiens
  source 1..203: mol_type = other DNA
ggcgcgccagtcctataccggcacagagcagaggaccagcagatgaatggacaccttgaagcagaggagcagcaggaccagagatcacccctgacctgctacctcggccgccccggttgcttctattggtcagcgttgcatccttacggggcctggcctggcagtggtgtaagaaccacgtgcttccccgactcggaccgatg

SEQ ID NO: 10737 - DNA, 203 bp, Homo sapiens
  source 1..203: mol_type = other DNA
ggcgcgccagtcctagtaaggtacagagcagaggaccagcagatgaatggacaccttgaagcagaggagcagcaggaccagagatcacccctgacctgctaccttctggaggagcagagcttctattggtcaatccctttgggggtcggggcctggcctggcagtggtgtaagaaccacgtgcttccccgactcggaccgatg

SEQ ID NO: 10738 - DNA, 203 bp, Homo sapiens
  source 1..203: mol_type = other DNA
ggcgcgccagtcctgagacgaaacagagcagagggatcttcccaccgcggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 10739 - DNA, 203 bp, Homo sapiens
  source 1..203: mol_type = other DNA
ggcgcgccagtcctagggagtcacagcggccctagaagggggatcttgggtgaaggtcagggcttgggcgctagctctccgaggcctgttctgaatcggtctccagaaatgctttgggagacgtcactgcgtctgcaaggaacttccatgcctctaacactcatcttcaaaagactgggactgctgagcgactcggaccgatg

SEQ ID NO: 10740 - DNA, 203 bp, Homo sapiens
  source 1..203: mol_type = other DNA
ggcgcgccagtcctgttggcatacagcggccctagaagggggatcttgggtgaaggtcagggcttgggcgctagctctccgaggcctgttctgaatcggtctccagaaatgctttgggttcatctttcattgctgcaaggaacttccatgcctctaacacatcgggcttgtcctctgggactgctgagcgactcggaccgatg

SEQ ID NO: 10741 - DNA, 203 bp, Homo sapiens
  source 1..203: mol_type = other DNA
ggcgcgccagtccttccgcgaaacagcggccctagaagggggatcttgggtgaaggtcagggcttgggcgctagctctccgaggcctgttctgaatcggtctccgccctcaaggcaatttcatctttcattgctgcaaggaacttccatgcctctaacactcatcttcaaaagactgggactgctgagcgactcggaccgatg

SEQ ID NO: 10742 - DNA, 203 bp, Homo sapiens
  source 1..203: mol_type = other DNA
ggcgcgccagtccttcgttataacagtaaccttggtcgcacccccctgcaaccctcacctctttacaaaaccacatcaacatctcaccatgcaagccatcatccatattataaagtagttaattaaaaataatcataacaatgaactaagatattaagactaacaataacgttggggcaaatgcaaaccgactcggaccgatg

SEQ ID NO: 10743 - DNA, 203 bp, Homo sapiens
  source 1..203: mol_type = other DNA
ggcgcgccagtccttatcggatacagtgcttggacggaacccggcgctaaacgtagtatagtgccggccgcccatagccagccctccgtcacctcttcaccgcaccctcggactgccccaaggcccccgccgccgctccagcgccgcgcagccaccgccgccgccgccgcctctccttagtcgccgcccgactcggaccgatg

SEQ ID NO: 10744 - DNA, 203 bp, Homo sapiens
  source 1..203: mol_type = other DNA
ggcgcgccagtcctagtgctgcacagtgcttggacggaacccggcgctcgttccccaccccggccggccgcccatagccagccctccgtcacctcttcaccgcaatacatcctgtggacaaggcccccgccgccgctccagcgccgcgcagccaccgccgccgccgccgcctctccttagtcgccgcccgactcggaccgatg

SEQ ID NO: 10745 - DNA, 203 bp, Homo sapiens
  source 1..203: mol_type = other DNA
ggcgcgccagtcctgaaaccctacagtgcttggacggaacccggcgctcgttccccaccccggccggccgcccatatgataattagaagaacctcttcaccgcaccctcggactgccccaaggcccccgccgccgctccagcgccgcgcagccaccgccgccgccgccgcctctccttagtcgccgcccgactcggaccgatg

SEQ ID NO: 10746 - DNA, 203 bp, Homo sapiens
  source 1..203: mol_type = other DNA
ggcgcgccagtcctggtgctcaacatagatgttccttaaaagctaaatctttttgaacagatgatgataaacctggaagagattcaccaaatgccatttgacggacactggcttggaaagtactcccatgttccgtttgatcttggcaatttaatgctgttcttgaagactaattagttacactggatcgactcggaccgatg

SEQ ID NO: 10747 - DNA, 203 bp, Homo sapiens
  source 1..203: mol_type = other DNA
ggcgcgccagtcctgacgcgtaacatagatgttccttaaaagctaaatctttttgaacagatgatgataaacctggaagagattcaccaacaatagcaaattacacactggcttggaaagtactcccatgttccgtttgatcttggcaatttaatgctgtcaaacgtagaactatagttacactggatcgactcggaccgatg

SEQ ID NO: 10748 - DNA, 203 bp, Homo sapiens
  source 1..203: mol_type = other DNA
ggcgcgccagtcctggcagtaaacatagatgttccttaaaagctaaattggacgccgtctgggatgataaacctggaagagattcaccaacaatagcaaattacacactggcttggaaagtactcccatgttccgtttgatcttggcaatttaatgctgttcttgaagactaattagttacactggatcgactcggaccgatg

SEQ ID NO: 10749 - DNA, 203 bp, Homo sapiens
  source 1..203: mol_type = other DNA
ggcgcgccagtcctctactagaacatcataagaacgttcagaggctcatttgataaatagaagatttatttgggcttggtggtaagtgtgattttatgttttctttgattttcttgtagacttgttcctgacgctgctacaggagcagaagactaacaagcttcatttatttttccaggtaagcaaaccgactcggaccgatg

SEQ ID NO: 10750 - DNA, 203 bp, Homo sapiens
  source 1..203: mol_type = other DNA
ggcgcgccagtcctcgtagcctacatcatttcgctttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagacgactcggaccgatg

SEQ ID NO: 10751 - DNA, 203 bp, Homo sapiens
  source 1..203: mol_type = other DNA
ggcgcgccagtcctagatcaccacatgttttatgtcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggacgactcggaccgatg

SEQ ID NO: 10752 - DNA, 203 bp, Homo sapiens
  source 1..203: mol_type = other DNA
ggcgcgccagtcctagtgggacacattgcgaaaacacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 10753 - DNA, 203 bp, Homo sapiens
  source 1..203: mol_type = other DNA
ggcgcgccagtcctcgatgcgcaccaattgaacgatggtgacaatcatagattgttatcataaagcgagttggattggccatccagtgtgaatcagattaattactcccttgtttgttggatccactcccgaaacgttttactccttaacttattgaaattgtttgaagacaggatttcagtgtcacacgactcggaccgatg

SEQ ID NO: 10754 - DNA, 203 bp, Homo sapiens
  source 1..203: mol_type = other DNA
ggcgcgccagtcctactatgacaccaggggcgccaggattcaacactccaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagcgactcggaccgatg

SEQ ID NO: 10755 - DNA, 203 bp, Homo sapiens
  source 1..203: mol_type = other DNA
ggcgcgccagtccttggtacgcaccaggggcgccgccgccggcgctcgcaggccgcggatgaagaagaaaacccggcgccgctcgacccggagcgaggagttgacccggagcgaggagttgaccctgagtgaggaagcgacctggacaagctgaatagatcagagtgaggaggcgacccagggcgaagcgactcggaccgatg

SEQ ID NO: 10756 - DNA, 203 bp, Homo sapiens
  source 1..203: mol_type = other DNA
ggcgcgccagtcctgggctgataccaggtgtggaaagtccccaggctccccagcaggcagaagtatgcaaagcatgcatctcaattagtcccactaatctactacgcccctaactccgcccatcccgcccctaactccgcccagttccgcccattctccgccccatggctgactaattttttttatttcgactcggaccgatg

SEQ ID NO: 10757 - DNA, 203 bp, Homo sapiens
  source 1..203: mol_type = other DNA
ggcgcgccagtcctagttaagaaccaggtgtggaaagtccccaggctccccagcaggcagaagtatgcaaagcatggggaagggccttgaagcaaccatagtcccgcccctaactccgcccatcccgcccctaactccgcccagttccgcccattctccgccccatggctgactaattttttttatttcgactcggaccgatg

SEQ ID NO: 10758 - DNA, 203 bp, Homo sapiens
  source 1..203: mol_type = other DNA
ggcgcgccagtcctagaccctgaccaggtgtggaaagtccccaggctcgatctatccacccggtatgcaaagcatgcatctcaattagtcagcaaccatagtcccgcccctaactccgcccatcccgcccctaactccgcccagttccgcccattctccgccccatggctgactaattttttttatttcgactcggaccgatg

SEQ ID NO: 10759 - DNA, 203 bp, Homo sapiens
  source 1..203: mol_type = other DNA
ggcgcgccagtcctgggtttgcacccagccccgatcctaaggggtcggggcttttgctcactcagcacaggatctgatcaggagacctcccccccctgctttacagggggcgggggttctcttgcgataacgggcctggcaaataacctaggggactaggttttcctttttattttaaagttgtcaatcgactcggaccgatg

SEQ ID NO: 10760 - DNA, 203 bp, Homo sapiens
  source 1..203: mol_type = other DNA
ggcgcgccagtcctttgcgtgtacccagccccgatcctaaggggtcggggcttttgctcactcagcacaggatctgatcaggagacctcccccccctgctttacagggggcgggggtttaaaaattgcccaaggcctggcaaataacctaggggactaggttttcctttttattggccgaaataattacgactcggaccgatg

SEQ ID NO: 10761 - DNA, 203 bp, Homo sapiens
  source 1..203: mol_type = other DNA
ggcgcgccagtcctaggatagaacccagccccgatcctaaggggtcggggcttttgctcactcagcacaggatctgatcaggagacctcccccccctgctttacagggggcgggggtttaaaaattgcccaaggcctggcaaataacctaggggactaggttttcctttttattttaaagttgtcaatcgactcggaccgatg

SEQ ID NO: 10762 - DNA, 203 bp, Homo sapiens
  source 1..203: mol_type = other DNA
ggcgcgccagtcctccttcctaacccagccccgatcctaaggggtcggggcttttgctcactcagcacaggatctggatcatcacgtggtcccccctgctttacagggggcgggggtttaaaaattgcccaaggcctggcaaataacctaggggactaggttttcctttttattttaaagttgtcaatcgactcggaccgatg

SEQ ID NO: 10763 - DNA, 203 bp, Homo sapiens
  source 1..203: mol_type = other DNA
ggcgcgccagtcctatatgaacacccagccccgatcctaaggggtcggggcttttgctcactggtggggctcctaaatcaggagacctcccccccctgctttacagggggcgggggtttaaaaattgcccaaggcctggcaaataacctaggggactaggttttcctttttattttaaagttgtcaatcgactcggaccgatg

SEQ ID NO: 10764 - DNA, 203 bp, Homo sapiens
  source 1..203: mol_type = other DNA
ggcgcgccagtccttgaatacgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccaccgactcggaccgatg

SEQ ID NO: 10765 - DNA, 203 bp, Homo sapiens
  source 1..203: mol_type = other DNA
ggcgcgccagtcctgcgatgcaaccccgagaaaccgaaaccgcagggcctagggcgggtggaacgagagggaactacatttcccagcaggctgcggaaacgggactgcggccactacttgtttaaatcaccgagagactggcgtccggcgtgtaccgagagactggcgtccggtgtgcaggtggccaccgactcggaccgatg

SEQ ID NO: 10766 - DNA, 203 bp, Homo sapiens
  source 1..203: mol_type = other DNA
ggcgcgccagtcctaaccgtaaaccccgagaaaccgaaaccgcagggcctagggcgggtggaacgagagggaactacatttcccagcaggctgcggaaacgggatacgttggctctagtccggcgtgtaccgagagactggcgtccggcgtgtaccgagagactggcgtccggtgtgcaggtggccaccgactcggaccgatg

SEQ ID NO: 10767 - DNA, 203 bp, Homo sapiens
  source 1..203: mol_type = other DNA
ggcgcgccagtcctcgtcttgcaccccgagaaaccgaaaccgcagggcctagggcgggtggaacgagagggaactacatttcccagcaggtgcttctctattacctgcggccactacttccggcgtgtaccgagagactggcgtccggcgtgtaccgagagactggcgtccggtgtgcaggtggccaccgactcggaccgatg

SEQ ID NO: 10768 - DNA, 203 bp, Homo sapiens
  source 1..203: mol_type = other DNA
ggcgcgccagtcctaggccaagaccccgagaaaccgaaaccgcagggcctagggcgggtggacgagccccactaagcatttcccagcaggctgcggaaacgggactgcggccactacttccggcgtgtaccgagagactggcgtccggcgtgtaccgagagactggcgtccggtgtgcaggtggccaccgactcggaccgatg

SEQ ID NO: 10769 - DNA, 203 bp, Homo sapiens
  source 1..203: mol_type = other DNA
ggcgcgccagtcctataaatccaccccgagaaaccgaaaccgcagggcgcgttttaccgaacacgagagggaactacatttcccagcaggctgcggaaacgggactgcggccactacttccggcgtgtaccgagagactggcgtccggcgtgtaccgagagactggcgtccggtgtgcaggtggccaccgactcggaccgatg

SEQ ID NO: 10770 - DNA, 203 bp, Homo sapiens
  source 1..203: mol_type = other DNA
ggcgcgccagtcctgcgttctgaccccggctactcctgctcagcatggctgctttagggactgttctcttcacaggtgtccggaggctgcactgcagcgtagccatcctacttccaccccagtggcgactacagcagggactggctgccaacccctccggctacgggccccttaccgagctcccagaccgactcggaccgatg

SEQ ID NO: 10771 - DNA, 203 bp, Homo sapiens
  source 1..203: mol_type = other DNA
ggcgcgccagtcctggtagattaccccggctactcctgctcagcatggtcctacaccttcaggttctcttcacaggtgtccggaggctgcactgcagcgtagccgcttgggcgggcggccagtggcgactacagcagggactggctgccaacccctccggctacgggccccttaccgagctcccagaccgactcggaccgatg

SEQ ID NO: 10772 - DNA, 203 bp, Homo sapiens
  source 1..203: mol_type = other DNA
ggcgcgccagtcctcggccgttaccccggctacttgccgcggttcgaactgctttagggactgttctcttcacaggtgtccggaggctgcactgcagcgtagccgcttgggcgggcggccagtggcgactacagcagggactggctgccaacccctccggctacgggccccttaccgagctcccagaccgactcggaccgatg

SEQ ID NO: 10773 - DNA, 203 bp, Homo sapiens
  source 1..203: mol_type = other DNA
ggcgcgccagtcctttcgctttacccctgaatggcaatctcaagcgcctctgtagggaagccaagaatgtccaggaggtaccccttcctctcggaagggatctgacctggagacacatacggtccctcaatgacctgtgcttgtgtttaaaaattgttacagcttccccgaaccaagtggtcttggttcgactcggaccgatg

SEQ ID NO: 10774 - DNA, 203 bp, Homo sapiens
  source 1..203: mol_type = other DNA
ggcgcgccagtcctgagcgcacacccctgaatggcaatctcaagcgcctctgtagggaagccaagaatgtccaggaggtaccccttcctctcggaagggatctgacctggagacacatcacacgtgctttacacctgtgcttgtgtcgggtgtcaccacgagcttccccgaaccaagtggtcttggttcgactcggaccgatg

SEQ ID NO: 10775 - DNA, 203 bp, Homo sapiens
  source 1..203: mol_type = other DNA
ggcgcgccagtcctgagaccggaccctgatggtttcctcacttgtgtccccaatggggctagctcgggtccacaacagctgccgatcaatccatctgaccagaatgtttcatgggtgtccagattttatcaattaaagcctgtgggaactgccagctcggcaagaggtaggcttggtctgcgccgatacgactcggaccgatg

SEQ ID NO: 10776 - DNA, 203 bp, Homo sapiens
  source 1..203: mol_type = other DNA
ggcgcgccagtcctccgcgagcaccctgcactccgtcgccggaagtgccaccgagaagcgccggcctcggggctgtctacagcggcccgggagaggctgtggtggccccgagcgcgaggtgagctcaccagcgacagcggccaggcccgcccctcccctcgtgatggtcattgtcctccagagcagtgcgactcggaccgatg

SEQ ID NO: 10777 - DNA, 203 bp, Homo sapiens
  source 1..203: mol_type = other DNA
ggcgcgccagtcctgctattggaccctgcactccgtcgccggaagtgccaccgagaagcgccggcctcggggctgtctacagcggcccgggagaggctgtggtggccccgagcgcgagtgtgtaggtgacaggacagcggccaggctatatgacttgacggtgatggtcattgtcctccagagcagtgcgactcggaccgatg

SEQ ID NO: 10778 - DNA, 203 bp, Homo sapiens
  source 1..203: mol_type = other DNA
ggcgcgccagtccttgggctcgaccctgcactccgtcgccggaagtgccaccgagaagcgccggcctcggggctgttatactgtatttatgagaggctgtggtggccccgagcgcgagtgtgtaggtgacaggacagcggccaggcccgcccctcccctcgtgatggtcattgtcctccagagcagtgcgactcggaccgatg

SEQ ID NO: 10779 - DNA, 203 bp, Homo sapiens
  source 1..203: mol_type = other DNA
ggcgcgccagtcctagcgtgttaccgcccgagactgtgtttcctgtgagtccagatgtgtgatccagatatgctgcttgctaatacagccctgttgactgagactaggagcgtgcctgaaactccatccctcctcctattattttttaatggtgcttctactggaatagtcaacaaagtgcacccaaccgactcggaccgatg

SEQ ID NO: 10780 - DNA, 203 bp, Homo sapiens
  source 1..203: mol_type = other DNA
ggcgcgccagtcctcacgcctcacctcacccggtcctcgcagagttgcggccgcccgccccttcagccccggctctccgtatgcgcatgagcagaggcgcctccaagatagtacgatcaggctaaactttctaattcccttctttgggctcgggggctcccggagcagggcgagagctcgcgtcgccgcgactcggaccgatg

SEQ ID NO: 10781 - DNA, 203 bp, Homo sapiens
  source 1..203: mol_type = other DNA
ggcgcgccagtcctatagcgtaacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgcgactcggaccgatg

SEQ ID NO: 10782 - DNA, 203 bp, Homo sapiens
  source 1..203: mol_type = other DNA
ggcgcgccagtcctcataacgcacctcacccggtcctcgcagagttgcggccgcccgccccttcagccccggctctccgtatgcgcatgagcagaggcgcctccctctgttcctcccaaggctaaactttctaattcccttctttgggctcgggggctcccggagcagggcgagctgaaagccaaggacgactcggaccgatg

SEQ ID NO: 10783 - DNA, 203 bp, Homo sapiens
  source 1..203: mol_type = other DNA
ggcgcgccagtcctaccttacgacctcacccggtcctcgcagagttgcggccgcccgccccttcagccccggctctccgtatgcgcatgagcagaggcgcctccctctgttcctcccaaggctaaactttctaattcccttctttgttacgttacatcgtcggagcagggcgagagctcgcgtcgccgcgactcggaccgatg

SEQ ID NO: 10784 - DNA, 203 bp, Homo sapiens
  source 1..203: mol_type = other DNA
ggcgcgccagtcctgcacaggaacctcacccggtcctcgcagagttgcggccgcccgccccttcagccccggctctccgtatgcgcatgatttccaaatttcagctctgttcctcccaaggctaaactttctaattcccttctttgggctcgggggctcccggagcagggcgagagctcgcgtcgccgcgactcggaccgatg

SEQ ID NO: 10785 - DNA, 203 bp, Homo sapiens
  source 1..203: mol_type = other DNA
ggcgcgccagtcctctacgattacctcacccggtcctcgcagagttgcggccgcccgccccttcagccccggctctgatccgcattcgaggcagaggcgcctccctctgttcctcccaaggctaaactttctaattcccttctttgggctcgggggctcccggagcagggcgagagctcgcgtcgccgcgactcggaccgatg

SEQ ID NO: 10786 - DNA, 203 bp, Homo sapiens
  source 1..203: mol_type = other DNA
ggcgcgccagtcctgggtccgaacctccaagagaaaataaccggggaccagagaggaaagacaggtccttaggtcctcaccctcccgtctccttgcccttgcagttctgggaactggacagattggacaactataacgacacctccctggtggaaaatcatctctgccctgccacagaggggcccctccgactcggaccgatg

SEQ ID NO: 10787 - DNA, 203 bp, Homo sapiens
  source 1..203: mol_type = other DNA
ggcgcgccagtcctggtacctaacctccaagagagctagggttcctctcagagaggaaagacaggtccttaggtcccatttagtgacctcccttgcccttgcagttctgggaactggacagattggacaactataacgacacctccctggtggaaaatcatctctgccctgccacagaggggcccctccgactcggaccgatg

SEQ ID NO: 10788 - DNA, 203 bp, Homo sapiens
  source 1..203: mol_type = other DNA
ggcgcgccagtcctgtccgtcgacctccaagagagctagggttcctctcagagaggaaagacaggtccttaggtcctcaccctcccgtctagcatataaaagccttctgggaactggacagattggacaactataacgacacctccctggtggaaaatcatctctgccctgccacagaggggcccctccgactcggaccgatg

SEQ ID NO: 10789 - DNA, 203 bp, Homo sapiens
  source 1..203: mol_type = other DNA
ggcgcgccagtcctttactgtcacctccaagagagctagggttcctctcagagaggaaagacaggtccttaggtcctcaccctcccgtctccttgcccttgcagttctgggaactggaacctccaactcttgataacgacacctccctggtggaaaatcatctctgccctgccacagaggggcccctccgactcggaccgatg

SEQ ID NO: 10790 - DNA, 203 bp, Homo sapiens
  source 1..203: mol_type = other DNA
ggcgcgccagtcctgttgggtaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctccgactcggaccgatg

SEQ ID NO: 10791 - DNA, 203 bp, Homo sapiens
  source 1..203: mol_type = other DNA
ggcgcgccagtcctactgtgcaacctccaagagagctagggttcctctcagagaggaaagacaggtccttaggtcctcaccctcccgtctccttgcccttgcagttctgggaactggacagattggacaactataacgacacctcctcctaaagtgggggtctctgccctgccacagaggggcccctccgactcggaccgatg

SEQ ID NO: 10792 - DNA, 203 bp, Homo sapiens
  source 1..203: mol_type = other DNA
ggcgcgccagtcctctcgtgacacctccaagagagctagggttcctctcagagaggaaagaccatcgggctcaagatcaccctcccgtctccttgcccttgcagttctgggaactggacagattggacaactataacgacacctccctggtggaaaatcatctctgccctgccacagaggggcccctccgactcggaccgatg

SEQ ID NO: 10793 - DNA, 203 bp, Homo sapiens
  source 1..203: mol_type = other DNA
ggcgcgccagtcctggttgaccacctcccagaagagtcacgtgggctgacccagagccggggcggaaaggctgcgttagtttcttccgggtcattgacagaagaccggtcgaggtaaagtagttcgttggttttctttcccctcatccttttgccgtgagatggcgaggggtggctttgatttcggcgcgactcggaccgatg

SEQ ID NO: 10794 - DNA, 203 bp, Homo sapiens
  source 1..203: mol_type = other DNA
ggcgcgccagtcctcgggcgcaacctcccagaagagtcacgtgggctgacccagagccggggcggaaaggctgcgttagtttcttccgggtcattgacagaagaccggtcgaggtaaagtagttcgttggttttctttcccctcatccttttgcctgctcccggcgaggggtggctttgatttcggcgcgactcggaccgatg

SEQ ID NO: 10795 - DNA, 203 bp, Homo sapiens
  source 1..203: mol_type = other DNA
ggcgcgccagtccttgagcgtgacctcccagaagagtcacgtgggctgacccagagccggggcggaaaggctgcgttagtttcttccgggtcattgacagaagcgtcaattcctgggagtagttcgttggttttctttcccctcatccttttgcctgctctaatttcttacgacctttgatttcggcgcgactcggaccgatg

SEQ ID NO: 10796 - DNA, 203 bp, Homo sapiens
  source 1..203: mol_type = other DNA
ggcgcgccagtcctcaatcattacctcccagaagagtcacgtgggctgacccagagccggggcggaaaggctgcgttagtttcttccgggtcattgacagaagcgtcaattcctgggagtagttcgttggttttctttcccctcatgtgccatgacatatccggcgaggggtggctttgatttcggcgcgactcggaccgatg

SEQ ID NO: 10797 - DNA, 203 bp, Homo sapiens
  source 1..203: mol_type = other DNA
ggcgcgccagtcctccacaccaacctcccagaagagtcacgtgggctggtgagtcaagcctacggaaaggctgcgttagtttcttccgggtcattgacagaagcgtcaattcctgggagtagttcgttggttttctttcccctcatccttttgcctgctcccggcgaggggtggctttgatttcggcgcgactcggaccgatg

SEQ ID NO: 10798 - DNA, 203 bp, Homo sapiens
  source 1..203: mol_type = other DNA
ggcgcgccagtcctgatggtgaacgaaatagatgatctgtttaatgcatttggaagcaactaatcgaatcaacattttgatccaaattaagggccgccgcttccaacttaggattaaagaatcctattataccagaatatagggtggtaaatttagagtttgcttgcaactcaatcaatagagagttgcgactcggaccgatg

SEQ ID NO: 10799 - DNA, 203 bp, Homo sapiens
  source 1..203: mol_type = other DNA
ggcgcgccagtcctcgcgctaaacgaacctcagcatttctgttggagactctagacctactggaaataacataactctggacctattggaacttatataattggcgcccaaccaacaatctgaacccaccaatctaatttaacacactttgtcaggcgacaaacagggtagttaagttagaaaagcatcgactcggaccgatg

SEQ ID NO: 10800 - DNA, 203 bp, Homo sapiens
  source 1..203: mol_type = other DNA
ggcgcgccagtcctaccgcacaacgaacctcagcgaaagaaggaagatctctagacctactggaaataacataacttgatcttacaatttacttatataattggcgcccaaccaacaatctgaacccaccaatctaatttaacacactttgtcaggcgacaaacagggtagttaagttagaaaagcatcgactcggaccgatg

SEQ ID NO: 10801 - DNA, 203 bp, Homo sapiens
  source 1..203: mol_type = other DNA
ggcgcgccagtcctgagatggcacgatatcatatgcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 10802 - DNA, 203 bp, Homo sapiens
  source 1..203: mol_type = other DNA
ggcgcgccagtcctgaggagttacgatgggaaacgcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgaccgactcggaccgatg

SEQ ID NO: 10803 - DNA, 203 bp, Homo sapiens
  source 1..203: mol_type = other DNA
ggcgcgccagtcctcttgacagacgcagccaggcgcgcactgcacagcgtaaagggaaattggccgcccgagcgcacccttcagcccgcgcgccggccgtgagtcctcggtgctcgcccgccggccagacaaacagcccgcccgaccccgtcccgaccctggccgccccgagcggagcctggagcaaacgactcggaccgatg

SEQ ID NO: 10804 - DNA, 203 bp, Homo sapiens
  source 1..203: mol_type = other DNA
ggcgcgccagtcctccgtctatacgccgccaaaaccttcgggacagctatgcgggttgacaatcccagtggggggcattatgattatatgttacttgtcctgcgagttcctcttgagactggccgaaaggcagccacggggccaccaaggcggcgcagcgctgcatgcggcaaggggaaaaatccttccgactcggaccgatg

SEQ ID NO: 10805 - DNA, 203 bp, Homo sapiens
  source 1..203: mol_type = other DNA
ggcgcgccagtcctccatacggacgccgccaaaaccttcgggacagctatgcgggttgacaatcccagtggggggccggggaccagctgattacttgtcctgcgagttcctcttgagactggccgaaaggcagccacggggccaccgcacacttatttaactgcatgcggcaaggggaaaaatccttccgactcggaccgatg

SEQ ID NO: 10806 - DNA, 203 bp, Homo sapiens
  source 1..203: mol_type = other DNA
ggcgcgccagtcctcgaggtatacggacacccctagggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgcgactcggaccgatg

SEQ ID NO: 10807 - DNA, 203 bp, Homo sapiens
  source 1..203: mol_type = other DNA
ggcgcgccagtccttccttcagacggacacccctagggtatacaatgacagagatcttctagactaggtgcgagaggccgaggaccagaacaacatccgcctaccctccatcattgttataaaaaacttaggtgatgttcaacgggagccgccagccaaccaaccatccactcccacgactggagccgcgactcggaccgatg

SEQ ID NO: 10808 - DNA, 203 bp, Homo sapiens
  source 1..203: mol_type = other DNA
ggcgcgccagtccttagggcaaacggacacccctagggtatacaatgacagagatcttctagactaggtgcgagaggccgaggaccagaacaacatccgcctaccctccatcattgtttcctgttggggttaaaccaggtccacacagccgccagccaaccaaccatccactcccacgactggagccgcgactcggaccgatg

SEQ ID NO: 10809 - DNA, 203 bp, Homo sapiens
  source 1..203: mol_type = other DNA
ggcgcgccagtcctatcacgctacggacacccctagggtatacaatgacagagatcttctagactaggtgcgagaggccgaggaccagaagtctcgatttgatacctccatcattgttataaaaaacttaggaaccaggtccacacagccgccagccaaccaaccatccactcccacgactggagccgcgactcggaccgatg

SEQ ID NO: 10810 - DNA, 203 bp, Homo sapiens
  source 1..203: mol_type = other DNA
ggcgcgccagtcctttatttatacggacacccctagggtatacaatgacagagatcttctagttcgtcccatgtttgccgaggaccagaacaacatccgcctaccctccatcattgttataaaaaacttaggaaccaggtccacacagccgccagccaaccaaccatccactcccacgactggagccgcgactcggaccgatg

SEQ ID NO: 10811 - DNA, 203 bp, Homo sapiens
  source 1..203: mol_type = other DNA
ggcgcgccagtcctctaatgatacggacagccaatttttgttgtattgttgagtcttcttgtgttttgttgtctttctacaggttgttgtggttgttgcaattgtttaacttcatcaatgcgaggctgttgtgattgtggttcaactaaacttccttattacgaatttgaaaaggtccacgttcaatacgactcggaccgatg

SEQ ID NO: 10812 - DNA, 203 bp, Homo sapiens
  source 1..203: mol_type = other DNA
ggcgcgccagtccttctcctgaacggcctctggctaggacccaggtccttgattatgccaattttctcgagaaatcattcaattgaccatagactgaaagcgttgttacctagttcttcagaagagatcttattagaattaatttatatgatctaattcccttaaaaactgaataccaaaaaacaaaacgactcggaccgatg

SEQ ID NO: 10813 - DNA, 203 bp, Homo sapiens
  source 1..203: mol_type = other DNA
ggcgcgccagtccttgaggcctacgtcctcgccacatctctgtaacctccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 10814 - DNA, 203 bp, Homo sapiens
  source 1..203: mol_type = other DNA
ggcgcgccagtccttttagctaacgtcgttgaagacccacaggctgctgggaggagagcataaggaatctacttgaaaatggatcggtttatgttggattaaatgctgctctttgtggcctcatagcaaacagtctttttcgacgcatcttgaatgtgacaaaggctcgcatagctgctggcttaccacgactcggaccgatg

SEQ ID NO: 10815 - DNA, 203 bp, Homo sapiens
  source 1..203: mol_type = other DNA
ggcgcgccagtcctgaccatgtacgtctgtgcggctgcgtggggctcgagttacacttgaccaggagactgaagcacttctaccctagccgggcccagcccccgagcagtgcagcctcccgagtgcagagtgcagcccctgcccgccctggcccagctgcccatgtctaccctgctggatcccaagtacgactcggaccgatg

SEQ ID NO: 10816 - DNA, 203 bp, Homo sapiens
  source 1..203: mol_type = other DNA
ggcgcgccagtcctagatcgggacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcaggctgaagtgagtctggatcccaagtacgactcggaccgatg

SEQ ID NO: 10817 - DNA, 203 bp, Homo sapiens
  source 1..203: mol_type = other DNA
ggcgcgccagtcctagttagcgacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtacgactcggaccgatg

SEQ ID NO: 10818 - DNA, 203 bp, Homo sapiens
  source 1..203: mol_type = other DNA
ggcgcgccagtccttacgaaagacgtctgtgcggctgcgtggggctcggccgcgcggactgaaggagactgaagcacttctaccctagccgggcccagcccccgagcagtgcagcctcccgagtgcagagtgcagcccctgcccgcgagcctaagcaataccatgtctaccctgctggatcccaagtacgactcggaccgatg

SEQ ID NO: 10819 - DNA, 203 bp, Homo sapiens
  source 1..203: mol_type = other DNA
ggcgcgccagtccttcgccaatacgtctgtgcggctgcgtggggctcggccgcgcggactgaaggagactgaagcacttctaccctagccgggcccagcccccgagcagtgcagcctctgccagttgagcgtcagcccctgcccgccctggcccagctgcccatgtctaccctgctggatcccaagtacgactcggaccgatg

SEQ ID NO: 10820 - DNA, 203 bp, Homo sapiens
  source 1..203: mol_type = other DNA
ggcgcgccagtccttcacccgcacgtctgtgcggctgcgtggggctcggccgcgcggactgaaggagactgaagcacttctaccctagccgggcccagcccccggttttgtgtttactccgagtgcagagtgcagcccctgcccgccctggcccagctgcccatgtctaccctgctggatcccaagtacgactcggaccgatg

SEQ ID NO: 10821 - DNA, 203 bp, Homo sapiens
  source 1..203: mol_type = other DNA
ggcgcgccagtcctcataaataacgtctgtgcggctgcgtggggctcggccgcgcggactgaaggagactgaagcatcagcggatgcattgggcccagcccccgagcagtgcagcctcccgagtgcagagtgcagcccctgcccgccctggcccagctgcccatgtctaccctgctggatcccaagtacgactcggaccgatg

SEQ ID NO: 10822 - DNA, 203 bp, Homo sapiens
  source 1..203: mol_type = other DNA
ggcgcgccagtcctacattattacgtctgtgcggtgtgtgcttctgtagccgcgcggactgaaggagactgaagcacttctaccctagccgggcccagcccccgagcagtgcagcctcccgagtgcagagtgcagcccctgcccgccctggcccagctgcccatgtctaccctgctggatcccaagtacgactcggaccgatg

SEQ ID NO: 10823 - DNA, 203 bp, Homo sapiens
  source 1..203: mol_type = other DNA
ggcgcgccagtcctagagtttaactaatgtgccgcgcctgtgtggaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagccgactcggaccgatg

SEQ ID NO: 10824 - DNA, 203 bp, Homo sapiens
  source 1..203: mol_type = other DNA
ggcgcgccagtcctgcagcctgactaccagatttgactcatttgtgattccttcgagaatctagttattagacacgtggttacatgaatgtttgggaaggaaaactggcaacatcttagtatatgttctccatggcacattagggaaagaagccagaaaaggctcccaacgcattgatttttaaaatgcgactcggaccgatg

SEQ ID NO: 10825 - DNA, 203 bp, Homo sapiens
  source 1..203: mol_type = other DNA
ggcgcgccagtccttgccgaccactaccagatttgactcatttgtgattccttcgagaatctcccatgatttgcaatggttacatgaatgtttgggaaggaaaactggcaacatcttagtatatgttctccatggcacattagggaaagaagccagaaaaactcaattgttagctgatttttaaaatgcgactcggaccgatg

SEQ ID NO: 10826 - DNA, 203 bp, Homo sapiens
  source 1..203: mol_type = other DNA
ggcgcgccagtcctgacaaaccactacccccaattgcaataaccccaggacaatctagccacagctaactgcccaaatccactacattccattcatatttagtcagctttgcgtggggaggcccggaaagaattagttctacgagcatcgacacaattatcttgatcgtgtttctttccgggcaagcccgactcggaccgatg

SEQ ID NO: 10827 - DNA, 203 bp, Homo sapiens
  source 1..203: mol_type = other DNA
ggcgcgccagtccttcagaagaactacccccaattgcaataaccccaggacaatctagccacagctaactgcccaaatccactacattccattcatatttagtctttaagaaaaaactaggcccggaaagaattagttctacgagcatcgacacaattatcttgatcgtgtttccccttaatgcgcggcgactcggaccgatg

SEQ ID NO: 10828 - DNA, 203 bp, Homo sapiens
  source 1..203: mol_type = other DNA
ggcgcgccagtcctgtttggacactacccccaattgcaataaccccaggacaatctagccacagctaactgcccaagggactacttgataattcatatttagtctttaagaaaaaactaggcccggaaagaattagttctacgagcatcgacacaattatcttgatcgtgtttctttccgggcaagcccgactcggaccgatg

SEQ ID NO: 10829 - DNA, 203 bp, Homo sapiens
  source 1..203: mol_type = other DNA
ggcgcgccagtcctatggacgcactacccccaattgcaataaccccagtgtcgggataaataagctaactgcccaaatccactacattccattcatatttagtctttaagaaaaaactaggcccggaaagaattagttctacgagcatcgacacaattatcttgatcgtgtttctttccgggcaagcccgactcggaccgatg

SEQ ID NO: 10830 - DNA, 203 bp, Homo sapiens
  source 1..203: mol_type = other DNA
ggcgcgccagtcctacagatagactagtcgacgttcttcgttaagaagcacgacttccagcagttggggccacggtgggacggaccctacactgtagtcctcagcacccccaccgcggtaaaggtcgctgggaagaccccgtggatccaccactctcgactcaagaaagctcctgacaaccaagaagacgactcggaccgatg

SEQ ID NO: 10831 - DNA, 203 bp, Homo sapiens
  source 1..203: mol_type = other DNA
ggcgcgccagtcctggcggtgtactataatttatagtagagtcggaagccgaccctcacagtaaaatagcacaggctgggttttctacgtacgagtaaaacacggtgatttttctgcagtgagctctcccatgagcaacatgacagaaaacgaaagattgcttcattttttctaaactgaacgaaaagcgactcggaccgatg

SEQ ID NO: 10832 - DNA, 203 bp, Homo sapiens
  source 1..203: mol_type = other DNA
ggcgcgccagtcctgcctggtcactattacttttgtttcttttgatgacctttatgttgctattagaggttcttgtgaaaagaacctacaacttatgcgtaaggttgacttgtataatggtgctgtcatttacatttttgccgaagagcctgttgttggtatagtctactcttcgtggaccgtttcgtcgactcggaccgatg

SEQ ID NO: 10833 - DNA, 203 bp, Homo sapiens
  source 1..203: mol_type = other DNA
ggcgcgccagtcctccatgtttactattacttttgtttcttttgatgacctttatgttgctattagaggttcttgtgaaaagaacctacaacttatgcgtaaggttgacttgtataatggtgctgtcatttacatttttgccgaagagcctgttgttggtatagtctactcttctcaactatacgaagcgactcggaccgatg

SEQ ID NO: 10834 - DNA, 203 bp, Homo sapiens
  source 1..203: mol_type = other DNA
ggcgcgccagtcctactgccctactattacttttgtttcttttgatgacctttatgttgctattagaggttcttgtgaaaagaacctacaggcctaatagggttttgacttgtataatggtgctgtcatttacatttttgccgaagagcctgttgttggtatagtctactcttctcaactatacgaagcgactcggaccgatg

SEQ ID NO: 10835 - DNA, 203 bp, Homo sapiens
  source 1..203: mol_type = other DNA
ggcgcgccagtcctatcaagagactattacttttgtttcttttgatgagaaacgcagaatgcttagaggttcttgtgaaaagaacctacaacttatgcgtaaggttgacttgtataatggtgctgtcatttacatttttgccgaagagcctgttgttggtatagtctactcttctcaactatacgaagcgactcggaccgatg

SEQ ID NO: 10836 - DNA, 203 bp, Homo sapiens
  source 1..203: mol_type = other DNA
ggcgcgccagtcctgtcattctactcagactttactctaaaagtcaaatcttctgacattctttgaagtgaagcataaccacgggaaccactgaagaaatgaatgaaatgaaataatgcagcatctagtgctttttgcatggcccaaaggggctctgtgctgctccactacagaggaaacttcaagaacgactcggaccgatg

SEQ ID NO: 10837 - DNA, 203 bp, Homo sapiens
  source 1..203: mol_type = other DNA
ggcgcgccagtcctcaatgggtactcagactttactctaaaagtcaaatcttctgacattctttgaagtgaagcattctatgaatgtgagctgaagaaatgaatgaaatgaaataatgcagcatctagtgctttttgcatggcccaaaggggctctgtgcctgcgggaatttacggaaacttcaagaacgactcggaccgatg

SEQ ID NO: 10838 - DNA, 203 bp, Homo sapiens
  source 1..203: mol_type = other DNA
ggcgcgccagtcctcgatagatactcagactttactctaaaagtcaaatcttctgacattctttgaagtgaagcattctatgaatgtgagctgaagaaatgaatgaaatgaaataatgcagcatctagtgctttttgcatggcccaccatatgataactttgctccactacagaggaaacttcaagaacgactcggaccgatg

SEQ ID NO: 10839 - DNA, 203 bp, Homo sapiens
  source 1..203: mol_type = other DNA
ggcgcgccagtcctatccactaactcagactttactctaaaagtcaaatcttctgacattctttgaagtgaagcattctatgaatgtgagctgaagaaatgaatgaaatgaaataatgcagcatctagtgctttttgcatggcccagtctcatgtgtgtatgctccactacagaggaaacttcaagaacgactcggaccgatg

SEQ ID NO: 10840 - DNA, 203 bp, Homo sapiens
  source 1..203: mol_type = other DNA
ggcgcgccagtcctaggtaactactcagactttatagactggacggtctcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaacgactcggaccgatg

SEQ ID NO: 10841 - DNA, 203 bp, Homo sapiens
  source 1..203: mol_type = other DNA
ggcgcgccagtcctaatcacttactcagcacaggatctgatcaggagatttgtctccggtgctttacaccggagcaaccccagttggtgcgcccaaggcctggcaaataacctaggggactaggttttcttttaatttacacgtctgtcaatatgggtgcaaacaatagcaaggagtctgtgtcaagccgactcggaccgatg

SEQ ID NO: 10842 - DNA, 203 bp, Homo sapiens
  source 1..203: mol_type = other DNA
ggcgcgccagtccttgtttaacactcagcacaggatctgatcaggagatttgtctccggtgctttacaccggagcacaaatttaaaaattgcccaaggcctggcaaataacctaggggactaggttttctttatgaggtggtagaagtcaatatgggtgcaaacaatagcaaggagtctgtgtcaagccgactcggaccgatg

SEQ ID NO: 10843 - DNA, 203 bp, Homo sapiens
  source 1..203: mol_type = other DNA
ggcgcgccagtcctttgtcctgactcagcacaggatctgatcaggagatttgtctccggtgctttacaccggagcacaaatttaaaaattgcccaaggcctggcggtgtttaccccccactaggttttcttttaatttacacgtctgtcaatatgggtgcaaacaatagcaaggagtctgtgtcaagccgactcggaccgatg

SEQ ID NO: 10844 - DNA, 203 bp, Homo sapiens
  source 1..203: mol_type = other DNA
ggcgcgccagtcctcctggacaactcccaggctcctcgggacattttttagcctcctgggagtctcggagggggtgatactagcaggtttgggccttgacgtggctgtggatgcagtcgttctgacccctggtggccgagaggtgaagtgcagtggcggctgcttgctcaaggccggaggaagacgcccgactcggaccgatg

SEQ ID NO: 10845 - DNA, 203 bp, Homo sapiens
  source 1..203: mol_type = other DNA
ggcgcgccagtcctttacctacactcccaggctcctcgggactcggcgggtcctcctgggagtctcggaggggaccggctgtgcaggtttgggccttgacgtggaaacatccctgtaggttctgacccctggtggccgagaggtgaagtgcagtggcggctgcttgctcaaggccggaggaagacgcccgactcggaccgatg

SEQ ID NO: 10846 - DNA, 203 bp, Homo sapiens
  source 1..203: mol_type = other DNA
ggcgcgccagtcctaacgcggcactcccaggctcctcgggactcggcgggtcctcctgggagtctcggaggggaccggctgtgcaggtttgggccttgacgtggctgtggatgcagtctccggcctgtagattggccgagaggtgaagtgcagtggcggctgcttgctcaaggccggaggaagacgcccgactcggaccgatg

SEQ ID NO: 10847 - DNA, 203 bp, Homo sapiens
  source 1..203: mol_type = other DNA
ggcgcgccagtccttctatgctactcccaggctcctcgggactcggcgtcgatgagaccatatctcggaggggaccggctgtgcaggtttgggccttgacgtggctgtggatgcagtcgttctgacccctggtggccgagaggtgaagtgcagtggcggctgcttgctcaaggccggaggaagacgcccgactcggaccgatg

SEQ ID NO: 10848 - DNA, 203 bp, Homo sapiens
  source 1..203: mol_type = other DNA
ggcgcgccagtcctcccatttgactcccaggctctggacatagaaataggtcctcctgggagtctcggaggggaccggctgtgcaggtttgggccttgacgtggctgtggatgcagtcgttctgacccctggtggccgagaggtgaagtgcagtggcggctgcttgctcaaggccggaggaagacgcccgactcggaccgatg

SEQ ID NO: 10849 - DNA, 203 bp, Homo sapiens
  source 1..203: mol_type = other DNA
ggcgcgccagtcctcggctaggactcttgccatacgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagcccgactcggaccgatg

SEQ ID NO: 10850 - DNA, 203 bp, Homo sapiens
  source 1..203: mol_type = other DNA
ggcgcgccagtcctgggccggcactgagagcgcctggaggctcgagcgagtacctcgaatcatgcacacctgttagcaagaaacagaagttgaaggactggaacaagtgaactaggaaagagggaacgccaatccaaggatagaaggacaaggacagaatcaccagcactggctgaaggtaccttaaccgactcggaccgatg

SEQ ID NO: 10851 - DNA, 203 bp, Homo sapiens
  source 1..203: mol_type = other DNA
ggcgcgccagtcctacttgtcaactgagagcgcctggaggctcgagcggagggtaattcatttgcacacctgttagcaagaaacagaagttgaaggactggaacaagtgaactaggaaagagggaacgccaaagtccaatgtcccagacaaggacagaatcaccagcactggctgaaggtaccttaaccgactcggaccgatg

SEQ ID NO: 10852 - DNA, 203 bp, Homo sapiens
  source 1..203: mol_type = other DNA
ggcgcgccagtccttttacgacactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctctgctatgagccgtcgactcggaccgatg

SEQ ID NO: 10853 - DNA, 203 bp, Homo sapiens
  source 1..203: mol_type = other DNA
ggcgcgccagtcctgtcgtcaaactgagagcgcctggaggctcgagcggagggtaattcatttgcacacctgttagcaagaaacagaagttgaaggactggaacaagtgaactaggaaagagggaacgccaatccaaggatagaaggacaaggacagaatgcggccgtgaattcgaaggtaccttaaccgactcggaccgatg

SEQ ID NO: 10854 - DNA, 203 bp, Homo sapiens
  source 1..203: mol_type = other DNA
ggcgcgccagtcctcagacccaactgagagcgcctggaggctcgagcggagggtaattcatttgcacacctgttagcaagaaacagaagttgaaggactggaacaagtgaactaggaacttataccgatatctccaaggatagaaggacaaggacagaatcaccagcactggctgaaggtaccttaaccgactcggaccgatg

SEQ ID NO: 10855 - DNA, 203 bp, Homo sapiens
  source 1..203: mol_type = other DNA
ggcgcgccagtcctcgcactgtactgagagcgcctggaggctcgagcggagggtaattcatttgcacacctgttagcaagaaacagaagttgaaggactggaactgtccgctgtccgtagagggaacgccaatccaaggatagaaggacaaggacagaatcaccagcactggctgaaggtaccttaaccgactcggaccgatg

SEQ ID NO: 10856 - DNA, 203 bp, Homo sapiens
  source 1..203: mol_type = other DNA
ggcgcgccagtccttcagtgccactgataaagaaaggaaaagctaccaccattacatcagtcttaccgaagccagcactagttgcatctcaacggcgtagaaataaagtccttattctaggatcaggaggtctgtccattggtcaggctggagaatttgattactcaggatctcaagctgtaaaagcccgactcggaccgatg

SEQ ID NO: 10857 - DNA, 203 bp, Homo sapiens
  source 1..203: mol_type = other DNA
ggcgcgccagtcctctccgtgcactgcaataggccactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgacgactcggaccgatg

SEQ ID NO: 10858 - DNA, 203 bp, Homo sapiens
  source 1..203: mol_type = other DNA
ggcgcgccagtccttggtgtccactggcgctaaaagttttgagcttctattgtactctacctcaccgtccagggagcaggtagctgctgggctccggggacactttgcgttcgggctgggagcgtgctttccacgacggtgacacgcttccctggattggcagccagactgccttccgggtcactgcccgactcggaccgatg

SEQ ID NO: 10859 - DNA, 203 bp, Homo sapiens
  source 1..203: mol_type = other DNA
ggcgcgccagtcctcatatcttactggcgctaaaagttttgagcttctcaaaagtctagagccaccgtccagggagcaggtagctgctgggctccggggacactttgcgttcgggctgggagcgtgctttccacgacggtgacacgaagtgacttcacaacagccagactgccttccgggtcactgcccgactcggaccgatg

SEQ ID NO: 10860 - DNA, 203 bp, Homo sapiens
  source 1..203: mol_type = other DNA
ggcgcgccagtcctccggctgaactgggaaaaatggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggcgactcggaccgatg

SEQ ID NO: 10861 - DNA, 203 bp, Homo sapiens
  source 1..203: mol_type = other DNA
ggcgcgccagtcctacatactcactggggacctccgcgcctgggaaaaggagttggctgaaggacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10862 - DNA, 203 bp, Homo sapiens
  source 1..203: mol_type = other DNA
ggcgcgccagtcctgagcattgactggggacctcgctcaggaccgtggggagttggctgaaggacttggggagcccagaagctgccaccgaaccaagaaccacctctgtgcagaaaagagtaacgtgcccggtctattctgctgcccgagacaaccacatcctcctcctcctacacccaaaggctccccgactcggaccgatg

SEQ ID NO: 10863 - DNA, 203 bp, Homo sapiens
  source 1..203: mol_type = other DNA
ggcgcgccagtcctggcacggaactggggacctcgctcaggaccgtggggagttggctgaaggacttggggagcccagaagctgccaccgaaccaagaaccacctctgtgcagaaaagcaaccaccttgttctctattctgctgccatgcttttatcacgcctcctcctcctacacccaaaggctccccgactcggaccgatg

SEQ ID NO: 10864 - DNA, 203 bp, Homo sapiens
  source 1..203: mol_type = other DNA
ggcgcgccagtccttgtaagagactggggacctcgctcaggaccgtggggagttggctgaaggacttggggagcccagaagctgccaccggcaacccttttcggtctgtgcagaaaagcaaccaccttgttctctattctgctgcccgagacaaccacatcctcctcctcctacacccaaaggctccccgactcggaccgatg

SEQ ID NO: 10865 - DNA, 203 bp, Homo sapiens
  source 1..203: mol_type = other DNA
ggcgcgccagtcctagcgaaacactggggacctcgctcaggaccgtggtcttgctcacccttgacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 10866 - DNA, 203 bp, Homo sapiens
  source 1..203: mol_type = other DNA
ggcgcgccagtcctcgctgtagacttccggtgacgtatttccgcttccctagaatatccgcctacgtatttccgcttccgggacacgtccgcttaaaagcggaagtgacgccctttcccaaccacacctacctcgcctataagaatcagtgtcagttcctctgactcactctgttcgtagaggtcacccgactcggaccgatg

SEQ ID NO: 10867 - DNA, 203 bp, Homo sapiens
  source 1..203: mol_type = other DNA
ggcgcgccagtcctagctacaaacttccggtgacgtatttccgcttccggtcccgcgaaaattacgtatttccgcttccgggacacgtccgcttaaaagcggaagtgacgccctttcccaaccacacctacctcgcctataagaatcagtgtcagttcctctgactcactctgtgatcgcctcagtttcgactcggaccgatg

SEQ ID NO: 10868 - DNA, 203 bp, Homo sapiens
  source 1..203: mol_type = other DNA
ggcgcgccagtccttccactccacttcgcaagatcaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 10869 - DNA, 203 bp, Homo sapiens
  source 1..203: mol_type = other DNA
ggcgcgccagtcctacaatacaacttggctgactgtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatcgactcggaccgatg

SEQ ID NO: 10870 - DNA, 203 bp, Homo sapiens
  source 1..203: mol_type = other DNA
ggcgcgccagtcctagactcacactttccaaggcgcccgccgactggcatggcgcaccgacccggggccggggccccgggagagggaatgagtgtgagctcgtgagtgggcgccgccgccaccgcccccgccgccgtcgtctcggtagcagccttcgccacgccggggtcttcagctccactggggcccgactcggaccgatg

SEQ ID NO: 10871 - DNA, 203 bp, Homo sapiens
  source 1..203: mol_type = other DNA
ggcgcgccagtccttccaaacgactttccaaggcgcccgccgactggctgtattggggagggacatatacttctgtcgggagagggaatgagtgtgagctcgtgagtgggcgccgccgccaccgcccccgccgccgtcgtctcggtagcagccttcgccacgccggggtcttcagctccactggggcccgactcggaccgatg

SEQ ID NO: 10872 - DNA, 203 bp, Homo sapiens
  source 1..203: mol_type = other DNA
ggcgcgccagtcctagtagttcactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcacacatcagatctgacgactcggaccgatg

SEQ ID NO: 10873 - DNA, 203 bp, Homo sapiens
  source 1..203: mol_type = other DNA
ggcgcgccagtcctgttacaatactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcagctccactggggcccgactcggaccgatg

SEQ ID NO: 10874 - DNA, 203 bp, Homo sapiens
  source 1..203: mol_type = other DNA
ggcgcgccagtccttaagtctaactttgcccatagcagcgggcgggcactttgcactggaaccccgcggggttcgtcaaggacgcgactctcccgacgcggggaggctattctgcccatttggggacacttccccgccgctgccaggacccgcttctctgaaaggctctccttgcagctgcttagacgcgactcggaccgatg

SEQ ID NO: 10875 - DNA, 203 bp, Homo sapiens
  source 1..203: mol_type = other DNA
ggcgcgccagtcctcacggatgactttgcccatagcagcgggcgggcactttgcactggaacttacaacacccgagcaaggacgcgactcggggcttcttaaagggctattctgcccatttggggacacttccccgccgctgccaggacccgcttctctgaaaggctctccttgcagctgcttagacgcgactcggaccgatg

SEQ ID NO: 10876 - DNA, 203 bp, Homo sapiens
  source 1..203: mol_type = other DNA
ggcgcgccagtccttaaagtaaactttgcccatagcagcgggcgggcactttgcactggaacttacaacacccgagcaaggacgcgactctcccgacgcggggactgacacggctgagtttggggacacttccccgccgctgccaggacccgcttctctgaaaggctctccttgcagctgcttagacgcgactcggaccgatg

SEQ ID NO: 10877 - DNA, 203 bp, Homo sapiens
  source 1..203: mol_type = other DNA
ggcgcgccagtcctttgacgcaactttgcccatagcagcgggcgggcactttgcactggaacttacaacacccgagcaaggacgcgactctcccgacgcggggaggctattctgcccacccctctgttacgacccgccgctgccaggacccgcttctctgaaaggctctccttgcagctgcttagacgcgactcggaccgatg

SEQ ID NO: 10878 - DNA, 203 bp, Homo sapiens
  source 1..203: mol_type = other DNA
ggcgcgccagtcctacttgggtactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgcgactcggaccgatg

SEQ ID NO: 10879 - DNA, 203 bp, Homo sapiens
  source 1..203: mol_type = other DNA
ggcgcgccagtcctcgacatttactttgcccatagcagcgggcgggcactttgcactggaacttacaacacccgagcaaggacgcgactctcccgacgcggggaggctattctgcccatttggggacacttccccgccgctgccagtcttataccgatataaaggctctccttgcagctgcttagacgcgactcggaccgatg

SEQ ID NO: 10880 - DNA, 203 bp, Homo sapiens
  source 1..203: mol_type = other DNA
ggcgcgccagtcctgcgcccagactttgcccatagcagcgggcgggcactttgcactggaacttacaacacccgagggtatgtcgcctgatcccgacgcggggaggctattctgcccatttggggacacttccccgccgctgccaggacccgcttctctgaaaggctctccttgcagctgcttagacgcgactcggaccgatg

SEQ ID NO: 10881 - DNA, 203 bp, Homo sapiens
  source 1..203: mol_type = other DNA
ggcgcgccagtcctacttatacagaaaggggcggaaaaccactattcggtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgacgactcggaccgatg

SEQ ID NO: 10882 - DNA, 203 bp, Homo sapiens
  source 1..203: mol_type = other DNA
ggcgcgccagtcctggattatcagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgacgactcggaccgatg

SEQ ID NO: 10883 - DNA, 203 bp, Homo sapiens
  source 1..203: mol_type = other DNA
ggcgcgccagtcctctgggtcgagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggctagtgagtagtacccgactcggaccgatg

SEQ ID NO: 10884 - DNA, 203 bp, Homo sapiens
  source 1..203: mol_type = other DNA
ggcgcgccagtccttcaggacgagaaaggggcggggccggcgggcagcgtgcggcagtgcggagctcctgagaccggcgggcacacgggggtctgtggcccccggttgccggagtcaggccgccgtcgcttggttcccgtcggtctgcgggaggcgggttatggcggcggcggcagtgagagctgtgacgactcggaccgatg

SEQ ID NO: 10885 - DNA, 203 bp, Homo sapiens
  source 1..203: mol_type = other DNA
ggcgcgccagtcctagattaaaagaaaggggcggggccggcgggcagcgtgcggcagtgcggagctcctgagaccggcgggcacacggggtagcccttataggcccgtagcagtggctgccgccgtcgcttggttcccgtcggtctgcgggaggcgggttatggcggcggcggcagtgagagctgtgacgactcggaccgatg

SEQ ID NO: 10886 - DNA, 203 bp, Homo sapiens
  source 1..203: mol_type = other DNA
ggcgcgccagtcctcggttaatagaactagttaatgcggcccagtccgagacagcagatgaggagactgtccttcctgtttcgcagatgaggaaactgaggcttagagaagtttggcaaattggctaagttcctacagctaattgtgggattagtgatatgcttttctaaagagtagaaaagtcgaagcgactcggaccgatg

SEQ ID NO: 10887 - DNA, 203 bp, Homo sapiens
  source 1..203: mol_type = other DNA
ggcgcgccagtcctttctcggcagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggcgactcggaccgatg

SEQ ID NO: 10888 - DNA, 203 bp, Homo sapiens
  source 1..203: mol_type = other DNA
ggcgcgccagtcctgtgcgaatagaatgatatctgtcaaaagaaacacttggagagcactgagtttagtaataggtgactgccggaaaaaagggaactttgaatcgaagttgtttgctgaggcatgagcccggaacgcgcttgcttttaggagacagccactttctgtgtggtacgctggattcaaggcgactcggaccgatg

SEQ ID NO: 10889 - DNA, 203 bp, Homo sapiens
  source 1..203: mol_type = other DNA
ggcgcgccagtccttagagcgcagaatgatatctgtcaaaagaaacacttggagagcactgagtttagtaataggtgactgccggaaaaagaaaggtgacatcgattgtcaagaacaggaggcatgagcccggaacgcgcttgcttttaggagacagccactttctgtgtggtacgctggattcaaggcgactcggaccgatg

SEQ ID NO: 10890 - DNA, 203 bp, Homo sapiens
  source 1..203: mol_type = other DNA
ggcgcgccagtcctatgtgagaagacagccttgtctcgtctgaaggaacagaaatctctgggccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 10891 - DNA, 203 bp, Homo sapiens
  source 1..203: mol_type = other DNA
ggcgcgccagtcctcagtatttagacagccttgttctacagaaatgatgagaaatctctgggccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 10892 - DNA, 203 bp, Homo sapiens
  source 1..203: mol_type = other DNA
ggcgcgccagtcctctttggcgagacagccttgttctacagatcctccagaggtaacggaaaccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 10893 - DNA, 203 bp, Homo sapiens
  source 1..203: mol_type = other DNA
ggcgcgccagtcctaagagacaagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctaggttataagtccacgactcggaccgatg

SEQ ID NO: 10894 - DNA, 203 bp, Homo sapiens
  source 1..203: mol_type = other DNA
ggcgcgccagtcctagggctttagacctctctgtgcttagggcaaacatcatttggccttaaatgggattctgtgaacttactcaaaagaattgacagctggactgttctttggggccttatgtggtgtttgcctctgaggtactcaggggcatttaggtttttcctcattcttaaataataatgaaccgactcggaccgatg

SEQ ID NO: 10895 - DNA, 203 bp, Homo sapiens
  source 1..203: mol_type = other DNA
ggcgcgccagtcctggtgtttcagacctctctgtgcttagggcaaacatcatttggccttaaatgggattctgtgagaggggatccctccattgacagctggactgttctttggggccttatgtggtgtttgcctctgaggtactcaggggcatttaggtttttcctcattctttttaggatggtttacgactcggaccgatg

SEQ ID NO: 10896 - DNA, 203 bp, Homo sapiens
  source 1..203: mol_type = other DNA
ggcgcgccagtccttaagattgagacctctctgtgcttagggcaaacatcatttggccttaaatgggattctgtgagaggggatccctccattgacagctggactgttctttggggccttatgtggtgtttgcctctgaggtactcgatacgggcatcccttttcctcattcttaaataataatgaaccgactcggaccgatg

SEQ ID NO: 10897 - DNA, 203 bp, Homo sapiens
  source 1..203: mol_type = other DNA
ggcgcgccagtcctatagtgctagacgccatagttccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctacccgactcggaccgatg

SEQ ID NO: 10898 - DNA, 203 bp, Homo sapiens
  source 1..203: mol_type = other DNA
ggcgcgccagtcctagcaatatagactctgtcttcagccaggcactccctccctccctcccaatcgatatgggcgtaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 10899 - DNA, 203 bp, Homo sapiens
  source 1..203: mol_type = other DNA
ggcgcgccagtcctatcgggtcagactctgtcttcagccaggcactccctccctccctcccagcactatgccctacaacttctgcctgcccagcctgagctgccgcaccagctgcatactggggccctgcgtgccccccagctgccacagctgcaccctgcccggggcctgcaacatccccgccaatgcgactcggaccgatg

SEQ ID NO: 10900 - DNA, 203 bp, Homo sapiens
  source 1..203: mol_type = other DNA
ggcgcgccagtcctattcccatagactctgtcttcagccaggcactccctccctccctcccagcactatgccctacaacttctgcctgcccagcctgagctgccgcaccagctgctccctggaatttacgcagccccccagctgccacagctgcaccctgcccggggcctgcaacatccccgccaatgcgactcggaccgatg

SEQ ID NO: 10901 - DNA, 203 bp, Homo sapiens
  source 1..203: mol_type = other DNA
ggcgcgccagtcctcctgctcgagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 10902 - DNA, 203 bp, Homo sapiens
  source 1..203: mol_type = other DNA
ggcgcgccagtcctcactgtgaagactctgtcttcagccaggcactccctccctccctcccagcactatgccctacaacttctgcctgcccagcctgagctgccgcaccagctgctcctcccggccctgcgtgccccccagctgccgagttgttctaaaccccggggcctgcaacatccccgccaatgcgactcggaccgatg

SEQ ID NO: 10903 - DNA, 203 bp, Homo sapiens
  source 1..203: mol_type = other DNA
ggcgcgccagtcctgttgtggtagactctgtcttcagccaggcactccctccctccctcccagcactatgccctacaacttctgcctgcctgatgcaccggttggcaccagctgctcctcccggccctgcgtgccccccagctgccacagctgcaccctgcccggggcctgcaacatccccgccaatgcgactcggaccgatg

SEQ ID NO: 10904 - DNA, 203 bp, Homo sapiens
  source 1..203: mol_type = other DNA
ggcgcgccagtcctgcggatctagactctgtcttcagccaggcactccctccctccctcccagcactatgccctacgtgcgtccagacagcagcctgagctgccgcaccagctgctcctcccggccctgcgtgccccccagctgccacagctgcaccctgcccggggcctgcaacatccccgccaatgcgactcggaccgatg

SEQ ID NO: 10905 - DNA, 203 bp, Homo sapiens
  source 1..203: mol_type = other DNA
ggcgcgccagtcctattgtcttagactctgtcttcagccaggcactcctgggacagaggtaggcactatgccctacaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 10906 - DNA, 203 bp, Homo sapiens
  source 1..203: mol_type = other DNA
ggcgcgccagtcctgttgtaacagactggagagaagcaggcctgagcccaaatggccaggtgtcctggggactcccaggaccacaggctgagacgagacgcagggtggctggaggaagtgagaggtgaactcagcctgggactggctgggcgagactctccacctgctccctgggaccatcgcccacccgactcggaccgatg

SEQ ID NO: 10907 - DNA, 203 bp, Homo sapiens
  source 1..203: mol_type = other DNA
ggcgcgccagtcctatggtgagagactggagagaagcaggcctgagcctccccaaaggcagctcctggggactcccaggaccacaggctgagacgagacgcagggtggctggaggaaggccatttgattaaaagcctgggactggctgggcgagactctccacctgctccctgggaccatcgcccacccgactcggaccgatg

SEQ ID NO: 10908 - DNA, 203 bp, Homo sapiens
  source 1..203: mol_type = other DNA
ggcgcgccagtcctttgtagtaagactgtgcagtccacggcctgaacaatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 10909 - DNA, 203 bp, Homo sapiens
  source 1..203: mol_type = other DNA
ggcgcgccagtcctgggtaaggagactgtgcagtggggcaaggatttcatgagcatcctcctctaaacgcgtgtcaagacaaaagatgcttcagctttggaaacaaccctctagaacaggcgtgctcactgggacctcagagtctcttcttgacaatcttggcaatgacctaagcaatgtcgtggatacgactcggaccgatg

SEQ ID NO: 10910 - DNA, 203 bp, Homo sapiens
  source 1..203: mol_type = other DNA
ggcgcgccagtcctatgagcccagactgtgcagtggggcaaggatttcatgagcatcctcctctaaacgcgtgtcaagacaaaagatgcttcagctttggaaacttgttctcctgtgcggcgtgctcactggcgagcatatacgatttcttgacaatcttggcaatgacctaagcaatgtcgtggatacgactcggaccgatg

SEQ ID NO: 10911 - DNA, 203 bp, Homo sapiens
  source 1..203: mol_type = other DNA
ggcgcgccagtccttgcttgtgagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttaatccctttacctccaatgtcgtggatacgactcggaccgatg

SEQ ID NO: 10912 - DNA, 203 bp, Homo sapiens
  source 1..203: mol_type = other DNA
ggcgcgccagtcctcgctgacaagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 10913 - DNA, 203 bp, Homo sapiens
  source 1..203: mol_type = other DNA
ggcgcgccagtcctgttaagccagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaaggtcgagatctttcccgactcggaccgatg

SEQ ID NO: 10914 - DNA, 203 bp, Homo sapiens
  source 1..203: mol_type = other DNA
ggcgcgccagtcctgcccgcttagactgtgcagtggggcaaggatttcatgagcatcctcctctaaacgcgtgtcaagacaaaagatgcttcagctttggaaacttgttctcctgtgcttttcctcgcgaccgacctcagagtctcttcttgacaatcttggcaatgacctaagcaatgtcgtggatacgactcggaccgatg

SEQ ID NO: 10915 - DNA, 203 bp, Homo sapiens
  source 1..203: mol_type = other DNA
ggcgcgccagtcctcgcaatcgagactgtgcagtggggcaaggatttcggtgctgcggatgcctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 10916 - DNA, 203 bp, Homo sapiens
  source 1..203: mol_type = other DNA
ggcgcgccagtccttcaacctaagagaaagaaaggactctcagactgttggagcagaactactgagaaaaaccaggcattgtatcttcagttgtcatcaagttcgcaatcagattggaaaagctcaacttgaagctttcttgcctgcagtgaagcagagactgttcggccggatacgtaataaaaaaccgactcggaccgatg

SEQ ID NO: 10917 - DNA, 203 bp, Homo sapiens
  source 1..203: mol_type = other DNA
ggcgcgccagtcctcttccctgagagaaagaaaggactctcagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaaccgactcggaccgatg

SEQ ID NO: 10918 - DNA, 203 bp, Homo sapiens
  source 1..203: mol_type = other DNA
ggcgcgccagtcctcaagttgaagagaagagacttgtttggaaatatactgggcgtcactggttaacttaggattaaagacattgactagaaggtcaagaaaagggaactctataatttcaaaaatgttgagcctatttgatacatttaatgcacgtaggcaagaaaacataacaaaatcagccggtgcgactcggaccgatg

SEQ ID NO: 10919 - DNA, 203 bp, Homo sapiens
  source 1..203: mol_type = other DNA
ggcgcgccagtcctatgacctaagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaaataggcatgttggcgactcggaccgatg

SEQ ID NO: 10920 - DNA, 203 bp, Homo sapiens
  source 1..203: mol_type = other DNA
ggcgcgccagtcctgtctgagtagagaccacagactttgagggaagctcactcaggatctgctctccggcaaagtagtaagtgaggtgctgagagcagaatgagctactttgtggattctgctgggagcagccccgtcccttactcagcgcctcgtcctgcagtggtgaggcaaggacctagcaacaccgactcggaccgatg

SEQ ID NO: 10921 - DNA, 203 bp, Homo sapiens
  source 1..203: mol_type = other DNA
ggcgcgccagtccttgtcccagagagaccacagactttgagggaagctcactcaggatctgctctccggcaaagtagtaagtgaggtgctgagagcagaatgagctactttgtggattctgctgggagcagccccgtcccttactcagcgcctcgtcctgggtactgcctcttcggacctagcaacaccgactcggaccgatg

SEQ ID NO: 10922 - DNA, 203 bp, Homo sapiens
  source 1..203: mol_type = other DNA
ggcgcgccagtcctgcatgtcgagagaccacagactttgagggaagctcactcaggatctgctctccggcaaagtagtaagtgaggtgctgagagcagaatgagctactttgtggattctgctgggagcagccccgtcccttactctatatacacaagaacagtggtgaggcaaggacctagcaacaccgactcggaccgatg

SEQ ID NO: 10923 - DNA, 203 bp, Homo sapiens
  source 1..203: mol_type = other DNA
ggcgcgccagtcctatctaacaagagaccacagactttgagggaagctcactcaggatctgctctccggcaaagtagtaagtgaggtgctttcgctgactgagactactttgtggattctgctgggagcagccccgtcccttactcagcgcctcgtcctgcagtggtgaggcaaggacctagcaacaccgactcggaccgatg

SEQ ID NO: 10924 - DNA, 203 bp, Homo sapiens
  source 1..203: mol_type = other DNA
ggcgcgccagtcctttcgcgcgagagaccacagactttgagggaagctcactcaggatctgctctccggcaaagtatatttgacacgctggagagcagaatgagctactttgtggattctgctgggagcagccccgtcccttactcagcgcctcgtcctgcagtggtgaggcaaggacctagcaacaccgactcggaccgatg

SEQ ID NO: 10925 - DNA, 203 bp, Homo sapiens
  source 1..203: mol_type = other DNA
ggcgcgccagtcctgcccttagagagaccacagactttgagggaagctttagacaacatatttctccggcaaagtagtaagtgaggtgctgagagcagaatgagctactttgtggattctgctgggagcagccccgtcccttactcagcgcctcgtcctgcagtggtgaggcaaggacctagcaacaccgactcggaccgatg

SEQ ID NO: 10926 - DNA, 203 bp, Homo sapiens
  source 1..203: mol_type = other DNA
ggcgcgccagtcctgtctgcccagagaccacagatacctttcctcagacactcaggatctgctctccggcaaagtagtaagtgaggtgctgagagcagaatgagctactttgtggattctgctgggagcagccccgtcccttactcagcgcctcgtcctgcagtggtgaggcaaggacctagcaacaccgactcggaccgatg

SEQ ID NO: 10927 - DNA, 203 bp, Homo sapiens
  source 1..203: mol_type = other DNA
ggcgcgccagtcctctgaagtcagagagaaaaaatactgttggcagcagcacaatgtttgggctaagacctggtcttgaaagcgccacaagcagcagctgctgagccatggctgaaggggaaatcaccaccttcacagccctgaccgagaagtttaatcttgggagccttccggacaagaagcccaaacgactcggaccgatg

SEQ ID NO: 10928 - DNA, 203 bp, Homo sapiens
  source 1..203: mol_type = other DNA
ggcgcgccagtcctaacattggagagagaaaaaatactgttggcagcagcacaatgtttgggtatcagggaaaaagtgaaagcgccacaagcagcagctgctgagccatggctgaaggggaaatcaccaccttcacagccctgaccgagaagtttaatctgcctccagggaattacaagaagcccaaacgactcggaccgatg

SEQ ID NO: 10929 - DNA, 203 bp, Homo sapiens
  source 1..203: mol_type = other DNA
ggcgcgccagtcctttattcggagagcgggagaacgcgtcctcgcccgaaccagcaatatggccggagctggcccatggggagcaggcgcccggtgccggccacgacgaccgccaccgcccgcgccgcgaccggccggtgaagcccagggacccccctctgggagagccccatgagggcaggagagtgcgactcggaccgatg

SEQ ID NO: 10930 - DNA, 203 bp, Homo sapiens
  source 1..203: mol_type = other DNA
ggcgcgccagtcctctggataaagagctgggagaaggcagtgagcgagatacgcaactatggggtccgtgcggagcaggcgagcgagcgggaagacgcagccaccttcctcaccagccagcccacagcggtttgttccccttctcgggagtgcgccaatgcctgggccgacccaaaccctgtccccaacgactcggaccgatg

SEQ ID NO: 10931 - DNA, 203 bp, Homo sapiens
  source 1..203: mol_type = other DNA
ggcgcgccagtccttctagcacagagctgggagaaggcagtgagcgagcaggcggcaggcagggtccgtgcggagcaggcgagcgagcgggaagacgcagccaccttcctcaccagccagcccacagcggttgcactgttcaagatggagtgcgccaatgcctgggccgacccaaaccctgtccccaacgactcggaccgatg

SEQ ID NO: 10932 - DNA, 203 bp, Homo sapiens
  source 1..203: mol_type = other DNA
ggcgcgccagtcctgagcggcaagagctgggagaaggcagtgagcgagcaggcggcaggcagggtccgtgcggagcaggcgagcgagcgggaagacgcagccaccttcctcaccagccagcccacagcggtttgttccccttctcgggagtgcgccaatgcctgggccgacccattattaactatatgcgactcggaccgatg

SEQ ID NO: 10933 - DNA, 203 bp, Homo sapiens
  source 1..203: mol_type = other DNA
ggcgcgccagtcctggcatgtcagagctgggagaaggcagtgagcgagcaggcggcaggcagggtccgtgcggagcaggcgagcgagcgggaagacgcagccaccttcctcaccagccagcccacagcggtttgttccccttctcgggagtgcgccaatgtaccacgtctgtagaaccctgtccccaacgactcggaccgatg

SEQ ID NO: 10934 - DNA, 203 bp, Homo sapiens
  source 1..203: mol_type = other DNA
ggcgcgccagtcctttctaaacagagctgggagaaggcagtgagcgagcaggcggcaggcagggtccgtgcggagcaggcgagcgagcgggaagacgcagccaccttcctcaccagcctagagggtatctgatgttccccttctcgggagtgcgccaatgcctgggccgacccaaaccctgtccccaacgactcggaccgatg

SEQ ID NO: 10935 - DNA, 203 bp, Homo sapiens
  source 1..203: mol_type = other DNA
ggcgcgccagtcctcttcatcaagagctgggagaaggcagtgagcgagcaggcggcaggcagggtccgtgcggagctcagacaaatagacgaagacgcagccaccttcctcaccagccagcccacagcggtttgttccccttctcgggagtgcgccaatgcctgggccgacccaaaccctgtccccaacgactcggaccgatg

SEQ ID NO: 10936 - DNA, 203 bp, Homo sapiens
  source 1..203: mol_type = other DNA
ggcgcgccagtccttgtaattaagaggagcggcgctcaggttattccaggatctttggagacccgaggaaagccgtgttgaccaaaagcatccggcggacgcgccagagaaaaaagatggcagaaccaagggcaactaaagccgtcaggttctgaacagctggtagatgggctggcttactgaaggaccgactcggaccgatg

SEQ ID NO: 10937 - DNA, 203 bp, Homo sapiens
  source 1..203: mol_type = other DNA
ggcgcgccagtccttcatagtgagaggagggaactgaatgacatcccaggattacataaactgtcagaggcagccgaagagttcacaagttacgcaagctctgtccggcgggtgccgctgtgtaggaaagaagctaaagcacttccagagcctgtccggagctcagaggttcggaagacttatcgacccgactcggaccgatg

SEQ ID NO: 10938 - DNA, 203 bp, Homo sapiens
  source 1..203: mol_type = other DNA
ggcgcgccagtccttaacgcccagaggagggaactgaatgacatcccaggattacataaactgtcagaggcagccgttccagctttgctagtgaagcctggaagccggcgggtgccgctgtgtaggaaagaagctaaagcacttccagagcctgtccggagctcagaggttcggaagacttatcgacccgactcggaccgatg

SEQ ID NO: 10939 - DNA, 203 bp, Homo sapiens
  source 1..203: mol_type = other DNA
ggcgcgccagtccttccgtaatagaggtctgaggtttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacgactcggaccgatg

SEQ ID NO: 10940 - DNA, 203 bp, Homo sapiens
  source 1..203: mol_type = other DNA
ggcgcgccagtcctgcgggtggagagtaccggaaatccagattagagagcttaattagctctgtattaataataacactactattccaataactggaatcaccagcttgatttatctccaaaatgattcaaagaaaacaaatcatattaagactatcctaagcacgaacccatatcgtccttcaaatccgactcggaccgatg

SEQ ID NO: 10941 - DNA, 203 bp, Homo sapiens
  source 1..203: mol_type = other DNA
ggcgcgccagtcctagtaaaccagatcagcgaattaaaatagtgattcaaaaatattttttaccgaaaggcctgcgctacgtgaaagtagtattcaaaataaaatcccgtgcggtcggaaacaaaaattaatttaaattttttaattccgaaacttaaaaccaagtttaaagaaaacttaaaatcaagcgactcggaccgatg

SEQ ID NO: 10942 - DNA, 203 bp, Homo sapiens
  source 1..203: mol_type = other DNA
ggcgcgccagtcctttctggaaagcaacctatgagaatttcccctattccccctgatgcttccaggagaatcaacaatcagtccgattttaccggtggtaacttgattgaaattatagaaaaaataagcctagaaggatatcttacggtgatgtgcgggcacttcgaaaatagaattgatcagtaatccgactcggaccgatg

SEQ ID NO: 10943 - DNA, 203 bp, Homo sapiens
  source 1..203: mol_type = other DNA
ggcgcgccagtcctcgtgtgccagcaacctatgagaatttcccctattccccctgatgcttccaggagaatcaacaatcagtccgattttaccggtggtaacttgattgaaattatagtttcttattctaaggaaggatatcttacttctcgacttcccaacttcgaaaatagaattgatcagtaatccgactcggaccgatg

SEQ ID NO: 10944 - DNA, 203 bp, Homo sapiens
  source 1..203: mol_type = other DNA
ggcgcgccagtcctcggcagcgagcaatgaacgagattgctggtattactggccttggagaagaagcactatctctccaaagacaaacagaaagtttggccatattatgtaatcacacttttggaagtaatataatgagaccccaccgcatccttatcggaaaaggagttgaaggcagagttggagagcgactcggaccgatg

SEQ ID NO: 10945 - DNA, 203 bp, Homo sapiens
  source 1..203: mol_type = other DNA
ggcgcgccagtccttcgtatgtagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaaatcacgcccgtaaacgactcggaccgatg

SEQ ID NO: 10946 - DNA, 203 bp, Homo sapiens
  source 1..203: mol_type = other DNA
ggcgcgccagtccttcataaatagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagttcctgcgactcggaccgatg

SEQ ID NO: 10947 - DNA, 203 bp, Homo sapiens
  source 1..203: mol_type = other DNA
ggcgcgccagtcctccttagagagcagctgatacccagggaggtgtcaggacctgcccggggcgcggggtcgccggaagccaggcgggagccccggctgctttcaaatggcagcacaccataagtgaccctccctgggctgctttctttcgattatcatcagtgaccctaccccggctgctcttcccacgactcggaccgatg

SEQ ID NO: 10948 - DNA, 203 bp, Homo sapiens
  source 1..203: mol_type = other DNA
ggcgcgccagtcctcactttccagcagctgatacccagggaggtgtcaggacctgcccggggcgcggggtcgccggaagccaggcgggagccccggctgctttctggcaatctagtctcataagtgaccctccctgggctgctttctttcgattatcatcagtgaccctaccccggctgctcttcccacgactcggaccgatg

SEQ ID NO: 10949 - DNA, 203 bp, Homo sapiens
  source 1..203: mol_type = other DNA
ggcgcgccagtccttggccctaagcagctgatacccagggaggtgtcaggacctgcccggggcgcggggtcgccggaagccaggcgggagccccggctgctttctggcaatctagtctcataagtgaccctcgagacatacaggcatttcgattatcatcagtgaccctaccccggctgctcttcccacgactcggaccgatg

SEQ ID NO: 10950 - DNA, 203 bp, Homo sapiens
  source 1..203: mol_type = other DNA
ggcgcgccagtcctctggaaggagcagctgatacccagggaggtgtcaggacctgcccggggcgcggggtcgccggcccttttaaactgcccccggctgctttctggcaatctagtctcataagtgaccctccctgggctgctttctttcgattatcatcagtgaccctaccccggctgctcttcccacgactcggaccgatg

SEQ ID NO: 10951 - DNA, 203 bp, Homo sapiens
  source 1..203: mol_type = other DNA
ggcgcgccagtccttttgagtgagcatgacgtaccaaacaggcacgagataagtcccggacatgatggcacatggaatgacaatcagctacaagaaatggcccaactgaggattaagcaccaagaggaactgactgaattacacaaccgtacctaccgtatcaactggtgattgacctgaataaccaacgactcggaccgatg

SEQ ID NO: 10952 - DNA, 203 bp, Homo sapiens
  source 1..203: mol_type = other DNA
ggcgcgccagtcctgaattaatagccagagggcagtgtgtcgtaacggtacggatcaacctcgaaccgactactttgggtgtccgtgtttcattttattcctatactggctgcttatggtgacaattgagagattgttaccatatagctattggattggccatccggtgaccaatagagctattatatcgactcggaccgatg

SEQ ID NO: 10953 - DNA, 203 bp, Homo sapiens
  source 1..203: mol_type = other DNA
ggcgcgccagtcctccgtccgcagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgcgactcggaccgatg

SEQ ID NO: 10954 - DNA, 203 bp, Homo sapiens
  source 1..203: mol_type = other DNA
ggcgcgccagtcctgtataagaagccagccactggagtcgcagcccgcctcggccgccgcggtgtgaaagtcgagagggagacggccggaagccagtaaaagaagagaaaatggaagaaagggacctgctgtccgacttacaggacatcagcgacagcgagaggaagaccagctcggccgagtcctcgcgactcggaccgatg

SEQ ID NO: 10955 - DNA, 203 bp, Homo sapiens
  source 1..203: mol_type = other DNA
ggcgcgccagtccttggtggttagccagccactggagtcgcagcccgcgagccaataaatttgagcggttcgagttgggagacggccggaagccagtaaaagaagagaaaatggaagaaagggacctgctgtccgacttacaggacatcagcgacagcgagaggaagaccagctcggccgagtcctcgcgactcggaccgatg

SEQ ID NO: 10956 - DNA, 203 bp, Homo sapiens
  source 1..203: mol_type = other DNA
ggcgcgccagtcctaacgttcaagcccaaccggctaaccgatgacagaccgtggcaaggaggtgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 10957 - DNA, 203 bp, Homo sapiens
  source 1..203: mol_type = other DNA
ggcgcgccagtcctcagacgtgagcccgatcgtagttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 10958 - DNA, 203 bp, Homo sapiens
  source 1..203: mol_type = other DNA
ggcgcgccagtcctagtaaggtagccggcgcatcaatcatgcaaaatcactattttgtactactaactcattaagaaaaacttaggatccaagagatttactctaggatctcctattaagcttagcagtcattagttgagagttcaacttgcaaaactctaaccttcactctaataacaattcatccacgactcggaccgatg

SEQ ID NO: 10959 - DNA, 203 bp, Homo sapiens
  source 1..203: mol_type = other DNA
ggcgcgccagtcctgagacgaaagcgccactctgctggctgaggctgcggagagtgtgcggcgaggccgcccacagcgcggtcgtgatgtctcgggagtcggatgttgaggctcagcagtctcatggcagcagtgcctgttcacagccccatggcagcgttacccagtcccaaggctcctcctcacagcgactcggaccgatg

SEQ ID NO: 10960 - DNA, 203 bp, Homo sapiens
  source 1..203: mol_type = other DNA
ggcgcgccagtcctaagcctcgagcgccactctgctggctgaggctgcggagagtgtgcggctccaggtgggctcacgcggtcgtgatgtctcgggagtcggataggatattggctatgtctcatggcagcagtgcctgttcacagccccatggcagcgttacccagtcccaaggctcctcctcacagcgactcggaccgatg

SEQ ID NO: 10961 - DNA, 203 bp, Homo sapiens
  source 1..203: mol_type = other DNA
ggcgcgccagtcctcgtagggcagcgccactctgctggctgaggctgcggagagtgtgcggctccaggtgggctcacgcggtcgtgatgtctcgggagtcggatgttgaggctcagcagtctcatggcagcagtgcctgttcacagattataattgttcgtacccagtcccaaggctcctcctcacagcgactcggaccgatg

SEQ ID NO: 10962 - DNA, 203 bp, Homo sapiens
  source 1..203: mol_type = other DNA
ggcgcgccagtcctagggagtcagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgtccaagtcgagatgagctcctcctcacagcgactcggaccgatg

SEQ ID NO: 10963 - DNA, 203 bp, Homo sapiens
  source 1..203: mol_type = other DNA
ggcgcgccagtcctgttggcatagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagcgactcggaccgatg

SEQ ID NO: 10964 - DNA, 203 bp, Homo sapiens
  source 1..203: mol_type = other DNA
ggcgcgccagtccttctggagcagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaagttctggtactcggtcgactcggaccgatg

SEQ ID NO: 10965 - DNA, 203 bp, Homo sapiens
  source 1..203: mol_type = other DNA
ggcgcgccagtcctgtaagacaagcgccactctgctggctgaggctgcggagagtgtgcggctccaggtgggctcacgcggtcgtgatgtgcattctactcagggttgaggctcagcagtctcatggcagcagtgcctgttcacagccccatggcagcgttacccagtcccaaggctcctcctcacagcgactcggaccgatg

SEQ ID NO: 10966 - DNA, 203 bp, Homo sapiens
  source 1..203: mol_type = other DNA
ggcgcgccagtccttccgcgaaagcgccagtttcgcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagacgactcggaccgatg

SEQ ID NO: 10967 - DNA, 203 bp, Homo sapiens
  source 1..203: mol_type = other DNA
ggcgcgccagtcctacagccaaagcgcggccgttcttacgctccgatggtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 10968 - DNA, 203 bp, Homo sapiens
  source 1..203: mol_type = other DNA
ggcgcgccagtcctgaagttacagcgcggccgttgggggtgaggccgcagacacaacatcagacaaagggccgcgggcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 10969 - DNA, 203 bp, Homo sapiens
  source 1..203: mol_type = other DNA
ggcgcgccagtccttagaactaagcgcggccgttgggggtgaggccgcgtcgggggaggacaacaaagggccgcgggcggcgggcagtgggccgagcaggcggtggtgcttccctgaggctgaggcgcccggcctcccgcccgccgcgctccagatgaagtgtgagcactgcacgcgcaaggaatgtacgactcggaccgatg

SEQ ID NO: 10970 - DNA, 203 bp, Homo sapiens
  source 1..203: mol_type = other DNA
ggcgcgccagtcctcttaccgtagcgcggccgttgggggtgaggccgcgtcgggggaggacaacaaagggccgcgggcggcgggcagtggtgtcccagtctcccaccctaattaccctgctgaggcgcccggcctcccgcccgccgcgctccagatgaagtgtgagcactgcacgcgcaaggaatgtacgactcggaccgatg

SEQ ID NO: 10971 - DNA, 203 bp, Homo sapiens
  source 1..203: mol_type = other DNA
ggcgcgccagtcctataagttgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcactaatttacccacatcgactcggaccgatg

SEQ ID NO: 10972 - DNA, 203 bp, Homo sapiens
  source 1..203: mol_type = other DNA
ggcgcgccagtccttgagtgatagcgcggccgttgggggtgaggccgcgtcgggggaggacactcgcctaggatccgcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 10973 - DNA, 203 bp, Homo sapiens
  source 1..203: mol_type = other DNA
ggcgcgccagtcctaccatcaaagcggagcctggaggccaggtctctgcctcggaagtgagtctggtctgtgggagcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10974 - DNA, 203 bp, Homo sapiens
  source 1..203: mol_type = other DNA
ggcgcgccagtcctggagactaagcggagcctggaggccaggtctctgcctcggaagtgagtgcttctgccatcgtcccctgcctgtcccctcctgggtcactgcgaaccttttcgcgtgctaacctgacgccctttgtcaaggaagagctgaggtttgccatccagaacaagcacctctgccaccggcgactcggaccgatg

SEQ ID NO: 10975 - DNA, 203 bp, Homo sapiens
  source 1..203: mol_type = other DNA
ggcgcgccagtcctcttatgtgagcggagcctggaggccaggtctctgcctcggaagtgagtgcttctgccatcgtcccctgcctgtcccctcctgggtcactggtgtttgaggattttgctaacctgacgcaaaggtggggtcctgagctgaggtttgccatccagaacaagcacctctgccaccggcgactcggaccgatg

SEQ ID NO: 10976 - DNA, 203 bp, Homo sapiens
  source 1..203: mol_type = other DNA
ggcgcgccagtccttaaacaatagcggagcctggaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10977 - DNA, 203 bp, Homo sapiens
  source 1..203: mol_type = other DNA
ggcgcgccagtcctaatcgtgtagcggagcctggaggccaggtctctgcctcggaagtgagtgcttctgccatcgtcccctgcctgtcccctcctgggtcactggtgtttgaggattttgctaacctgacgccctttgtcaaggaagagctgaggtttgctcagtgaccagcttacctctgccaccggcgactcggaccgatg

SEQ ID NO: 10978 - DNA, 203 bp, Homo sapiens
  source 1..203: mol_type = other DNA
ggcgcgccagtcctcctaaaggagcggagcctggaggccaggtctctgttgattgcaatcacgcttctgccatcgtcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10979 - DNA, 203 bp, Homo sapiens
  source 1..203: mol_type = other DNA
ggcgcgccagtcctagcccagaagcggagcctgggtagatcaggctctcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggcgactcggaccgatg

SEQ ID NO: 10980 - DNA, 203 bp, Homo sapiens
  source 1..203: mol_type = other DNA
ggcgcgccagtcctggagtagtagcggccacatcgtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggccgactcggaccgatg

SEQ ID NO: 10981 - DNA, 203 bp, Homo sapiens
  source 1..203: mol_type = other DNA
ggcgcgccagtcctctgtgaagagcggcgggtcacgtgacgcggtgccacagtgatgataggccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 10982 - DNA, 203 bp, Homo sapiens
  source 1..203: mol_type = other DNA
ggcgcgccagtcctagtgctgcagcggcgggtcacgtgacgcggtgcctggcgccgagcctcccaagatggcggtgtgcatcgcggtgattgccaaggagaattaccccctctacattcgcagcacccctacaccacgacgtgaacagttccactacatggtgcacacatctctggacgtggtggatgcgactcggaccgatg

SEQ ID NO: 10983 - DNA, 203 bp, Homo sapiens
  source 1..203: mol_type = other DNA
ggcgcgccagtcctattcacccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 10984 - DNA, 203 bp, Homo sapiens
  source 1..203: mol_type = other DNA
ggcgcgccagtcctcttccactagcggcgggtcacgtgacgcggtgcctggcgccgagcctcccaagatggcggtgtgcatcgcggtgattgccaaggagaattaccccctctacattcgcagcacccctacggagaacgagctgagagaaactacaccagtgcacacatctctggacgtggtggatgcgactcggaccgatg

SEQ ID NO: 10985 - DNA, 203 bp, Homo sapiens
  source 1..203: mol_type = other DNA
ggcgcgccagtcctaggtattgagcggcgggtcacgtgacgcggtgcctggcgccgagcctcccaagatggcggtgtgcatcgcggtgattgccaaggagaattaccccctctacattgtacctgatttacaggagaacgagctgaagttccactacatggtgcacacatctctggacgtggtggatgcgactcggaccgatg

SEQ ID NO: 10986 - DNA, 203 bp, Homo sapiens
  source 1..203: mol_type = other DNA
ggcgcgccagtcctacatggagagctgcaacccagcagccagcctgtcgtaacgcgcaagtccgtggcggaaccgaaagaggatacccctcgtgtttccttttattcttgaatggctgcttatggtgacaatcatagattgttatcataaagcgagttggattggccatccagtgtgaatcagattaacgactcggaccgatg

SEQ ID NO: 10987 - DNA, 203 bp, Homo sapiens
  source 1..203: mol_type = other DNA
ggcgcgccagtcctacggattaagctgcaacccagcagccagcctgtcgtaacgcgcaagtccgtggcggaaccgactactttgggtgtccgtgtttccttttattcttgaatggctgcttatggtgacaatcatagattgttatcataaagcgagttggattggccatccagtcgattcttagcattcgactcggaccgatg

SEQ ID NO: 10988 - DNA, 203 bp, Homo sapiens
  source 1..203: mol_type = other DNA
ggcgcgccagtcctagctggatagctgcaacccagcagccagcctgtcgtaacgcgcaagtccgtggcggaaccgactactttgggtgtccgtgtttccttttattcttgaatggctgcttatggtgacaatttgtctagtaccggataaagcgagttggattggccatccagtgtgaatcagattaacgactcggaccgatg

SEQ ID NO: 10989 - DNA, 203 bp, Homo sapiens
  source 1..203: mol_type = other DNA
ggcgcgccagtcctgacagaagagctgcaacccagcagccagcctgtcgtaacgcgcaagtccgtggcggaaccgactactttgggtgtctcatcacgaaggggttcttgaatggctgcttatggtgacaatcatagattgttatcataaagcgagttggattggccatccagtgtgaatcagattaacgactcggaccgatg

SEQ ID NO: 10990 - DNA, 203 bp, Homo sapiens
  source 1..203: mol_type = other DNA
ggcgcgccagtcctcgtagcctagctggtgtctgagggattacgactcgcgtggtcggacagcacatgttagtcatgtattatggtgtttcccaacacgtatctttgctctagtattgaactttagtgatgacatcctacttgtgctacacctgattagttagcccttgtggatacgccactgccgctcgactcggaccgatg

SEQ ID NO: 10991 - DNA, 203 bp, Homo sapiens
  source 1..203: mol_type = other DNA
ggcgcgccagtcctaccggcagagctggtgtctgagggattacgactcgcgtggtcggacagcacatgttagtcatgtattatggtgtttcccaacacgtatctttgctctagtattgaactttagtgatgagtgtacttggcatgtacacctgattagtatatagagtaatcgacgccactgccgctcgactcggaccgatg

SEQ ID NO: 10992 - DNA, 203 bp, Homo sapiens
  source 1..203: mol_type = other DNA
ggcgcgccagtcctagtgggacagctggtgtctgagggattacgactcgcgtggtcggacagcacatgttagtcatgtattatggtgtttcccaacacgtatctttgctctagtattgaactttagtgatgagtgtacttggcatgtacacctgattagttagcccttgtggatggtgattactgtaccgactcggaccgatg

SEQ ID NO: 10993 - DNA, 203 bp, Homo sapiens
  source 1..203: mol_type = other DNA
ggcgcgccagtccttatacgtaagctggtgtctgccatgaacacttctgcgtggtcggacagcacatgttagtcatgtattatggtgtttcccaacacgtatctttgctctagtattgaactttagtgatgagtgtacttggcatgtacacctgattagttagcccttgtggatacgccactgccgctcgactcggaccgatg

SEQ ID NO: 10994 - DNA, 203 bp, Homo sapiens
  source 1..203: mol_type = other DNA
ggcgcgccagtcctacaagaatagctttttttccccgtcctgcagcaagtccggaagaaggtccgggggctggagtcctgggacctagctcgggaccggcctggagatggagttcgactgcgagggcctgagacggctgcttggcaagtacaagttcagggacctaactgtggaagaactaaggaatgcgactcggaccgatg

SEQ ID NO: 10995 - DNA, 203 bp, Homo sapiens
  source 1..203: mol_type = other DNA
ggcgcgccagtcctcgccggtcaggacacaacataccgatatgttataagaatccttgtgtgtagatctttggtggcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 10996 - DNA, 203 bp, Homo sapiens
  source 1..203: mol_type = other DNA
ggcgcgccagtcctgactagggaggacacaacatcagagggacggcagagaatccttgtgtgcgatgggagatgctcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 10997 - DNA, 203 bp, Homo sapiens
  source 1..203: mol_type = other DNA
ggcgcgccagtcctggctcctgaggacacaacatcagagggacggcagagaatccttgtgtgtagatctttggtggcagtttgaaaattgcaaggagggactttaagactacttctgagaacagccacgctgctgtgctctgagcaggctgaagtgactggacgagacgcactgttggagaaataaaacgactcggaccgatg

SEQ ID NO: 10998 - DNA, 203 bp, Homo sapiens
  source 1..203: mol_type = other DNA
ggcgcgccagtcctcgtcgtcgaggacacaacatcagagggacggcagagaatccttgtgtgtagatctttggtggcagtttgaaaattgcaaggagggactttaagactacttctgatttgcaaagattgtctgtgctctgagcaggctgaagtgactggacgagacgcactgcacctaggtccgttcgactcggaccgatg

SEQ ID NO: 10999 - DNA, 203 bp, Homo sapiens
  source 1..203: mol_type = other DNA
ggcgcgccagtcctccttatctaggacacaacatcagagggacggcaggatgatgcccgcaatagatctttggtggcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 11000 - DNA, 203 bp, Homo sapiens
  source 1..203: mol_type = other DNA
ggcgcgccagtcctatccgcgtaggacagtcagaacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 11001 - DNA, 203 bp, Homo sapiens
  source 1..203: mol_type = other DNA
ggcgcgccagtcctgggtagaaaggacgaccgggtcctttccattggatcaaacccgctcaagatacttgttcaaaggcgtgcccccgcaagactgctagccgagtagcgttgggttgcgaaaggccttgtggtactgcctgatagggtgcttgcgagtgccccgggaggtctcgtagaccgtgcaaccgactcggaccgatg

SEQ ID NO: 11002 - DNA, 203 bp, Homo sapiens
  source 1..203: mol_type = other DNA
ggcgcgccagtcctgaggttcgaggacgaccgggtcctttccattggatcaaacccgctcaatgcctggagatttgaaacgttaaaacgcagactgctagccgagtagcgttgggttgcgaaaggccttgtggtactgcctgatagggtgcttgcgagtgccccgggaggtctcgtagaccgtgcaaccgactcggaccgatg

SEQ ID NO: 11003 - DNA, 203 bp, Homo sapiens
  source 1..203: mol_type = other DNA
ggcgcgccagtcctgggctgataggacgaccgggtcctttccattggatcaaacccgctcaatgcctggagatttgggcgtgcccccgcaagactgctagccgagtagcgttgggttgcgaaaggccttgtgaatggtgaaccattggtgcttgcgagtgccccgggaggtctcgtagaccgtgcaaccgactcggaccgatg

SEQ ID NO: 11004 - DNA, 203 bp, Homo sapiens
  source 1..203: mol_type = other DNA
ggcgcgccagtcctaagatcacaggacgaccgggtcctttccattggatcaaacccgctcaatgcctggagatttgggcgtgcccccgcaagactgctagccgagtagcgttgggttggtctgactaaccacgtactgcctgatagggtgcttgcgagtgccccgggaggtctcgtagaccgtgcaaccgactcggaccgatg

SEQ ID NO: 11005 - DNA, 203 bp, Homo sapiens
  source 1..203: mol_type = other DNA
ggcgcgccagtccttgaccattaggactcactctcgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 11006 - DNA, 203 bp, Homo sapiens
  source 1..203: mol_type = other DNA
ggcgcgccagtcctctcgaattaggaggctgactccccaagtcctgcaaaggggtgcaagcctagttccaaccctgccgggctgaggcatgagtaggggctgtagcctacgcggttgcggcccccaaagcttccactcgctgccttaaaacgccaacccagcctctcagacaatgctgccctcccactcgactcggaccgatg

SEQ ID NO: 11007 - DNA, 203 bp, Homo sapiens
  source 1..203: mol_type = other DNA
ggcgcgccagtcctttgcgtgtaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccaatgctaggcgactagctgccctcccactcgactcggaccgatg

SEQ ID NO: 11008 - DNA, 203 bp, Homo sapiens
  source 1..203: mol_type = other DNA
ggcgcgccagtcctaggatagaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 11009 - DNA, 203 bp, Homo sapiens
  source 1..203: mol_type = other DNA
ggcgcgccagtcctccttcctaaggaggctgactccccaagtcctgcaaaggggtgcaagcctagttccaaccctgccgggctgaggcatgagtaggggctgtatttgcgtgcaggcgggcccccaaagcttgtcagataacggggaaaacgccaacccagcctctcagacaatgctgccctcccactcgactcggaccgatg

SEQ ID NO: 11010 - DNA, 203 bp, Homo sapiens
  source 1..203: mol_type = other DNA
ggcgcgccagtcctatatgaacaggaggctgactccccaagtcctgcaaaggggtgcaagcctagttccaaccctgccgggctgaggcatgagtaggggctgtatttgcgtgcaggcgtcttgttcttatagccactcgctgccttaaaacgccaacccagcctctcagacaatgctgccctcccactcgactcggaccgatg

SEQ ID NO: 11011 - DNA, 203 bp, Homo sapiens
  source 1..203: mol_type = other DNA
ggcgcgccagtcctcgtgacgaaggaggctgactccccaagtcctgcactcccagttggcggtagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 11012 - DNA, 203 bp, Homo sapiens
  source 1..203: mol_type = other DNA
ggcgcgccagtcctctgtttgaaggaggctgacttgtgcgactactggaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 11013 - DNA, 203 bp, Homo sapiens
  source 1..203: mol_type = other DNA
ggcgcgccagtcctactgtcgcaggatgctctcgcaaaagacaactcacaatctccctaaaacagcaacgacaccatgtcagctttgctcaaatctctctgggagaaacttttgcccacatactaacaacatcacaaccatctcaagaaaagaaactgggcaaaacagcatccaagagacaaatagcacgactcggaccgatg

SEQ ID NO: 11014 - DNA, 203 bp, Homo sapiens
  source 1..203: mol_type = other DNA
ggcgcgccagtcctgcctaagcaggatggcgcggcacgggccgtgcggggcccgaaccagtaagggaaccgccggctcgcgccctccgttctttcccggagccggcttcacgcagggccgggaacggccgtgcctctgggatccgccttcgctgacgccgggcacctacctggacgcgagcgagcgagcgactcggaccgatg

SEQ ID NO: 11015 - DNA, 203 bp, Homo sapiens
  source 1..203: mol_type = other DNA
ggcgcgccagtccttcaactggaggcaaaatttgcacagtataaaatcatgggtcgaacggcttgttggaatcaccgtacctatttaggtttacgctccaagatcggtggatagcagccctatcaatatctaggagaactgtgctatgtttagaagattaggtagtctctaaacagaacaatttacctcgactcggaccgatg

SEQ ID NO: 11016 - DNA, 203 bp, Homo sapiens
  source 1..203: mol_type = other DNA
ggcgcgccagtcctccaaccagaggcaaaatttgcacagtataaaatctgcaagtagtgctattgttggaatcaccgtacctatttaggtttacgctccaagatcggtggatagcagccctatcaatatctaggagaactgtgctatgtttagaagattaaagtcgagggcgcgagaacaatttacctcgactcggaccgatg

SEQ ID NO: 11017 - DNA, 203 bp, Homo sapiens
  source 1..203: mol_type = other DNA
ggcgcgccagtcctctgtcagtaggcaaaatttgtcttcgtgggccgatgcaagtagtgctattgttggaatcaccgtacctatttaggtttacgctccaagatcggtggatagcagccctatcaatatctaggagaactgtgctatgtttagaagattaggtagtctctaaacagaacaatttacctcgactcggaccgatg

SEQ ID NO: 11018 - DNA, 203 bp, Homo sapiens
  source 1..203: mol_type = other DNA
ggcgcgccagtcctaagaggataggcgaaggtttctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagcccgactcggaccgatg

SEQ ID NO: 11019 - DNA, 203 bp, Homo sapiens
  source 1..203: mol_type = other DNA
ggcgcgccagtcctgagcgcacaggcgcaagcgcgcacagactgtagccatccgaggacacccccgcccccccggcgtcatgaacctactccgcgcagaatcgcctccggatcccctgcagtcggcgggagtgttggaggtcggcgccggcccccgccttccgcgccccccacgggaaggaagcaccccgactcggaccgatg

SEQ ID NO: 11020 - DNA, 203 bp, Homo sapiens
  source 1..203: mol_type = other DNA
ggcgcgccagtcctccaggctaaggcgcaagcgcgcacagactgtagccatccgaggacaccgttaaaaaagactgccacccggagacacccgcgcagaatcgcctccggatcccctgcagtcggcgggagtgttggaggtcggcgccggcccccgccttccgcgccccccacgggaaggaagcaccccgactcggaccgatg

SEQ ID NO: 11021 - DNA, 203 bp, Homo sapiens
  source 1..203: mol_type = other DNA
ggcgcgccagtcctacgtcaggaggcgcaagcgcgcacagactgtagctgaggccatttttgcccgcccccccggcccacccggagacacccgcgcagaatcgcctccggatcccctgcagtcggcgggagtgttggaggtcggcgccggcccccgccttccgcgccccccacgggaaggaagcaccccgactcggaccgatg

SEQ ID NO: 11022 - DNA, 203 bp, Homo sapiens
  source 1..203: mol_type = other DNA
ggcgcgccagtcctcgtggaagaggcgccgggaagtcgacggcgccggataggatgctgtagggccactgtctgcagctcccgtgaagatgtccactccagacccacccctgggcggaactcctcggccaggtccttccccgggccctggcccttcccctggagccatgctgggccctagcccgggtccgactcggaccgatg

SEQ ID NO: 11023 - DNA, 203 bp, Homo sapiens
  source 1..203: mol_type = other DNA
ggcgcgccagtcctctcagctgaggcgccgggaagtcgacggcgccggcggctcctgcaggaggccactgtctgcagctcccgtgaagatgtccactccagacccacccctgggcggaactcctcggccagggttcggagtcaaaactggcccttcccctggagccatgctgggccctagcccgggtccgactcggaccgatg

SEQ ID NO: 11024 - DNA, 203 bp, Homo sapiens
  source 1..203: mol_type = other DNA
ggcgcgccagtcctgagaccggaggcgccgggaagtcgacggcgccggcggctcctgcaggaggccactgtctgcagctcccgtgaagatgtccactccagacccacccctgggcggaactcctcggccaggtccttccccgggcctacattgaatagaaggagccatgctgggccctagcccgggtccgactcggaccgatg

SEQ ID NO: 11025 - DNA, 203 bp, Homo sapiens
  source 1..203: mol_type = other DNA
ggcgcgccagtcctggcggctcaggcgtaattgcccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 11026 - DNA, 203 bp, Homo sapiens
  source 1..203: mol_type = other DNA
ggcgcgccagtcctattcgtagagggaccgtccacaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttacgactcggaccgatg

SEQ ID NO: 11027 - DNA, 203 bp, Homo sapiens
  source 1..203: mol_type = other DNA
ggcgcgccagtcctgtaccgttagggagaatatggatacgttaaaatatataacgtatttttaaaacttaggaaccaagacaaacacttttggtcttggtattgcgagacgcgcgctaatatcatcatgagtgatatctttgaagaggcggctagttttaggagttatcaatctaagttagggagagacgactcggaccgatg

SEQ ID NO: 11028 - DNA, 203 bp, Homo sapiens
  source 1..203: mol_type = other DNA
ggcgcgccagtcctaaagacgaagggagcaggagagagaggacaagtggatccaacagccttcgctccaggggaatacttttgcatatcacttttctgggaggacactcccttctgatggtgaatgggaactcccttcctcctgcagcagcctgcctgcagctgtcctggtagaacagtgtggacattcgactcggaccgatg

SEQ ID NO: 11029 - DNA, 203 bp, Homo sapiens
  source 1..203: mol_type = other DNA
ggcgcgccagtcctgctattggagggagcaggagagagaggacaagtggatccaacagccttcgctccaggggaatcagggcatcgcctccttttctgggaggacactcccttctgatacgcctcaaatgagcccttcctcctgcagcagcctgcctgcagctgtcctggtagaacagtgtggacattcgactcggaccgatg

SEQ ID NO: 11030 - DNA, 203 bp, Homo sapiens
  source 1..203: mol_type = other DNA
ggcgcgccagtcctcgcaagttagggagcaggagagagaggacaagtggatccaacagccttcgctccaggggaatcagggcatcgcctccttttctgggaggacactcccttctgatggtgaatgggaactcccttcctcctgcagcagcctgcctgcacgacgagactgcttacagtgtggacattcgactcggaccgatg

SEQ ID NO: 11031 - DNA, 203 bp, Homo sapiens
  source 1..203: mol_type = other DNA
ggcgcgccagtcctctgccgggagggagcaggagagagaggacaagtggatccaacagccttcgctccaggggaatcagggcatcgcctccttttctgggaggacactcccttctgatggtgaatgggaactcccttcctcctgcatgctaactatgtatgctgtcctggtagaacagtgtggacattcgactcggaccgatg

SEQ ID NO: 11032 - DNA, 203 bp, Homo sapiens
  source 1..203: mol_type = other DNA
ggcgcgccagtcctctgctcctagggagcaggagagagaggacaagtggatccaacagccttcgctccaggggaatcagggcatcgcctccttttctgggaggaggtaaaaagaaagcggtgaatgggaactcccttcctcctgcagcagcctgcctgcagctgtcctggtagaacagtgtggacattcgactcggaccgatg

SEQ ID NO: 11033 - DNA, 203 bp, Homo sapiens
  source 1..203: mol_type = other DNA
ggcgcgccagtccttagctctgagggagcaggagagagaggacaagtggatccaacagccttcgctccaggggaatcagggcatcgcctctaaggaatatgaaccactcccttctgatggtgaatgggaactcccttcctcctgcagcagcctgcctgcagctgtcctggtagaacagtgtggacattcgactcggaccgatg

SEQ ID NO: 11034 - DNA, 203 bp, Homo sapiens
  source 1..203: mol_type = other DNA
ggcgcgccagtcctccagtggtagggagcaggagagagaggacaagtggatccaacagccttgataatcactcgcgcagggcatcgcctccttttctgggaggacactcccttctgatggtgaatgggaactcccttcctcctgcagcagcctgcctgcagctgtcctggtagaacagtgtggacattcgactcggaccgatg

SEQ ID NO: 11035 - DNA, 203 bp, Homo sapiens
  source 1..203: mol_type = other DNA
ggcgcgccagtcctcttataccagggagcaggagccttgatgagctacgatccaacagccttcgctccaggggaatcagggcatcgcctccttttctgggaggacactcccttctgatggtgaatgggaactcccttcctcctgcagcagcctgcctgcagctgtcctggtagaacagtgtggacattcgactcggaccgatg

SEQ ID NO: 11036 - DNA, 203 bp, Homo sapiens
  source 1..203: mol_type = other DNA
ggcgcgccagtccttaacacgtagggaggagctccctccaggctctatttagagccgggtaggggagcgcagcggccagatacctcagcgagctggtcaccggatggatttctctcccgcctgccggcctgcctgccacagccggactccgccactccggtagcctcatggctgcaacctgtgagattcgactcggaccgatg

SEQ ID NO: 11037 - DNA, 203 bp, Homo sapiens
  source 1..203: mol_type = other DNA
ggcgcgccagtcctagcgtgttagggaggagctccctccaggctctatttagagccgggtaggggagcgcagcggccagatacctcagcgctacctggcggaactggatttctctcccgcctgccggcctgcaaaggcttaaaaagctccgccactccggtagcctcatggctgcaacctgtgagattcgactcggaccgatg

SEQ ID NO: 11038 - DNA, 203 bp, Homo sapiens
  source 1..203: mol_type = other DNA
ggcgcgccagtccttacaggcaagggaggagctccctccaggctctatttagagccgggtaggggagcgcagcggccagatacctcagcgctacctggcggaactggatttctctcccgcctgccggcctgcctgccacagccggagcttcagcgggttttagcctcatggctgcaacctgtgagattcgactcggaccgatg

SEQ ID NO: 11039 - DNA, 203 bp, Homo sapiens
  source 1..203: mol_type = other DNA
ggcgcgccagtcctatttatgtagggaggagctccctccaggctctatttagagccgggtaggggagcgcagcggccagatacctcagcgctacctggcggaactggatttctctccctaactttcagtgatctgccacagccggactccgccactccggtagcctcatggctgcaacctgtgagattcgactcggaccgatg

SEQ ID NO: 11040 - DNA, 203 bp, Homo sapiens
  source 1..203: mol_type = other DNA
ggcgcgccagtcctcacgcctcagggaggagctcgagagcctacaacattagagccgggtaggggagcgcagcggccagatacctcagcgctacctggcggaactggatttctctcccgcctgccggcctgcctgccacagccggactccgccactccggtagcctcatggctgcaacctgtgagattcgactcggaccgatg

SEQ ID NO: 11041 - DNA, 203 bp, Homo sapiens
  source 1..203: mol_type = other DNA
ggcgcgccagtcctatcggtataggggaccctgtacagctggatgttaatcgcagcgtcggatgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 11042 - DNA, 203 bp, Homo sapiens
  source 1..203: mol_type = other DNA
ggcgcgccagtcctattcagggaggggaccctgtggttagcagcagctatcgcagcgtcggatgttcagagcagcaactaattctccttgcggatgttgtgttgcccgccaccatgagctacacaggctttgtccagggatctgaaaccactttgcagtcgacatactcggataccagcgctcagccccgactcggaccgatg

SEQ ID NO: 11043 - DNA, 203 bp, Homo sapiens
  source 1..203: mol_type = other DNA
ggcgcgccagtcctctcgtgacaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcaggtccggttcccgccagcgctcagccccgactcggaccgatg

SEQ ID NO: 11044 - DNA, 203 bp, Homo sapiens
  source 1..203: mol_type = other DNA
ggcgcgccagtcctctgctgaaaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataattaaatggtcgggcgactcggaccgatg

SEQ ID NO: 11045 - DNA, 203 bp, Homo sapiens
  source 1..203: mol_type = other DNA
ggcgcgccagtcctgtaactgcaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 11046 - DNA, 203 bp, Homo sapiens
  source 1..203: mol_type = other DNA
ggcgcgccagtcctggttgaccaggggaccctgtggttagcagcagctatcgcagcgtcggatgttcagagcagcagaagccggcgtcgtttacctggagaggccccgccaccatgagctacacaggctttgtccagggatctgaaaccactttgcagtcgacatactcggataccagcgctcagccccgactcggaccgatg

SEQ ID NO: 11047 - DNA, 203 bp, Homo sapiens
  source 1..203: mol_type = other DNA
ggcgcgccagtcctcgggcgcaaggggaccctgtggttagcagcagcttcattgcaactaattgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 11048 - DNA, 203 bp, Homo sapiens
  source 1..203: mol_type = other DNA
ggcgcgccagtccttctagttgagggggtggggcatgtgccctcttttaatgaccggccgtccctgcggtcccgccccctccccgcccccggagccgcggcctcgctgagtgcccagccgcccggcgcccaggcctggggcaccgcgagtgccgaaccttcggctgctccccgcctcaggacaccaagcgactcggaccgatg

SEQ ID NO: 11049 - DNA, 203 bp, Homo sapiens
  source 1..203: mol_type = other DNA
ggcgcgccagtcctccacaccaagggggtggggctatatgttcggaccaatgaccggccgtccctgcggtcccgccccctccccgcccccggagccgcggcctcgctgagtgcccagctcagatttagtattgcctggggcaccgcgagtgccgaaccttcggctgctccccgcctcaggacaccaagcgactcggaccgatg

SEQ ID NO: 11050 - DNA, 203 bp, Homo sapiens
  source 1..203: mol_type = other DNA
ggcgcgccagtcctttaaactcagggggtggggctatatgttcggaccaatgaccggccgtccctgcggtcccgcctggcgtagctagtaggagccgcggcctcgctgagtgcccagccgcccggcgcccaggcctggggcaccgcgagtgccgaaccttcggctgctccccgcctcaggacaccaagcgactcggaccgatg

SEQ ID NO: 11051 - DNA, 203 bp, Homo sapiens
  source 1..203: mol_type = other DNA
ggcgcgccagtcctctttattgaggggttcttgtgccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgccgactcggaccgatg

SEQ ID NO: 11052 - DNA, 203 bp, Homo sapiens
  source 1..203: mol_type = other DNA
ggcgcgccagtcctggtatagcagggtcaagcgattcccctgcctcagcttcctgagtagctaacgacctgatgcttgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 11053 - DNA, 203 bp, Homo sapiens
  source 1..203: mol_type = other DNA
ggcgcgccagtcctgatcttatagggtcaagcgattcccctgcctcagcttcctgagtagctgggattacaggctcacgagttggaatcttggagcaggtgtgcagagggtgagaacccagctctgggaccaagtcacttgcttccttacttagcaagactatcgacttgagcaaacttggacctgggcgactcggaccgatg

SEQ ID NO: 11054 - DNA, 203 bp, Homo sapiens
  source 1..203: mol_type = other DNA
ggcgcgccagtccttttcgtccagggtcaagcgattcccctgcctcagcttcctgagtagctgggattacaggctctgtgtgctccgggatggagcaggtgtgcagagggtgagaacccagctctgggaccaagtcacttgcttccactgcgtcggcctttatcgacttgagcaaacttggacctgggcgactcggaccgatg

SEQ ID NO: 11055 - DNA, 203 bp, Homo sapiens
  source 1..203: mol_type = other DNA
ggcgcgccagtcctacgccgacagggtcaagcgattcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 11056 - DNA, 203 bp, Homo sapiens
  source 1..203: mol_type = other DNA
ggcgcgccagtcctctcaattaaggtaggtgatagaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagccgactcggaccgatg

SEQ ID NO: 11057 - DNA, 203 bp, Homo sapiens
  source 1..203: mol_type = other DNA
ggcgcgccagtccttagtttctaggtctcgagataagtacatactaccggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11058 - DNA, 203 bp, Homo sapiens
  source 1..203: mol_type = other DNA
ggcgcgccagtcctggccaaataggtctcgagatgccacgtggacgagctatccgtatcgtgacatcttaacctgagcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11059 - DNA, 203 bp, Homo sapiens
  source 1..203: mol_type = other DNA
ggcgcgccagtcctcttgacagaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgcatgcgccgcataacgctgtacatggcaccgactcggaccgatg

SEQ ID NO: 11060 - DNA, 203 bp, Homo sapiens
  source 1..203: mol_type = other DNA
ggcgcgccagtcctcgagtaacaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgcctagttgctcagtcgctgtacatggcaccgactcggaccgatg

SEQ ID NO: 11061 - DNA, 203 bp, Homo sapiens
  source 1..203: mol_type = other DNA
ggcgcgccagtccttacgccctaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctcacaggggcatgttcgactcggaccgatg

SEQ ID NO: 11062 - DNA, 203 bp, Homo sapiens
  source 1..203: mol_type = other DNA
ggcgcgccagtcctcccggaacaggtctcgagatgccacgtggacgagggcatgcccaaagcacatcttaacctgagcgggggtcgcccaggtaaaagcagttttaaccgactgttacgaatacagcctgatcaaaattgtgtatcgcccactgtattgctactaaaaatctctgctgtacatggcaccgactcggaccgatg

SEQ ID NO: 11063 - DNA, 203 bp, Homo sapiens
  source 1..203: mol_type = other DNA
ggcgcgccagtcctgcgcaacgaggtctcgagatgccacgtggacgagggcatgcccaaagccatagaggtagcacgcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11064 - DNA, 203 bp, Homo sapiens
  source 1..203: mol_type = other DNA
ggcgcgccagtcctcaacgaagaggtctcgagatgccacgtggacgagggcatgcccaaagcttcatggctgtaacgcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11065 - DNA, 203 bp, Homo sapiens
  source 1..203: mol_type = other DNA
ggcgcgccagtcctattacggaaggtgtatctcgcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtcgactcggaccgatg

SEQ ID NO: 11066 - DNA, 203 bp, Homo sapiens
  source 1..203: mol_type = other DNA
ggcgcgccagtcctgtttgtctagtaagaaaattcctagttataatatttttaatactgctacatttttaagacccttagttatttagctttaccgcccaggatggggtgcagcgttcctgcaatatccagggcacctaggtgcagccttgtagttttagcacttcgggtttgcaagaatttcactagcgactcggaccgatg

SEQ ID NO: 11067 - DNA, 203 bp, Homo sapiens
  source 1..203: mol_type = other DNA
ggcgcgccagtccttgcgttagagtaagtctgtctgatctaggatgtcttgcttaccacccaggtagggggttatacgtcagggatagacctgattccattgtaactcttgccgaaatccgggtgaacggaagtagtctctttaagaactggtatgggcaggcccaagttgtcaaggcttcggaggtacgactcggaccgatg

SEQ ID NO: 11068 - DNA, 203 bp, Homo sapiens
  source 1..203: mol_type = other DNA
ggcgcgccagtcctcgaggtatagtaagtctgtctgatctaggatgtcttgcttaccacccaggtagggggttatatactcccagcctttctgattccattgtaactcttgccgaaatccgggtgaacggaaaactgaatcacctaaactggtatgggcaggcccaagttgtcaaggcttcggaggtacgactcggaccgatg

SEQ ID NO: 11069 - DNA, 203 bp, Homo sapiens
  source 1..203: mol_type = other DNA
ggcgcgccagtccttattgtgcagtaagtctgtctgatctaggatgtcttgcttaccacccaggtagggggttatatactcccagcctttctgattccattgtaactcttgccgaaatccgggtgaacggaagtagtctctttaagaactggtatgggcacatgacccccacgcaggcttcggaggtacgactcggaccgatg

SEQ ID NO: 11070 - DNA, 203 bp, Homo sapiens
  source 1..203: mol_type = other DNA
ggcgcgccagtcctcattgactagtaatgattttgtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 11071 - DNA, 203 bp, Homo sapiens
  source 1..203: mol_type = other DNA
ggcgcgccagtcctagatcgggagtacggtgtgtggagctggagcaccgtgaggaagaagcgctaagagaggcccaagttcagctgcgagatatcaaacaaagaattactctgtacaaagccagaacacatatatcaaagtaatcctgaagtatcagaacaaaataataggctgtaacagaggaggaacgactcggaccgatg

SEQ ID NO: 11072 - DNA, 203 bp, Homo sapiens
  source 1..203: mol_type = other DNA
ggcgcgccagtcctcgcattacagtaggtcagcccaaatacgaatgtgcagcggtgctggggtcatgatggctcggtgggcagcgaggggccgggccggctggaggagcacagtgcggattctattctgaaagtcaagaagacatcatccggaatattgccaggcacctcgcccaggtcggggacagccgactcggaccgatg

SEQ ID NO: 11073 - DNA, 203 bp, Homo sapiens
  source 1..203: mol_type = other DNA
ggcgcgccagtccttacgaaagagtagttaggatggctgaaggggagtacattcggctgaaggccgactgtgattcccccggttgatacaaggcgattttgaccccctgagggctgctctagaggactcaggccccgaagctgtcccagggaggtccccgctgcatcccaccacccaagctgtgcctccgactcggaccgatg

SEQ ID NO: 11074 - DNA, 203 bp, Homo sapiens
  source 1..203: mol_type = other DNA
ggcgcgccagtccttcacccgcagtagttaggatggctgaaggggatactcaccggctgaaggccgactgtgattcccccggttgatacaaggcgattttgaccccctgagggctgctctagaggactcaggccccgaagctgtcccagggaggtccccgctgcatcccaccacccaagctgtgcctccgactcggaccgatg

SEQ ID NO: 11075 - DNA, 203 bp, Homo sapiens
  source 1..203: mol_type = other DNA
ggcgcgccagtcctcataaataagtagttaggatggctgaaggggatactcaccggctgaaggccgactgtgattccccctacccccacaaggcgattttgaccccctgagggctgctaattttctaagcacccccgaagctgtcccagggaggtccccgctgcatcccaccacccaagctgtgcctccgactcggaccgatg

SEQ ID NO: 11076 - DNA, 203 bp, Homo sapiens
  source 1..203: mol_type = other DNA
ggcgcgccagtcctgagctagtagtagttaggatggctgaaggggatactcaccggctgaaggccgactgtgattccccctacccccacaaggcgattttgaccccctgagggctgctctagaggactcaggatagctgatcaggacagggaggtccccgctgcatcccaccacccaagctgtgcctccgactcggaccgatg

SEQ ID NO: 11077 - DNA, 203 bp, Homo sapiens
  source 1..203: mol_type = other DNA
ggcgcgccagtcctacgcgcctagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11078 - DNA, 203 bp, Homo sapiens
  source 1..203: mol_type = other DNA
ggcgcgccagtcctagagtttaagtagttaggatggctgaaggggatactcaccggctgaagtgtactacgctggacccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11079 - DNA, 203 bp, Homo sapiens
  source 1..203: mol_type = other DNA
ggcgcgccagtcctaatacccgagtagttaggatggctgaaggggatatcacagtatgcggcgccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11080 - DNA, 203 bp, Homo sapiens
  source 1..203: mol_type = other DNA
ggcgcgccagtccttgaaaccaagtagttaggattctgcctaatagatctcaccggctgaaggccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 11081 - DNA, 203 bp, Homo sapiens
  source 1..203: mol_type = other DNA
ggcgcgccagtcctgcccgtgaagtcaataagactgtggtgagagagttcgtcgtcctcggcccgcatattgactacaggctgcagcagctgctctttgttatcttcctgctcctctacctgttcactctgggcaccaatgcaatcatcatttccaccattgtgctggacagagcccttcatactccccgactcggaccgatg

SEQ ID NO: 11082 - DNA, 203 bp, Homo sapiens
  source 1..203: mol_type = other DNA
ggcgcgccagtcctaaacatacagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 11083 - DNA, 203 bp, Homo sapiens
  source 1..203: mol_type = other DNA
ggcgcgccagtccttgacgggcagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagaggaaccgtattggatcgactcggaccgatg

SEQ ID NO: 11084 - DNA, 203 bp, Homo sapiens
  source 1..203: mol_type = other DNA
ggcgcgccagtcctgacaaaccagtcaataagactgtggtgagagagttcgtcgtcctcggcttctcatccctggccaggctgcagcagctgctctttgttatcttcctgctcctctattgcgaattcgctagcaccaatgcaatcatcatttccaccattgtgctggacagagcccttcatactccccgactcggaccgatg

SEQ ID NO: 11085 - DNA, 203 bp, Homo sapiens
  source 1..203: mol_type = other DNA
ggcgcgccagtcctctcgttgtagtcaataagactgtggtgagagagttcgtcgtcctcggcttctcatccctggctgacggttcaagcgtgctctttgttatcttcctgctcctctacctgttcactctgggcaccaatgcaatcatcatttccaccattgtgctggacagagcccttcatactccccgactcggaccgatg

SEQ ID NO: 11086 - DNA, 203 bp, Homo sapiens
  source 1..203: mol_type = other DNA
ggcgcgccagtccttcagaagaagtcaggctattaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11087 - DNA, 203 bp, Homo sapiens
  source 1..203: mol_type = other DNA
ggcgcgccagtcctgtttggacagtcaggtggagcgaggctagctggcccgatttctcctccgggtgatgcttttcctagattattctctgatttggtcgtattgggcgcctggtcaccagggctgcttttaactctggtaaagtgagggcacagttatccaatgaccccttcattgacctcaactaccgactcggaccgatg

SEQ ID NO: 11088 - DNA, 203 bp, Homo sapiens
  source 1..203: mol_type = other DNA
ggcgcgccagtcctatggacgcagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcacatctacgccggtgcgactcggaccgatg

SEQ ID NO: 11089 - DNA, 203 bp, Homo sapiens
  source 1..203: mol_type = other DNA
ggcgcgccagtcctggctttcaagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactaccgactcggaccgatg

SEQ ID NO: 11090 - DNA, 203 bp, Homo sapiens
  source 1..203: mol_type = other DNA
ggcgcgccagtcctggcggtgtagtcaggtggagcgaggctagctggcccgatttctcctccgggtgatgcttttcctagattattctctgatttggtcgtattgggcgcctggtcaccagggctgcttttaactctggtaaagtgttcggaaacagtcccaatgaccccttcattgacctcaactaccgactcggaccgatg

SEQ ID NO: 11091 - DNA, 203 bp, Homo sapiens
  source 1..203: mol_type = other DNA
ggcgcgccagtcctgtttccaaagtcaggtggagcgaggctagctggcccgatttctcctccgggtgatgcttttcctagattattctctgatttggtcgtattgggcgcctggtcaccagggctgcttttaggaggctgtctccagatattgttgccatcaatgaccccttcattgacctcaactaccgactcggaccgatg

SEQ ID NO: 11092 - DNA, 203 bp, Homo sapiens
  source 1..203: mol_type = other DNA
ggcgcgccagtccttgcgtatcagtcaggtggagcgaggctagctggcccgatttctcctccgggtgatgcttttcctagattattctctgatttggtcgtattgggcgcctggtcaccagggctgcttttatgcactaagcttgagatattgttgccatcaatgaccccttcattgacctcaactaccgactcggaccgatg

SEQ ID NO: 11093 - DNA, 203 bp, Homo sapiens
  source 1..203: mol_type = other DNA
ggcgcgccagtcctttgctttaagtcaggtggagcgaggctagctggcccgatttctcctccgggtgatgcttttcctagattattctctgatttggtcgtattgggcgcctggtcacggtaaagcagccgcactctggtaaagtggatattgttgccatcaatgaccccttcattgacctcaactaccgactcggaccgatg

SEQ ID NO: 11094 - DNA, 203 bp, Homo sapiens
  source 1..203: mol_type = other DNA
ggcgcgccagtcctactaatcgagtcaggtggagcgaggctagctggcccgatttctcctcctaaacgccggaagtctagattattctctgatttggtcgtattgggcgcctggtcaccagggctgcttttaactctggtaaagtggatattgttgccatcaatgaccccttcattgacctcaactaccgactcggaccgatg

SEQ ID NO: 11095 - DNA, 203 bp, Homo sapiens
  source 1..203: mol_type = other DNA
ggcgcgccagtccttcggatacagtcagttccaagacgaggtaaacaacaaactcattcgccgagtttctaaacaagacatattcgagtgactcataagaagttgaataacaaaatgccggaaatctacggattgtgtatatccatcatgaaaaaaactaacacccctcctttcgaaccaccccaaaccgactcggaccgatg

SEQ ID NO: 11096 - DNA, 203 bp, Homo sapiens
  source 1..203: mol_type = other DNA
ggcgcgccagtcctgcgttaccagtcagttccaatcatcaagctcgtccaaactcattcgccgagtttctaaacaaagtcagaatcgtccactcataagaagttgaataacaaaatgccggaaatctacggattgtgtatatccatcatgaaaaaaactaacacccctcctttcgaaccaccccaaaccgactcggaccgatg

SEQ ID NO: 11097 - DNA, 203 bp, Homo sapiens
  source 1..203: mol_type = other DNA
ggcgcgccagtcctaactatcgagtcagttccaatcatcaagctcgtccaaactcattcgccgagtttctaaacaagacatattcgagtgactcataagaagttcttacgagcctacgcggaaatctacggattgtgtatatccatcatgaaaaaaactaacacccctcctttcgaaccaccccaaaccgactcggaccgatg

SEQ ID NO: 11098 - DNA, 203 bp, Homo sapiens
  source 1..203: mol_type = other DNA
ggcgcgccagtcctgcctggtcagtcagttccaatcatcaagctcgtccaaactcattcgccgagtttctaaacaagacatattcgagtgactcataagaagttgaataacaaaatgcaatcttgagctctgttgtgtatatccatcatgaaaaaaactaacacccctcctttcgaaccaccccaaaccgactcggaccgatg

SEQ ID NO: 11099 - DNA, 203 bp, Homo sapiens
  source 1..203: mol_type = other DNA
ggcgcgccagtcctaagtctgaagtcagttccaatcatcaagctcgtccaaactcattcgccgagtttctaaacaagacatattcgagtgactcataagaagttgaataacaaaatgccggaaatctacggattgtgtatatccatatcctggttcctgcacacccctcctttcgaaccaccccaaaccgactcggaccgatg

SEQ ID NO: 11100 - DNA, 203 bp, Homo sapiens
  source 1..203: mol_type = other DNA
ggcgcgccagtcctatcaagagagtcagttccaatcatcaagctcgtccaaactcattcgccgagtttctaaacaagacatattcgagtgcacgccggatccaagaataacaaaatgccggaaatctacggattgtgtatatccatcatgaaaaaaactaacacccctcctttcgaaccaccccaaaccgactcggaccgatg

SEQ ID NO: 11101 - DNA, 203 bp, Homo sapiens
  source 1..203: mol_type = other DNA
ggcgcgccagtcctctgcaataagtccgattggggctgcgcgcttcgcttctgcggctcagcctccagcccaggtggcgctgtggaccctgcagccgcggagcgaggcagcggggcggctccgtgaccacggcgggcggagcctagtggacctacgacgtgctgctgtggccgtggctgttcgcgaggcgactcggaccgatg

SEQ ID NO: 11102 - DNA, 203 bp, Homo sapiens
  source 1..203: mol_type = other DNA
ggcgcgccagtcctacttcgaaagtccgattggggctgcgcgcttcgcttctgcggctcagcgagagtgttcttccgcgctgtggaccctgcagccgcggagcgaggcagcggggcggctccgtgaccacggcgggcggagcctaggactgagggcgatggctgctgtggccgtggctgttcgcgaggcgactcggaccgatg

SEQ ID NO: 11103 - DNA, 203 bp, Homo sapiens
  source 1..203: mol_type = other DNA
ggcgcgccagtccttcttcacgagtccgtaagttaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcgactcggaccgatg

SEQ ID NO: 11104 - DNA, 203 bp, Homo sapiens
  source 1..203: mol_type = other DNA
ggcgcgccagtccttgcaggacagtcggagctctatggaggtggcagcaacagagagaactaggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 11105 - DNA, 203 bp, Homo sapiens
  source 1..203: mol_type = other DNA
ggcgcgccagtcctcaatgggtagtcggagctctatggaggtggcagcgggtaccgagtggcggctgcagcagcgaaggtatacgatgctgtttgaggccgtccccgactccttcctcccccttccctcccccttttttttgttttccgttcccctttcccctcccttccctatccccgacgaccggacgactcggaccgatg

SEQ ID NO: 11106 - DNA, 203 bp, Homo sapiens
  source 1..203: mol_type = other DNA
ggcgcgccagtcctgattcgccagtcggagctctatggaggtggcagcgggtaccgagtggcggctgcagcagcgactcctctgagctgagtttgaggccgtccatagtcagagatggccccttccctcccccttttttttgttttccgttcccctttcccctcccttccctatccccgacgaccggacgactcggaccgatg

SEQ ID NO: 11107 - DNA, 203 bp, Homo sapiens
  source 1..203: mol_type = other DNA
ggcgcgccagtcctcgatagatagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctattatgtcaatgtactcgactcggaccgatg

SEQ ID NO: 11108 - DNA, 203 bp, Homo sapiens
  source 1..203: mol_type = other DNA
ggcgcgccagtcctttcatcgcagtcggagctctatggaggtggcagcgggtaccgagtggcggctgcagcagcgactcctctgagctgagtttgaggccgtccccgactccttcctcccccttccctcccccttttttttgttttggacattgagccaacctcccttccctatccccgacgaccggacgactcggaccgatg

SEQ ID NO: 11109 - DNA, 203 bp, Homo sapiens
  source 1..203: mol_type = other DNA
ggcgcgccagtcctaccaactgagtcggagctctatggaggtggcagcgggtaccgagtggcggctgcagcagcgactcctctgagctgagtttgaggccgtccccgactccttcctcccccttccctccccgcgggaacgcacacccgttcccctttcccctcccttccctatccccgacgaccggacgactcggaccgatg

SEQ ID NO: 11110 - DNA, 203 bp, Homo sapiens
  source 1..203: mol_type = other DNA
ggcgcgccagtcctaggtaactagtcggagctctccatgccaccattagggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 11111 - DNA, 203 bp, Homo sapiens
  source 1..203: mol_type = other DNA
ggcgcgccagtcctaatcacttagtctgacagagtgctgtgatatctggggctcctgctgctatagctggatttgcagctttactgcaaactgtgactggtgtgagcgctgttgctcaagtggggtatagattttttagtgactgggatcacaaagtttctactgttggtttatatcaacaaccaggacgactcggaccgatg

SEQ ID NO: 11112 - DNA, 203 bp, Homo sapiens
  source 1..203: mol_type = other DNA
ggcgcgccagtccttgtttaacagtgacgtcataccggttttacacacgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 11113 - DNA, 203 bp, Homo sapiens
  source 1..203: mol_type = other DNA
ggcgcgccagtccttgaaccacagtgacgtcataggtaaacaggctctgtatccgtggcagcggccgtggcaggctggctgggtaccggctgtcgctgacccaggagaagctgcctgtctacatcagcctggcaaaactttgctctccgccgcggggccggcagccatggccaaggacatcctgggtgcgactcggaccgatg

SEQ ID NO: 11114 - DNA, 203 bp, Homo sapiens
  source 1..203: mol_type = other DNA
ggcgcgccagtcctttaccacaagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaaccttattactaaccgactcggaccgatg

SEQ ID NO: 11115 - DNA, 203 bp, Homo sapiens
  source 1..203: mol_type = other DNA
ggcgcgccagtccttagccgccagtgacgtcataggtaaacaggctctgtatccgtggcagcggccgtggcaggctggctgggtaccggctgtcgctgacccaggagaagctgcctgtctacatcagcctgggctgcagcgcgctgttcggtatactggagcagccatggccaaggacatcctgggtgcgactcggaccgatg

SEQ ID NO: 11116 - DNA, 203 bp, Homo sapiens
  source 1..203: mol_type = other DNA
ggcgcgccagtcctcttactagagtgacgtcataggtaaacaggctctgtatccgtggcagcggccgtggcaggctggctgggtaccggctgtcgctgacccagtttgtataaagctcctacatcagcctgggctgcagcgcgctgccgccgcggggccggcagccatggccaaggacatcctgggtgcgactcggaccgatg

SEQ ID NO: 11117 - DNA, 203 bp, Homo sapiens
  source 1..203: mol_type = other DNA
ggcgcgccagtcctagttcctcagtgacgtcataggtaaacaggctctgtatccgtggcagcggccgtggcaggctggctgggtcagcatgtgcgctgacccaggagaagctgcctgtctacatcagcctgggctgcagcgcgctgccgccgcggggccggcagccatggccaaggacatcctgggtgcgactcggaccgatg

SEQ ID NO: 11118 - DNA, 203 bp, Homo sapiens
  source 1..203: mol_type = other DNA
ggcgcgccagtcctagattcgtagtgacgtcataggtaaacaggctctgtatccgtggctaattgataggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 11119 - DNA, 203 bp, Homo sapiens
  source 1..203: mol_type = other DNA
ggcgcgccagtcctcataagcgagtgactagctatttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagcccgactcggaccgatg

SEQ ID NO: 11120 - DNA, 203 bp, Homo sapiens
  source 1..203: mol_type = other DNA
ggcgcgccagtcctcaggtacaagtgactcccgtgccattggactcggccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 11121 - DNA, 203 bp, Homo sapiens
  source 1..203: mol_type = other DNA
ggcgcgccagtccttggagtagagtgagcgacacactctgcgtcctcgcctcaccagatggagaggagaaaacctatggtggctgtgaagagatactatggtactatgtcaaattgatatcatctgatggccatgaatttattgtaaaaagagaacatgcattaacatcaggcacgataaaagccatgcgactcggaccgatg

SEQ ID NO: 11122 - DNA, 203 bp, Homo sapiens
  source 1..203: mol_type = other DNA
ggcgcgccagtcctgtcgtcaaagtgagcgacacactctgcgtcctcgcctcaccagatggagaggagaaaacctatggtggctgtgaaggacctgatgccatgtatgtcaaattgatatcatctgatggccatgaatttattgtaaaaagagaacatgccacgttgaacactgcgataaaagccatgcgactcggaccgatg

SEQ ID NO: 11123 - DNA, 203 bp, Homo sapiens
  source 1..203: mol_type = other DNA
ggcgcgccagtcctcagacccaagtgagcgacacactctgcgtcctcgcctcaccagatggagaggagaaaacctatggtggctgtgaaggacctgatgccatgtatgtcaaattgatatcatctgatggcctgtctcagtcatcgaaaagagaacatgcattaacatcaggcacgataaaagccatgcgactcggaccgatg

SEQ ID NO: 11124 - DNA, 203 bp, Homo sapiens
  source 1..203: mol_type = other DNA
ggcgcgccagtcctctactgcgagtgagcgacacactctgcgtcctcgtgcatgtcctgtaggaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 11125 - DNA, 203 bp, Homo sapiens
  source 1..203: mol_type = other DNA
ggcgcgccagtccttacataacagtgagcgacacctcaaaatgttcttcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 11126 - DNA, 203 bp, Homo sapiens
  source 1..203: mol_type = other DNA
ggcgcgccagtcctacgcgggaagtggcggcttcgatgacctctggtacagccgcttccctgtgctgtgagtgtttccaccactccaggagacagcattcagagttgaccttgtgagagctggccataatttaattccatctctaggttttctgtcttattgtttcagaggcacatcgagaaccaacccgactcggaccgatg

SEQ ID NO: 11127 - DNA, 203 bp, Homo sapiens
  source 1..203: mol_type = other DNA
ggcgcgccagtcctccgccatgagtggcggcttctccatgggtccagccagccgcttccctgccacagataaagacccaccactccaggagacagcattcagagttgaccttgtgagagctggccataatttaattccatctctaggttttctgtcttattgtttcagaggcacatcgagaaccaacccgactcggaccgatg

SEQ ID NO: 11128 - DNA, 203 bp, Homo sapiens
  source 1..203: mol_type = other DNA
ggcgcgccagtcctaatggtcgagtggcggcttctccatgggtccagccagccgcttccctgtgctgtgagtgtttaagggggaggctccgacagcattcagagttgaccttgtgagagctggccataatttaattccatctctaggttttctgtcttattgtttcagaggcacatcgagaaccaacccgactcggaccgatg

SEQ ID NO: 11129 - DNA, 203 bp, Homo sapiens
  source 1..203: mol_type = other DNA
ggcgcgccagtcctgaatgttaagtggcggcttctccatgggtccagccagccgcttccctgtgctgtgagtgtttccaccactccaggagacagcattcagaggaagaagcagtctcgctggccataatttaattccatctctaggttttctgtcttattgtttcagaggcacatcgagaaccaacccgactcggaccgatg

SEQ ID NO: 11130 - DNA, 203 bp, Homo sapiens
  source 1..203: mol_type = other DNA
ggcgcgccagtccttgggcaacagtggcggcttctccatgggtccagccagccgcttccctgtgctgtgagtgtttccaccactccaggagacagcattcagagttgaccttgtgagagctggccataatttaattccatctctaggttttctgtcttattgtttcagaggcaccagctcctattgtacgactcggaccgatg

SEQ ID NO: 11131 - DNA, 203 bp, Homo sapiens
  source 1..203: mol_type = other DNA
ggcgcgccagtccttggtgtccagtggcggcttctccatgggtccagccagccgcttccctgtgctgtgagtgtttccaccactccaggattacattacgtcctttgaccttgtgagagctggccataatttaattccatctctaggttttctgtcttattgtttcagaggcacatcgagaaccaacccgactcggaccgatg

SEQ ID NO: 11132 - DNA, 203 bp, Homo sapiens
  source 1..203: mol_type = other DNA
ggcgcgccagtcctactccagcagtggcttactcagttacttgacacgttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 11133 - DNA, 203 bp, Homo sapiens
  source 1..203: mol_type = other DNA
ggcgcgccagtcctgcacgatgagtggcttactcccggtgccaggttcttggagctgtgaggtgttcagcattattagctgcgcttacgacatcatctgaagccacagtcccaggtcatcttcatcaccttccccagtggaatgcctcctgtgttaaagcccacaacaacccctgtggaggaacaacccgactcggaccgatg

SEQ ID NO: 11134 - DNA, 203 bp, Homo sapiens
  source 1..203: mol_type = other DNA
ggcgcgccagtcctaccacatcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 11135 - DNA, 203 bp, Homo sapiens
  source 1..203: mol_type = other DNA
ggcgcgccagtcctcgtttgttagttcagataggcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagccgactcggaccgatg

SEQ ID NO: 11136 - DNA, 203 bp, Homo sapiens
  source 1..203: mol_type = other DNA
ggcgcgccagtcctaaatggcaagttcagctgagagatataaaagagcagtctttccagcacaccaggcaaagccacggcgggcactgacgggcacttgcaccgtgtggacagactctccggttctggggaaatccagtccctgttactccattttggccagaaattcaaggatactgtcatgaagcacgactcggaccgatg

SEQ ID NO: 11137 - DNA, 203 bp, Homo sapiens
  source 1..203: mol_type = other DNA
ggcgcgccagtcctactctgttagttcagctgagagatataaaagagcagtctttccagcacctgcaaatccagagcggcgggcactgacgggcacttgcaccggaccccgctggcagccggttctggggaaatccagtccctgttactccattttggccagaaattcaaggatactgtcatgaagcacgactcggaccgatg

SEQ ID NO: 11138 - DNA, 203 bp, Homo sapiens
  source 1..203: mol_type = other DNA
ggcgcgccagtcctctcttctaagttcagctgagagatataaaagagcagtctttccagcacctgcaaatccagagcggcgggcactgacgggcacttgcaccgtgtggacagactctccgggaagacaaccttccagtccctgttactccattttggccagaaattcaaggatactgtcatgaagcacgactcggaccgatg

SEQ ID NO: 11139 - DNA, 203 bp, Homo sapiens
  source 1..203: mol_type = other DNA
ggcgcgccagtcctccaattaaagttcagctgagagatataaaagagcagtctttccagcacctgcaaatccagagcggcgggcactgacgggcacttgcaccgtgtggacagactctccggttctggggaaatccagtccctgttactccattttggccttctgcaacgattgactgtcatgaagcacgactcggaccgatg

SEQ ID NO: 11140 - DNA, 203 bp, Homo sapiens
  source 1..203: mol_type = other DNA
ggcgcgccagtcctaatattctagttcagctgagagatataaaagagcagtctttccagcacctgcaaatccagagcggcgggcactgacgggcacttgcaccgtgtggacagactctgaatccacttcacgatccagtccctgttactccattttggccagaaattcaaggatactgtcatgaagcacgactcggaccgatg

SEQ ID NO: 11141 - DNA, 203 bp, Homo sapiens
  source 1..203: mol_type = other DNA
ggcgcgccagtcctggcacggaagttcatccacaaacggagctttgtaatctcggattgtaaaaaatttctagacagactttagtgacttctgatctaagaacctccaccagggctgagggagctcaagtttcagcctgaggcatgggccaggaggccatggtgacctgagacccgtggattctgtcccgactcggaccgatg

SEQ ID NO: 11142 - DNA, 203 bp, Homo sapiens
  source 1..203: mol_type = other DNA
ggcgcgccagtcctactggtttagttcatccacaaacggagctttgtaatctcggattgtaagggccaagcttgtgcctcccgtctggccctgatctaagaacctccaccagggctgagggagctcaagtttcagcctgaggcatgggccaggaggccatggtgacctgagacccgtggattctgtcccgactcggaccgatg

SEQ ID NO: 11143 - DNA, 203 bp, Homo sapiens
  source 1..203: mol_type = other DNA
ggcgcgccagtccttgtaagagagttcatccacaaacggagctttgtaatctcggattgtaagggccaagcttgtggactttagtgacttctgatctaagaacctccaccagggctgagggagctcaagtttcagcctgaggcatgggccaggaggccataacagtaatgtcttcgtggattctgtcccgactcggaccgatg

SEQ ID NO: 11144 - DNA, 203 bp, Homo sapiens
  source 1..203: mol_type = other DNA
ggcgcgccagtcctccacccttagttcatccacaaacggagctttgtaatctcggattgtaagggccaagcttgtggactttagtgactttcccctgctaggagtccaccagggctgagggagctcaagtttcagcctgaggcatgggccaggaggccatggtgacctgagacccgtggattctgtcccgactcggaccgatg

SEQ ID NO: 11145 - DNA, 203 bp, Homo sapiens
  source 1..203: mol_type = other DNA
ggcgcgccagtccttaataggcagttcatccacaaacggagctttgtagcaggacgcctgcggggccaagcttgtggactttagtgacttctgatctaagaacctccaccagggctgagggagctcaagtttcagcctgaggcatgggccaggaggccatggtgacctgagacccgtggattctgtcccgactcggaccgatg

SEQ ID NO: 11146 - DNA, 203 bp, Homo sapiens
  source 1..203: mol_type = other DNA
ggcgcgccagtcctggtgtacgagttctcggtctagctctagtgcccacaagaaaacagctggtttactggtcactaggcagcggaacccccctcctggtaacaggagcctctgcggccaaaagccacgtggataagatccacctttgtgtgcggtgcaaccccagcaccctggtttcttggtgacaccgactcggaccgatg

SEQ ID NO: 11147 - DNA, 203 bp, Homo sapiens
  source 1..203: mol_type = other DNA
ggcgcgccagtcctgtggcgatagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggagggaatacaggttcgactcggaccgatg

SEQ ID NO: 11148 - DNA, 203 bp, Homo sapiens
  source 1..203: mol_type = other DNA
ggcgcgccagtcctcgctgtagagttctcggtctagctctagtgcccacaagaaaacagctgtagcgaccacacaataaggtttcccgttccctcctggtaacaggagcctctgcggccaaaagccacgtggataagatccacctttgtgtgcggtgcaaccccagcaccctggtttcttggtgacaccgactcggaccgatg

SEQ ID NO: 11149 - DNA, 203 bp, Homo sapiens
  source 1..203: mol_type = other DNA
ggcgcgccagtcctacccaagtagttctcggtctgcgcgatcccagaccaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacaccgactcggaccgatg

SEQ ID NO: 11150 - DNA, 203 bp, Homo sapiens
  source 1..203: mol_type = other DNA
ggcgcgccagtccttatgtactagttgtgaacagacatctcgagtaagattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttcgactcggaccgatg

SEQ ID NO: 11151 - DNA, 203 bp, Homo sapiens
  source 1..203: mol_type = other DNA
ggcgcgccagtcctggaagaacagttgtgaacagggtgtgaagagcctattgagctacatgagagtcctccggcccctgaatgcggctaaaaggtggagatacccaggcagctgcaacccagcagccagcctgtcgtaacgcgcaagtccgtggcggaaccgactactttgggtgtccgtgtttccttcgactcggaccgatg

SEQ ID NO: 11152 - DNA, 203 bp, Homo sapiens
  source 1..203: mol_type = other DNA
ggcgcgccagtcctagctacaaagttgtgaacagggtgtgaagagcctattgagctacatgagagtcctccggcccctgaatgcggctaatcctaaccatggagcaggcagctgcaacccagcagccagcctagaccctatatggggtccgtggcggaaccgactactttgggtgtccgtgtttccttcgactcggaccgatg

SEQ ID NO: 11153 - DNA, 203 bp, Homo sapiens
  source 1..203: mol_type = other DNA
ggcgcgccagtcctgaaacataagttgtgaacagggtgtgaagagcctattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttcgactcggaccgatg

SEQ ID NO: 11154 - DNA, 203 bp, Homo sapiens
  source 1..203: mol_type = other DNA
ggcgcgccagtcctacaatacaagttgtgaacagggtgtgaagagccttcgttcggctccccgagtcctccggcccctgaatgcggctaatcctaaccatggagcaggcagctgcaacccagcagccagcctgtcgtaacgcgcaagtccgtggcggaaccgactactttgggtgtccgtgtttccttcgactcggaccgatg

SEQ ID NO: 11155 - DNA, 203 bp, Homo sapiens
  source 1..203: mol_type = other DNA
ggcgcgccagtcctagtagttcataaaaaacccagtctttgctgaccagacaaagcataccagatctcaccagagagtcctaggggactacagaaggaaaaagaattccaagctcttaatatctgtgtgtcctcccgctgaccacacttcctttagtgacccgattgcctcctcaagtcgcagacactcgactcggaccgatg

SEQ ID NO: 11156 - DNA, 203 bp, Homo sapiens
  source 1..203: mol_type = other DNA
ggcgcgccagtcctccggtgtaataaaaaacccagtctttgctgaccagacaaagcataccagatctcaccagagagtcctaggggactacagaaggaaaaagacaagaggcagtaggatatctgtgtgtcctcccgctgaccacacttcctttagtgactgagcatatgttagaagtcgcagacactcgactcggaccgatg

SEQ ID NO: 11157 - DNA, 203 bp, Homo sapiens
  source 1..203: mol_type = other DNA
ggcgcgccagtcctgcgacagcataaactatgtgattccaagtgaagtcctactgactcgcctcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 11158 - DNA, 203 bp, Homo sapiens
  source 1..203: mol_type = other DNA
ggcgcgccagtcctcacggatgataaactatgtgcagttcctgatccacctactgactcgcctcttgatcgggctagttgcagctactccagacttactatccaagaactccccgacccgccgactgatctcccagagtctaacagcaatcagggactggctgagacttaaggcggcccaactgcaatcgactcggaccgatg

SEQ ID NO: 11159 - DNA, 203 bp, Homo sapiens
  source 1..203: mol_type = other DNA
ggcgcgccagtcctacttgggtataaactatgtgcagttcctgatccacctactgactcgcctcttgatcgggctatacaacatctgcagagacttactatccaagaactccccgacccgccgactgatctcccagagtctaacagcaatcagggactggagtttgggggtacgggcccaactgcaatcgactcggaccgatg

SEQ ID NO: 11160 - DNA, 203 bp, Homo sapiens
  source 1..203: mol_type = other DNA
ggcgcgccagtcctcgacacagataaactatgtgcagttcctgatccacctactgactcgcctcttgatcgggctatacaacatctgcagagacttactatccaagaactccccgacccgccgactgatctcccagagtctaacagcaatcagggactggctgagacttaaggcaaggggctatgttgcgactcggaccgatg

SEQ ID NO: 11161 - DNA, 203 bp, Homo sapiens
  source 1..203: mol_type = other DNA
ggcgcgccagtcctcgacatttataaactatgtgcagttcctgatccacctactgactcgcctcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 11162 - DNA, 203 bp, Homo sapiens
  source 1..203: mol_type = other DNA
ggcgcgccagtccttcaccgctataaactatgtgcagttcctgatccagggtaccgtaatattcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 11163 - DNA, 203 bp, Homo sapiens
  source 1..203: mol_type = other DNA
ggcgcgccagtcctcgaacactataaatgccccttggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttcgactcggaccgatg

SEQ ID NO: 11164 - DNA, 203 bp, Homo sapiens
  source 1..203: mol_type = other DNA
ggcgcgccagtcctcaaagtcgataagtaagccgtgccgaaacgttaagtacgtatacagcacgtaacaactgttagtttaattttccaaaatttatttttcacaatttttagttaagattttagcttgccttaagcagtctttatatcttctgtatattattttaaagtttataggagcaaagttcgcgactcggaccgatg

SEQ ID NO: 11165 - DNA, 203 bp, Homo sapiens
  source 1..203: mol_type = other DNA
ggcgcgccagtcctcgcgtggaataagtaagccgtgccgaaacgttaatcggtcgctagttgcgtaacaactgttagtttaattttccaaaatttatttttcacaatttttagttaagattttagcttgcctgtccactcgacctgatcttctgtatattattttaaagtttataggagcaaagttcgcgactcggaccgatg

SEQ ID NO: 11166 - DNA, 203 bp, Homo sapiens
  source 1..203: mol_type = other DNA
ggcgcgccagtccttcaggacgataagtaagccgtgccgaaacgttaatcggtcgctagttgcgtaacaactgttagtttaattttccaaaatttatttttcacggccgcccaacggaattttagcttgccttaagcagtctttatatcttctgtatattattttaaagtttataggagcaaagttcgcgactcggaccgatg

SEQ ID NO: 11167 - DNA, 203 bp, Homo sapiens
  source 1..203: mol_type = other DNA
ggcgcgccagtcctagcctgggataatgggctgtgtgcaatgtaaggataaagaagcaacaaaactgacggaggagagggacggcagcctgaaccagagctctgccaggttaatacaaacagaccccacccctcagcactaccccagcttcggtgtgacctccatccccaactacaacaacttccacgcgactcggaccgatg

SEQ ID NO: 11168 - DNA, 203 bp, Homo sapiens
  source 1..203: mol_type = other DNA
ggcgcgccagtcctaggagtgtataatgggctgtgtgcaatgtaaggataaagaagcaacaaaactgacggaggagagggacggcagcctgaaccagagctctgggtaccgctatggcacagaccccaccccgtgcactaggatatgcttcggtgtgacctccatccccaactacaacaacttccacgcgactcggaccgatg

SEQ ID NO: 11169 - DNA, 203 bp, Homo sapiens
  source 1..203: mol_type = other DNA
ggcgcgccagtcctctccaaccataatgggctgtgtgcaatgtaaggataaagaagcaacaaaactgacggaggagagggacggcagcctgaaccagagctctgggtaccgctatggccgttctagtttggttcagcactaccccagcttcggtgtgacctccatccccaactacaacaacttccacgcgactcggaccgatg

SEQ ID NO: 11170 - DNA, 203 bp, Homo sapiens
  source 1..203: mol_type = other DNA
ggcgcgccagtccttagagcgcataatgggctgtgtgcaatgtaaggataaagaagcaacaatctgagacacatgtagggacggcagcctgaaccagagctctgggtaccgctatggcacagaccccacccctcagcactaccccagcttcggtgtgacctccatccccaactacaacaacttccacgcgactcggaccgatg

SEQ ID NO: 11171 - DNA, 203 bp, Homo sapiens
  source 1..203: mol_type = other DNA
ggcgcgccagtcctggtccgtgatacacggtttgtcccccccttccccttccccggggtctgggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 11172 - DNA, 203 bp, Homo sapiens
  source 1..203: mol_type = other DNA
ggcgcgccagtccttcacgcatatacttggaaaaacccacatagcattaaaaacaaagtactactgaacaaagtgataaatacattttctccgtcacgatggccctaaccacaggaacatttaaacttacaatagaattcactgaagaatatccaaataaaccacctacagttagatttgtctctaagcgactcggaccgatg

SEQ ID NO: 11173 - DNA, 203 bp, Homo sapiens
  source 1..203: mol_type = other DNA
ggcgcgccagtcctttagccgaatatcaggctcttgaagagcctattgagctagctggtagtcctccggcccctgaatgcggctaatcctaactgcggagcacatgctcacaaaccagtgggtggtgtgtcgtaacgggcaactctgcagcggaaccgactactttgggtgtccgtgtttccttttatcgactcggaccgatg

SEQ ID NO: 11174 - DNA, 203 bp, Homo sapiens
  source 1..203: mol_type = other DNA
ggcgcgccagtcctgcgcatgcatattttaggccagaggttaataagaaggaagtagtgctatcttaataattaggttaactatttagttttactgttcaggatgcctattggcagccccataatatccaggacaccctctctgcttcttatatgattaggttgtcatttagaataagaaaataacctcgactcggaccgatg

SEQ ID NO: 11175 - DNA, 203 bp, Homo sapiens
  source 1..203: mol_type = other DNA
ggcgcgccagtcctaccagttaatcacccctaaatgtattccaaagaataagaacattgttttatacatagcacacttaacaaaatcaagaaatttaacattaatacagtactgttacctaatccgtagtcgattttcaaattttgtcagttgttccaataatgtcctttatatgactttgaggtgttcgactcggaccgatg

SEQ ID NO: 11176 - DNA, 203 bp, Homo sapiens
  source 1..203: mol_type = other DNA
ggcgcgccagtcctgtgtttagatcacccctaaatgtattccaaagaataagaacattgttttatacatagcacacttaacaaaatcaagaaatttaacattaatacagtactgttacctaatccgtagtcgattttcaaattttgtcagttgttccaatgccaggtggggacgattccccgcccagccgactcggaccgatg

SEQ ID NO: 11177 - DNA, 203 bp, Homo sapiens
  source 1..203: mol_type = other DNA
ggcgcgccagtcctctcggccaatcacccctaaatgtattccaaagaataagaacattgttttatacatagcacacttaacaaaatcaagtttcgactgtcccttacagtactgttacctaatccgtagtcgattttcaaattttgtcagttgttccaataatgtcctttatatattccccgcccagccgactcggaccgatg

SEQ ID NO: 11178 - DNA, 203 bp, Homo sapiens
  source 1..203: mol_type = other DNA
ggcgcgccagtccttccaccatatcaggctcaggttctgaggaagaagaggaggaggaggaagaggaggaggaggaagggagcaccagtgaagaatcagaggaggaagaggaagaggaggaggaggagaccggcagcaactctgagagactcatgagaacgtctgccgaagaagtaagtgaggaagaacgactcggaccgatg

SEQ ID NO: 11179 - DNA, 203 bp, Homo sapiens
  source 1..203: mol_type = other DNA
ggcgcgccagtcctgttaagccatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcatgagcaacgcagcttaagtgaggaagaacgactcggaccgatg

SEQ ID NO: 11180 - DNA, 203 bp, Homo sapiens
  source 1..203: mol_type = other DNA
ggcgcgccagtccttgaccgaaatcaggctcaggttctgaggaagaagaggaggaggaggaagaggaggaggaggatactgtacttgcacaagaatcagaggaggaagaggaagaggaggaggaggagaccggcagcaactctgaggaggcatcagagcagtctgccgaagaagtaagtgaggaagaacgactcggaccgatg

SEQ ID NO: 11181 - DNA, 203 bp, Homo sapiens
  source 1..203: mol_type = other DNA
ggcgcgccagtcctggaggcagatcaggctcaggttctgaggaagaaggacttataagactggaggaggaggaggaagggagcaccagtgaagaatcagaggaggaagaggaagaggaggaggaggagaccggcagcaactctgaggaggcatcagagcagtctgccgaagaagtaagtgaggaagaacgactcggaccgatg

SEQ ID NO: 11182 - DNA, 203 bp, Homo sapiens
  source 1..203: mol_type = other DNA
ggcgcgccagtcctcttccctgatcagttcaatagtttagttattttaaaatatttgagaataggtaagtttctatggcacttcatagcaataggtaataattaacagcttaattatacactccgttccccataaaatcgtaactatttaatttacaaagtaaaaacaaaaatatgggacaagtagttcgactcggaccgatg

SEQ ID NO: 11183 - DNA, 203 bp, Homo sapiens
  source 1..203: mol_type = other DNA
ggcgcgccagtcctgtgatacgatcattacattgtccgaggacgtggtgaaggagctgaagaaggctctgtgcaatcctcacattcaagctgataggctgcgctaccggaatgtcatccagcgagtgattagatctggctctcctggccatcaatacgctgtgcaaagactgctcagaccccaatccacgactcggaccgatg

SEQ ID NO: 11184 - DNA, 203 bp, Homo sapiens
  source 1..203: mol_type = other DNA
ggcgcgccagtcctgacggcggatccacaacatccttcaggtctccggcccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 11185 - DNA, 203 bp, Homo sapiens
  source 1..203: mol_type = other DNA
ggcgcgccagtcctcaggaaatatccacaacatctccacatcgctgtccccacccagccaggaatataagctatgcagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 11186 - DNA, 203 bp, Homo sapiens
  source 1..203: mol_type = other DNA
ggcgcgccagtccttatgcttcatccacaacatctccacatcgctgtccccacccagccagggcagcgccagcactagctcagacgcaaggacggaaccgctggactccaggttccttgcctgggagtaggagaaatccacctgctgggggctgagtgtgcttgcgttagtcttccctgggtcccgggcgactcggaccgatg

SEQ ID NO: 11187 - DNA, 203 bp, Homo sapiens
  source 1..203: mol_type = other DNA
ggcgcgccagtcctgtgtgctaatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 11188 - DNA, 203 bp, Homo sapiens
  source 1..203: mol_type = other DNA
ggcgcgccagtcctacttaatgatccacaacatctccacatcgctgtccccacccagccagggcagcgccagcactctgcaccgtatcctgacggaaccgctggactccaggttccttgcctgggagtaggagaaatccacctgctgggggctgagtgtggcctgagggacaggccctgggtcccgggcgactcggaccgatg

SEQ ID NO: 11189 - DNA, 203 bp, Homo sapiens
  source 1..203: mol_type = other DNA
ggcgcgccagtcctaactcctaatccagacaggactcaccgagtatcaaatgataagaactgtcgcgcaacttcctaataatacttgcactgggagcactaagaaaagattgatctctgggctggtgaacataatctctgtcccagtcagaaaaggagagaggaaattagcagagcgattggtggagacgactcggaccgatg

SEQ ID NO: 11190 - DNA, 203 bp, Homo sapiens
  source 1..203: mol_type = other DNA
ggcgcgccagtccttattaagtatccatgctctcaggctccgatttgtgaataggtttttatattcgaagtaggtagtattgcgcatactattaattccacaatacgtggtcttcgtcttagcaaatttacctttcgtccctatggaaatggctcttcggacctgagtacagtgggacaaccccaacgcgactcggaccgatg

SEQ ID NO: 11191 - DNA, 203 bp, Homo sapiens
  source 1..203: mol_type = other DNA
ggcgcgccagtcctgccgccacatccgcagtttaggagagaggaagtaagaagacgcctccgggtaagggacgcccgcctttggggaaaaaccaatgcgcgtactgtaaggaggagggacattggaagaagaactgtccaaaactcgtaagcggggcaaccccagtgttggtagaagaattacaatagcgactcggaccgatg

SEQ ID NO: 11192 - DNA, 203 bp, Homo sapiens
  source 1..203: mol_type = other DNA
ggcgcgccagtcctatgcgcaaatccgcccaggtagccggctcggacccaggtcctgcgcccaggtcctcccctgccccccagcgacggagccggggccgggggtaattttatgaaacggccatgcgggtgagccgcggctgcagaggcctgagcgcctgatcgccgcggacccgagccgagcccacccgactcggaccgatg

SEQ ID NO: 11193 - DNA, 203 bp, Homo sapiens
  source 1..203: mol_type = other DNA
ggcgcgccagtcctgaaagctgatccggagtaactaagttggctggtactgccgtaataaatttaagagcagaccagattaatgatatggtttattcccttcttgaaaagggtaaactacttattagagatacaaataaagaagttttcgttggtgacagtttggttaatgtaatctaaactttaaaacgactcggaccgatg

SEQ ID NO: 11194 - DNA, 203 bp, Homo sapiens
  source 1..203: mol_type = other DNA
ggcgcgccagtcctaatcgaacatctagtctcataagtgaccctccctgggctgctttctttcgattatcatcagtagggaaggtttcagtgctcttcccagcacaactccggtgcaaaggcttgggcatcctggtgctttgcctctagcccatgctccacagcgaggagagagaaaaccctgaggcacgactcggaccgatg

SEQ ID NO: 11195 - DNA, 203 bp, Homo sapiens
  source 1..203: mol_type = other DNA
ggcgcgccagtcctgggaaatcatctagtctcataagtgaccctccctgggctgctttctttcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11196 - DNA, 203 bp, Homo sapiens
  source 1..203: mol_type = other DNA
ggcgcgccagtcctcgaagatgatctagtctcataagtgaccctccctgggctgctttctttcgattatcatcagtgaccctaccccggctgctcttcccagcatcgtggaccacaggaggcttgggcatcctggtgctttgcctctagcccatgctccacagcgaggagagagaaaaccctgaggcacgactcggaccgatg

SEQ ID NO: 11197 - DNA, 203 bp, Homo sapiens
  source 1..203: mol_type = other DNA
ggcgcgccagtccttcctcttaatctagtctcataagtgaccctcccttacagttacaacagcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11198 - DNA, 203 bp, Homo sapiens
  source 1..203: mol_type = other DNA
ggcgcgccagtccttgatggcgatctagtctcatcctgcctatagaaagggctgctttctttcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11199 - DNA, 203 bp, Homo sapiens
  source 1..203: mol_type = other DNA
ggcgcgccagtcctggcatgtcatctagtttccttaaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgcccgactcggaccgatg

SEQ ID NO: 11200 - DNA, 203 bp, Homo sapiens
  source 1..203: mol_type = other DNA
ggcgcgccagtcctcttcatcaatctatgcactgtcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattcgactcggaccgatg

SEQ ID NO: 11201 - DNA, 203 bp, Homo sapiens
  source 1..203: mol_type = other DNA
ggcgcgccagtccttgcgagtaatctcagttctaaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 11202 - DNA, 203 bp, Homo sapiens
  source 1..203: mol_type = other DNA
ggcgcgccagtcctgttgcctcatctctagcagtggcgcccgaacagggacctgaaagcgaattcatggggtctaaagctctctcgacgcaggactcggcttgctgaagcgcgcacggcaagaggcgaggggcggcgactggtgagtacgccaaaaattttgactagcggaggctagaaggagagagacgactcggaccgatg

SEQ ID NO: 11203 - DNA, 203 bp, Homo sapiens
  source 1..203: mol_type = other DNA
ggcgcgccagtcctcggattcaatctctgtgcaccaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagcgactcggaccgatg

SEQ ID NO: 11204 - DNA, 203 bp, Homo sapiens
  source 1..203: mol_type = other DNA
ggcgcgccagtcctatgcatttatctgagaatagaaccacaatcaagtcatactactagtcactatacaataatcaacaattttagtcaactgattaccaagatgttatcataggtccgaactgatcaatctaacaaaaaaactaaacgttccacaataagctgcacactgctacaaaatattcagcccgactcggaccgatg

SEQ ID NO: 11205 - DNA, 203 bp, Homo sapiens
  source 1..203: mol_type = other DNA
ggcgcgccagtcctcacagttcatctgagaatagaaccacaatcaagtcatactactagtcactatacaataatcaacaattttagtcaatctggacgtttttagttatcataggtccgaactgatcaatctaacaaaaaaactaaacgttccacaataaatcaacgttcaggccaaaatattcagcccgactcggaccgatg

SEQ ID NO: 11206 - DNA, 203 bp, Homo sapiens
  source 1..203: mol_type = other DNA
ggcgcgccagtcctatgcttggatctgagaatagtcggggtgctggtacatactactagtcactatacaataatcaacaattttagtcaactgattaccaagatgttatcataggtccgaactgatcaatctaacaaaaaaactaaacgttccacaataaatcaacgttcaggccaaaatattcagcccgactcggaccgatg

SEQ ID NO: 11207 - DNA, 203 bp, Homo sapiens
  source 1..203: mol_type = other DNA
ggcgcgccagtcctaagaatgcatctgatctcagacgtgttctcgtcactgcaactcttggaacaagataagacagtcatccattagtaatttttaagaaaaaaacgataggaccgaacctagtattgaaagaaccgtctcggtcaatctaggtaatcgagctgataccgtctcggaaagctcaaatccgactcggaccgatg

SEQ ID NO: 11208 - DNA, 203 bp, Homo sapiens
  source 1..203: mol_type = other DNA
ggcgcgccagtcctcgcagaatatctgatctcagtgagaaaaatcaacctgcaactcttggaacaagataagacagtcatccattagtaaaacccccatcgtcgacgataggaccgaacctagtattgaaagaaccgtctcggtcaatctaggtaatcgagctgataccgtctcggaaagctcaaatccgactcggaccgatg

SEQ ID NO: 11209 - DNA, 203 bp, Homo sapiens
  source 1..203: mol_type = other DNA
ggcgcgccagtcctgggcgcgtatctgatctcagtgagaaaaatcaacctgcaactcttggaacaagataagacagtcatccattagtaatttttaagaaaaaaacgataggaccgaaagccaatcattgtcaaccgtctcggtcaatctaggtaatcgagctgataccgtctcggaaagctcaaatccgactcggaccgatg

SEQ ID NO: 11210 - DNA, 203 bp, Homo sapiens
  source 1..203: mol_type = other DNA
ggcgcgccagtccttcatagtgatctgatctcagtgagaaaaatcaacctgcaactcttggaacaagataagacagtcatccattagtaatttttaagaaaaaaacgataggaccgaacctagtattgaaagtcgttggctccgacatctaggtaatcgagctgataccgtctcggaaagctcaaatccgactcggaccgatg

SEQ ID NO: 11211 - DNA, 203 bp, Homo sapiens
  source 1..203: mol_type = other DNA
ggcgcgccagtccttaacgcccatctgatctcagtgagaaaaatcaacctgcaactcttggaacaagataagacagtcatccattagtaatttttaagaaaaaattctcttatttacccctagtattgaaagaaccgtctcggtcaatctaggtaatcgagctgataccgtctcggaaagctcaaatccgactcggaccgatg

SEQ ID NO: 11212 - DNA, 203 bp, Homo sapiens
  source 1..203: mol_type = other DNA
ggcgcgccagtcctgaactgctatctgcctacaaactggtttgctactttaccaactggtcccaggaccggcaggaaccaggaaaattcacccctgagaatattgaccccttcctatgctctcatctcatctattcattcgccagcgcgtcgcttgtggtggttatcatcaaggacaagagtgaagtgcgactcggaccgatg

SEQ ID NO: 11213 - DNA, 203 bp, Homo sapiens
  source 1..203: mol_type = other DNA
ggcgcgccagtccttcctttgcatctggccatccatccgtgggggtctatgggccttcgagatagccgccaggaatttttccagcagctactgcaaggctgtctcctgcctactgcccagcagggccttgaccagatctggctgctccttgccatctgcctcgcctgccgcctcctctggaggctcggcgactcggaccgatg

SEQ ID NO: 11214 - DNA, 203 bp, Homo sapiens
  source 1..203: mol_type = other DNA
ggcgcgccagtccttttcacaaatctggccatccatccgtgggggtctgcaatggccaccttcctaatgtgttctattttccagcagctactgcaaggctgtctcctgcctactgcccagcagggccttgaccagatctggctgctccttgccatctgcctcgcctgccgcctcctctggaggctcggcgactcggaccgatg

SEQ ID NO: 11215 - DNA, 203 bp, Homo sapiens
  source 1..203: mol_type = other DNA
ggcgcgccagtcctaattacggatctggccatccatccgtgggggtctgcaatggccacctttagccgccaggaatgcagtattgctaacctgcaaggctgtctcctgcctactgcccagcagggccttgaccagatctggctgctccttgccatctgcctcgcctgccgcctcctctggaggctcggcgactcggaccgatg

SEQ ID NO: 11216 - DNA, 203 bp, Homo sapiens
  source 1..203: mol_type = other DNA
ggcgcgccagtcctttaggttcatctggccatccatccgtgggggtctgcaatggccacctttagccgccaggaatttttccagcagctactgcaaggctgtctcctgcctactgcccagcagggccttgacatatcaccagccgcccttgccatctgcctcgcctgccgcctcctctggaggctcggcgactcggaccgatg

SEQ ID NO: 11217 - DNA, 203 bp, Homo sapiens
  source 1..203: mol_type = other DNA
ggcgcgccagtcctaacctcctatctggccatccatccgtgggggtctgcaatggccacctttagccgccaggaatttttccagcagctactgcaaggctgtctcctgcctactgcccagcagggccttgaccagatctggctgctccttgccatctgccggtatcctatgacactctggaggctcggcgactcggaccgatg

SEQ ID NO: 11218 - DNA, 203 bp, Homo sapiens
  source 1..203: mol_type = other DNA
ggcgcgccagtccttgctgctaatctggccatccatccgtgggggtctgcaatggccacctttagccgccaggaatttttccagcagctactgcaaggctgtctgactggctaaatgaagcagggccttgaccagatctggctgctccttgccatctgcctcgcctgccgcctcctctggaggctcggcgactcggaccgatg

SEQ ID NO: 11219 - DNA, 203 bp, Homo sapiens
  source 1..203: mol_type = other DNA
ggcgcgccagtcctgctcagctatctggccatccatccgtgggggtctgcaatggccacctttagccgccaggaatttttccagcagctataattgcatccgaacctgcctactgcccagcagggccttgaccagatctggctgctccttgccatctgcctcgcctgccgcctcctctggaggctcggcgactcggaccgatg

SEQ ID NO: 11220 - DNA, 203 bp, Homo sapiens
  source 1..203: mol_type = other DNA
ggcgcgccagtcctagtaaaccatctggccatcccgtacgaattaggcgcaatggccacctttagccgccaggaatttttccagcagctactgcaaggctgtctcctgcctactgcccagcagggccttgaccagatctggctgctccttgccatctgcctcgcctgccgcctcctctggaggctcggcgactcggaccgatg

SEQ ID NO: 11221 - DNA, 203 bp, Homo sapiens
  source 1..203: mol_type = other DNA
ggcgcgccagtcctattagcggatcttcctcccggcggttttttggttagtagctcacaatcatctcgtgtttcagcaaagtgtgcataattataaagtgctgggtcatctaagcttttcagtcgagaaaaaaacagtagatcagaagaacaactggcaacacttctcatcctgagacctacttcaagcgactcggaccgatg

SEQ ID NO: 11222 - DNA, 203 bp, Homo sapiens
  source 1..203: mol_type = other DNA
ggcgcgccagtcctcgaacttaatcttggcgaattaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 11223 - DNA, 203 bp, Homo sapiens
  source 1..203: mol_type = other DNA
ggcgcgccagtcctccggcactatgacagagatcttctagactaggtgcgagaggccgaggaccagaacaacatccgcctaccctccatcattgttataaaaaacttaggaaccaggtccacacagccgccagccaaccaaccatccactcccacgactgaccataggttgtatagagcaggcacgcccgactcggaccgatg

SEQ ID NO: 11224 - DNA, 203 bp, Homo sapiens
  source 1..203: mol_type = other DNA
ggcgcgccagtcctctatcttcatgacagagatcttctagactaggtgcgagaggccgaggaccagaacaacatccgcctaccctccatcattgttataaaaaacttaggaaccaggtccacacagccgccagccaaccaaccatcgtactgtttcgtgagagccgatggcagaagagcaggcacgcccgactcggaccgatg

SEQ ID NO: 11225 - DNA, 203 bp, Homo sapiens
  source 1..203: mol_type = other DNA
ggcgcgccagtcctgacatcgaatgacagagatcttctagactaggtggatccacagcgattccagaacaacatccgcctaccctccatcattgttataaaaaacttaggaaccaggtccacacagccgccagccaaccaaccatccactcccacgactggagccgatggcagaagagcaggcacgcccgactcggaccgatg

SEQ ID NO: 11226 - DNA, 203 bp, Homo sapiens
  source 1..203: mol_type = other DNA
ggcgcgccagtcctcctctccgatgaccaattatatgaatcaattatctgaattacttggatttgatcttaatccataaattataataaagcgacttatcttggtcaatgtcactaacaccattagttaatataaaacttgacagaagataaaaatggggcaaataaatcaattcagccgacccaacccgactcggaccgatg

SEQ ID NO: 11227 - DNA, 203 bp, Homo sapiens
  source 1..203: mol_type = other DNA
ggcgcgccagtccttcccgaggatgagaagcgaccacccctcgacgacttctccttcacggtcgaacgagtatcatacggccaactctcccccggaatccataacggctcacgcaaatagatttctttccgttcctcctcggagggctctccacatttatctgctcgagacgtggcagctccagaacccgactcggaccgatg

SEQ ID NO: 11228 - DNA, 203 bp, Homo sapiens
  source 1..203: mol_type = other DNA
ggcgcgccagtcctgtccctatatgagaagcgaccacccctcgacgacttctccttcacggttcccacccaggagcacggccaactctcccccggaatccataacggctcacgcaaatagatttctttccgtaatagacaacctatctctccacatttatctgctcgagacgtggcagctccagaacccgactcggaccgatg

SEQ ID NO: 11229 - DNA, 203 bp, Homo sapiens
  source 1..203: mol_type = other DNA
ggcgcgccagtcctaaactaggatgagaagcgaccacccctcgacgacttctccttcacggttcccacccaggagcacggccaactctcccccggaatccataacggctcacgcaaatagatttctttccgttcctcctcggagggagtagtcatcccccctgctcgagacgtggcagctccagaacccgactcggaccgatg

SEQ ID NO: 11230 - DNA, 203 bp, Homo sapiens
  source 1..203: mol_type = other DNA
ggcgcgccagtccttagcaactatgagaagcgaccacccctcgacgacttctccttcacggttcccacccaggagcacggccaactctcccccggaatccataacggctcacgcaaatagatttctttccgttcctcctcggagggctctccacatttatctgctcgagacgtgttgcgatacccctacgactcggaccgatg

SEQ ID NO: 11231 - DNA, 203 bp, Homo sapiens
  source 1..203: mol_type = other DNA
ggcgcgccagtcctcggcagcgatgagaagcgaccacccctcgacgacttctccttcacggttcccacccaggagcacggccaactctcccccggaatccataattttctcaaatcgaagatttctttccgttcctcctcggagggctctccacatttatctgctcgagacgtggcagctccagaacccgactcggaccgatg

SEQ ID NO: 11232 - DNA, 203 bp, Homo sapiens
  source 1..203: mol_type = other DNA
ggcgcgccagtcctcaagacttatgagcgcgagcggcgggctcttgggtcttttttagcgccatctgctcgcggcgccgcctcctgctcctcccgctgctgctgccgctgccgccctgagtcactgcctgcgcagctccggccgccaaaggtgtacgttcagtcgccgatatttggagttcttacaaccgactcggaccgatg

SEQ ID NO: 11233 - DNA, 203 bp, Homo sapiens
  source 1..203: mol_type = other DNA
ggcgcgccagtccttcgtatgtatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 11234 - DNA, 203 bp, Homo sapiens
  source 1..203: mol_type = other DNA
ggcgcgccagtccttgtcaagcatgagcgcgagcggcgggctcttgggtcttttttagcgccatctgctcgcggcgccgcctcctgctcctcccgctgctgctgccgctgccgccctgagtcactgcctgcggccggtgacttatatggctccccatactagtcgccgatatttggagttcttacaaccgactcggaccgatg

SEQ ID NO: 11235 - DNA, 203 bp, Homo sapiens
  source 1..203: mol_type = other DNA
ggcgcgccagtcctactaacatatgagcgcgagcggcgggctcttgggtcttttttagcgcctaactgagcgtcgtccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 11236 - DNA, 203 bp, Homo sapiens
  source 1..203: mol_type = other DNA
ggcgcgccagtcctatgacaacatgatctttgaatattaaatgaaaggagactagaataacaactatgaacaggcgcatgaaggagctttagcaggagcattctttcttggtgtgcaaatcacgcctggcagcccctgcccacagtacccgaagatggcaggccttgttcccttcacctaaattcatacgactcggaccgatg

SEQ ID NO: 11237 - DNA, 203 bp, Homo sapiens
  source 1..203: mol_type = other DNA
ggcgcgccagtccttgcgtcgtatgatctttgaatattaaatgaaaggagactagaataacagtctcttgactattcatgaaggagctttagcaggagcattctgatccctacgaattatcacgcctggcagcccctgcccacagtacccgaagatggcaggccttgttcccttcacctaaattcatacgactcggaccgatg

SEQ ID NO: 11238 - DNA, 203 bp, Homo sapiens
  source 1..203: mol_type = other DNA
ggcgcgccagtccttggccctaatgatgatgcttggtttaagctatcgagttgaccccgggtcaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 11239 - DNA, 203 bp, Homo sapiens
  source 1..203: mol_type = other DNA
ggcgcgccagtccttttgagtgatgatgatgcttggtttaagctatcgtaccattatgaaaacaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 11240 - DNA, 203 bp, Homo sapiens
  source 1..203: mol_type = other DNA
ggcgcgccagtccttcgggcttatgatgatgcttggtttaagctatcgtaccattatgaaaacaattcttggttcttccgacatgtctacaggaaaagttttcatttccgtaaggcttgtcaaaatttagattgtaattgtttggggttttatgaatcttttccacgccttagataaactcagtgaaacgactcggaccgatg

SEQ ID NO: 11241 - DNA, 203 bp, Homo sapiens
  source 1..203: mol_type = other DNA
ggcgcgccagtcctaggatgccatgatgatgcttttgcgccctctgtataccattatgaaaacaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 11242 - DNA, 203 bp, Homo sapiens
  source 1..203: mol_type = other DNA
ggcgcgccagtcctcgttacccatgatgcgaggcgaaatgaatcaagtagattctctgggatataagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 11243 - DNA, 203 bp, Homo sapiens
  source 1..203: mol_type = other DNA
ggcgcgccagtccttggaccctatgcaattaagggcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggcgactcggaccgatg

SEQ ID NO: 11244 - DNA, 203 bp, Homo sapiens
  source 1..203: mol_type = other DNA
ggcgcgccagtcctgacagggtatgcagtggtgtgatcctgcgccagggggtgtgggcctcgctcaccggcggttggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 11245 - DNA, 203 bp, Homo sapiens
  source 1..203: mol_type = other DNA
ggcgcgccagtcctttgcacggatgcatagtatgctacgcgcgcgccaatctccacgacgccgactaacgcccctgtacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 11246 - DNA, 203 bp, Homo sapiens
  source 1..203: mol_type = other DNA
ggcgcgccagtcctccgtccgcatgcggcggcccaatcggaaggtggaccgaaatcccgcgacagcaagaggcccggtttccagttgacagctaaggaacacagtgctttcaaaagaattggcgtccgctgttcgcctctcctcccgggagtcttctgcctactcccagaagaggagggaagcacagtcgactcggaccgatg

SEQ ID NO: 11247 - DNA, 203 bp, Homo sapiens
  source 1..203: mol_type = other DNA
ggcgcgccagtcctgtcaccagatgcggcggcccaatcggaaggtggaccgaaatcccgcgacagcaagaggcccgtagcgacccgcggtaaggctagcaggtatgctttcaaaagaattggcgtccgctgttcgcctctcctcccgggagtcttctgcctactcccagaagaggagggaagcacagtcgactcggaccgatg

SEQ ID NO: 11248 - DNA, 203 bp, Homo sapiens
  source 1..203: mol_type = other DNA
ggcgcgccagtcctgtataagaatgcggcggcccaatcggaaggtggaccgaaatcccgcgacagcaagaggcccgtagcgacccgcggtgctaaggaacacagtgctttcaaaagaattggcgtccgctgttcgcctctcctccctttttcaccacaggtactcccagaagaggagggaagcacagtcgactcggaccgatg

SEQ ID NO: 11249 - DNA, 203 bp, Homo sapiens
  source 1..203: mol_type = other DNA
ggcgcgccagtcctgctagtatatgctaccagaggtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggcgactcggaccgatg

SEQ ID NO: 11250 - DNA, 203 bp, Homo sapiens
  source 1..203: mol_type = other DNA
ggcgcgccagtcctataccggcatgctactttatgcgccccgcccttgcgctcagcgccctctcaccgcccggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 11251 - DNA, 203 bp, Homo sapiens
  source 1..203: mol_type = other DNA
ggcgcgccagtcctagtgaattatgctgcaaaagcatatgctgaacaatcgtgttgcgtgtttgtgattaactacagtgtattagacttgacagcagaagaactagaggctatcaaacatcagcttaatccaaaagataatgatgtagagctttgagttaataaaaaaaatggggcaaataaaacatccgactcggaccgatg

SEQ ID NO: 11252 - DNA, 203 bp, Homo sapiens
  source 1..203: mol_type = other DNA
ggcgcgccagtcctcccttgcaatggagtggtttgctatttagcgtacgtgtaccataggcagccccaaaaacacgtgtgaggagaaagtcccagtcactttgggcaaagtagacagccgcgcttgcgtggtgggacttaattaatgcctgctaacccagagcctcgctgccggtttgatacaacaaccgactcggaccgatg

SEQ ID NO: 11253 - DNA, 203 bp, Homo sapiens
  source 1..203: mol_type = other DNA
ggcgcgccagtcctttcttactatggagtggtttgctatttagcgtactccggattgctcgcgccccaaaaacacgtgtgaggagaaagtcccagtcactttgggcaaagtagacagccgcgcttgcgtggtgggacttaattaatgcctgctaacccagttgaaattgataattttgatacaacaaccgactcggaccgatg

SEQ ID NO: 11254 - DNA, 203 bp, Homo sapiens
  source 1..203: mol_type = other DNA
ggcgcgccagtcctaacgatttatggcagggccacgccccagcccatgacaacaatgttggatggcagccttgatcagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 11255 - DNA, 203 bp, Homo sapiens
  source 1..203: mol_type = other DNA
ggcgcgccagtccttgagtgatatggcagggccacgccccagcccatgggccaggctgctccattgcaatgctcgtagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 11256 - DNA, 203 bp, Homo sapiens
  source 1..203: mol_type = other DNA
ggcgcgccagtcctaccatcaaatggcagggccacgccccagcccatgggccaggctgctcctggcagccttgatcagcgtcagcctctccacttgtgcctaccaccgctgcaagaaggccccagtgaagagctgcacggagtgtgtccgtgtggataaggactgcgcctactgcacagacgagatgtcgactcggaccgatg

SEQ ID NO: 11257 - DNA, 203 bp, Homo sapiens
  source 1..203: mol_type = other DNA
ggcgcgccagtcctagctgcggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactggtggagatcacgaccgactcggaccgatg

SEQ ID NO: 11258 - DNA, 203 bp, Homo sapiens
  source 1..203: mol_type = other DNA
ggcgcgccagtccttcccgttcatggcagggccagctatagtgatcatggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 11259 - DNA, 203 bp, Homo sapiens
  source 1..203: mol_type = other DNA
ggcgcgccagtcctcctaaaggatggcatccaacatggtgacaatcatagattgttatcataaagcgagttggattggccatccagtgtgaatcagattaattactcccttgtttgttggatccactcccgaaacgttttactccttaacttattgaaattgtttgaagacaggatttcagtgtcacacgactcggaccgatg

SEQ ID NO: 11260 - DNA, 203 bp, Homo sapiens
  source 1..203: mol_type = other DNA
ggcgcgccagtcctacggattaatggcggcgcttagttgcatgaaggcggaaactctgtgacttcgggtccgtagtggggcctgcggtgggagtgggaaggaaggcggagggaaccattacgaaacacccccattgcggcgagggtcgcctcgagagacggtttctgagttccttgaactttgtaagacgactcggaccgatg

SEQ ID NO: 11261 - DNA, 203 bp, Homo sapiens
  source 1..203: mol_type = other DNA
ggcgcgccagtcctagctggatatgtatatttaagcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgcgactcggaccgatg

SEQ ID NO: 11262 - DNA, 203 bp, Homo sapiens
  source 1..203: mol_type = other DNA
ggcgcgccagtcctcgatgcgcatgtggctaaccttaaccctgcagctagagcacgtaacccaatgtgtatctagttaactcacttgtcggcgggatgggaccaactactttgggtgtccgtgtttcactttttcctttatatttgcttatggtgacaatatatacaatatatatattggcaccatggcgactcggaccgatg

SEQ ID NO: 11263 - DNA, 203 bp, Homo sapiens
  source 1..203: mol_type = other DNA
ggcgcgccagtcctacaagaatatgttagcttacggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgactcggaccgatg

SEQ ID NO: 11264 - DNA, 203 bp, Homo sapiens
  source 1..203: mol_type = other DNA
ggcgcgccagtcctgactagggatgtttattatttttaaaaaattaggaatgttcagcaccgaatgtcaagatttaccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 11265 - DNA, 203 bp, Homo sapiens
  source 1..203: mol_type = other DNA
ggcgcgccagtcctcgtcgtcgatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 11266 - DNA, 203 bp, Homo sapiens
  source 1..203: mol_type = other DNA
ggcgcgccagtcctactatgacatgtttattatttttaaaaaattagggcctggattttgacaatgtcaagatttagacgcatgtttgcattgtttggatacaccagtgacgtccacttctagaagacaaagttatattacttaaacaaccaaagatggagtctcgctcttcgcccaggctggagtgccgactcggaccgatg

SEQ ID NO: 11267 - DNA, 203 bp, Homo sapiens
  source 1..203: mol_type = other DNA
ggcgcgccagtcctccttatctatgtttattatttttaaaaaattagggcctggattttgactggaatttcggaagccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 11268 - DNA, 203 bp, Homo sapiens
  source 1..203: mol_type = other DNA
ggcgcgccagtcctatccgcgtattaccgactagctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11269 - DNA, 203 bp, Homo sapiens
  source 1..203: mol_type = other DNA
ggcgcgccagtcctcttgcgttattatcaagcgtcaataattaaactaattaagctttgtttcacttgccatatgttttgtaatagaacagtttatggccccattaaaaatgtgtaccacatttaccaatcatatatgcacatagaccctttccctaaacgagttattgatttctaaactaaacgacacgactcggaccgatg

SEQ ID NO: 11270 - DNA, 203 bp, Homo sapiens
  source 1..203: mol_type = other DNA
ggcgcgccagtcctcgtcagtaattattacagagaagaaggaaactcacttcctgtcgtcgcagagcacagcctagttctgatgcagaggggactgttttcagatggagacactagtaagaagaagaaaaatgtcaccatgcgatccatcaagaccacccctactaagcgaagaacatatcagtacaacgactcggaccgatg

SEQ ID NO: 11271 - DNA, 203 bp, Homo sapiens
  source 1..203: mol_type = other DNA
ggcgcgccagtcctgtatcgcgattattcttttggtaggtgtcctacatcttctattattaaacatccaatttgtgtttatgattttttgcctattattttacaaggtattttattataacattgcaacacatttgttgtttttctattatttttgttatataacgataaatctcattaaatctaaaccgactcggaccgatg

SEQ ID NO: 11272 - DNA, 203 bp, Homo sapiens
  source 1..203: mol_type = other DNA
ggcgcgccagtccttttgtataattattcttttggtaggtgtcctacatcttctattattaaacatccaatttgtgtttatgattttttgcctattattttacaaggtattttattatgtttagctttactttttgttgtttttctattatttttgttattatgtcggctcggacattaaatctaaaccgactcggaccgatg

SEQ ID NO: 11273 - DNA, 203 bp, Homo sapiens
  source 1..203: mol_type = other DNA
ggcgcgccagtccttcggcgtcattcagcaattgtccaatttaggaaacattctgtttaagagttgacaaggtctcaatgaataatggacaagcaacaattacaagaaatggaggaaggttcgaaatcaggtgtcgtcacttggaccgtgactacaccatgccactaccaaatgctactagtaatgatcgactcggaccgatg

SEQ ID NO: 11274 - DNA, 203 bp, Homo sapiens
  source 1..203: mol_type = other DNA
ggcgcgccagtcctccttcctaattcagcaattgtccaatttaggaaacattctgtttaagagttgacaaggtctcaatgaataatggacaagcaacaattacataggtactccagctgttcgaaatcaggtgtcgtcacttggaccgtgactacaccatgccactaccaaatgctactagtaatgatcgactcggaccgatg

SEQ ID NO: 11275 - DNA, 203 bp, Homo sapiens
  source 1..203: mol_type = other DNA
ggcgcgccagtcctactgtcgcattccagcccccgatgcgccctctctgggcttttgctcgctcagcacaggatctgatcaggagattcatctctggtgctttacaccagagcatggatttaaaaattgcccaaggcctggcaaacaacctaggggactaggttttctctattttaaaagatgtcaatcgactcggaccgatg

SEQ ID NO: 11276 - DNA, 203 bp, Homo sapiens
  source 1..203: mol_type = other DNA
ggcgcgccagtcctcgagcccgattccagccccctccttttgaggagggggcttttgctcgctcagcacaggatctctctcaatttagtctctctggtgctttacaccagagcatggatttaaaaattgcccaaggcctggcaaacaacctaggggactaggttttctctattttaaaagatgtcaatcgactcggaccgatg

SEQ ID NO: 11277 - DNA, 203 bp, Homo sapiens
  source 1..203: mol_type = other DNA
ggcgcgccagtcctgccgtcctattccagccccctccttttgaggagggggcttttgctcgctcagcacaggatctgatcaggagattcacgagcaagcgcccccaccagagcatggatttaaaaattgcccaaggcctggcaaacaacctaggggactaggttttctctattttaaaagatgtcaatcgactcggaccgatg

SEQ ID NO: 11278 - DNA, 203 bp, Homo sapiens
  source 1..203: mol_type = other DNA
ggcgcgccagtccttccacgtgattccagccccctccttttgaggagggggcttttgctcgctcagcacaggatctgatcaggagattcatctctggtgctttacaccagagcatggatttaaaaattgcccaaggcctggcaaacggggcgtcttctatggttttctctattttaaaagatgtcaatcgactcggaccgatg

SEQ ID NO: 11279 - DNA, 203 bp, Homo sapiens
  source 1..203: mol_type = other DNA
ggcgcgccagtcctcgtcttgcattcctagggccgcggcgcttcccggcatgctccgctgcaggcccgcgcccgcgcccggactttgccatcggcggggcagtcgcgggatgcgcccgggagccacagcctgtatgccgaaatgaaaggaggatgtgaccgggactgagtcaggagccctctggaagccgactcggaccgatg

SEQ ID NO: 11280 - DNA, 203 bp, Homo sapiens
  source 1..203: mol_type = other DNA
ggcgcgccagtcctacctatgaattctgctgtttttcccatatgaagcaatccttcaacaccgacttaggttcaattttctcatcatttactgttgtaattcaatcttactaaagttattccgatatttaagcgtcggcccggcggatataatgtaacaatactattaagattatgatataggccagacgactcggaccgatg

SEQ ID NO: 11281 - DNA, 203 bp, Homo sapiens
  source 1..203: mol_type = other DNA
ggcgcgccagtcctcagattagattgagaagaaaatttttggttgcgcaattcaagtgtcctatttaaaatgggacaaatagtgacattcttccaggaagtgcctcatgtaatagaagaggtgatgaacattgttctcattgcactgtctgtactagcagtgctgaaaggtctgtacaattttgcaaccgactcggaccgatg

SEQ ID NO: 11282 - DNA, 203 bp, Homo sapiens
  source 1..203: mol_type = other DNA
ggcgcgccagtcctgagaccggattgcatactttgacgaaacaaattttcgttgcatacccaataaaagattattatattgcatacccgtttttaataaaatacattgcataccctctagggcgcgtcggccttgcatacgttgacgaaacaaattttcgttgcatacccaataaaagattattatatcgactcggaccgatg

SEQ ID NO: 11283 - DNA, 203 bp, Homo sapiens
  source 1..203: mol_type = other DNA
ggcgcgccagtcctgtaccgttattgcatactttgacgaaacaaattttcgttgcatacccatccgtctcagggattattgcatacccgtttttaataaaatacattgcataccctcttttaataaaaaatattgcatacgttgacgaaacaaattttcgttgcatacccaataaaagattattatatcgactcggaccgatg

SEQ ID NO: 11284 - DNA, 203 bp, Homo sapiens
  source 1..203: mol_type = other DNA
ggcgcgccagtccttgggctcgattgctgtccttggctctagcatgatcctagtgagcatcttcattataatcaagtctggtggacggggaacgggagcacctccagagctgagtggtgtcacaaacaatggcttcataccacacagttagttaattaaaaataaaataaaatttgggacaaatcatacgactcggaccgatg

SEQ ID NO: 11285 - DNA, 203 bp, Homo sapiens
  source 1..203: mol_type = other DNA
ggcgcgccagtcctctgccgggattgggacatttgatgtaaccggaccctcgcaccgcagaaggttgtcctgtattgttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 11286 - DNA, 203 bp, Homo sapiens
  source 1..203: mol_type = other DNA
ggcgcgccagtcctctgctcctattgggacatttgatgtaaccggacctggttcagtatccgcagcagatgtgccagttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 11287 - DNA, 203 bp, Homo sapiens
  source 1..203: mol_type = other DNA
ggcgcgccagtccttagctctgattgggacatttgatgtaaccggacctggttcagtatccgggttgtcctgtattacgttaaatgcctggtcttggcacactgaaagggtatttttgggtaatcctttcctactgcctgatagggtggcgtgcccggccacgagagattaagggtagcaatttaaaccgactcggaccgatg

SEQ ID NO: 11288 - DNA, 203 bp, Homo sapiens
  source 1..203: mol_type = other DNA
ggcgcgccagtcctaagccggtattgggacatttgatgtaaccggacctggttcagtatccgggttgtcctgtattgttacggtgtatccgtcttggcacactgaaagggtatttttgggtaatcctttcctactgcctgatagggcccgaaagtaataaacgagagattaagggtagcaatttaaaccgactcggaccgatg

SEQ ID NO: 11289 - DNA, 203 bp, Homo sapiens
  source 1..203: mol_type = other DNA
ggcgcgccagtcctcttggtacattgggacatttgatgtaaccggacctggttcagtatccgggttgtcctgtattgttacggtgtatccgtcttggcacactgaaagggtatttttgggtaatcctttcctactgcctgatagggtggcgtgcccggccacgagagattaaggtagtttcagggtctcgactcggaccgatg

SEQ ID NO: 11290 - DNA, 203 bp, Homo sapiens
  source 1..203: mol_type = other DNA
ggcgcgccagtcctagcgtgttattgggacatttgatgtaaccggacctggttcagtatccgggttgtcctgtattgttacggtgtatccgtcttggcacactgaaagggtatttttgggtaatcctttcctactgcctgatagggtggcgtgcccggcctaatcgctggggcagtagcaatttaaaccgactcggaccgatg

SEQ ID NO: 11291 - DNA, 203 bp, Homo sapiens
  source 1..203: mol_type = other DNA
ggcgcgccagtccttggttcaaattgggacatttgatgtaaccggacctggttcagtatccgggttgtcctgtattgttacggtgtatccgtcttggcacactggcgtcactcacccaggtaatcctttcctactgcctgatagggtggcgtgcccggccacgagagattaagggtagcaatttaaaccgactcggaccgatg

SEQ ID NO: 11292 - DNA, 203 bp, Homo sapiens
  source 1..203: mol_type = other DNA
ggcgcgccagtcctcataacgcattgggacattttggtgctttactggtggttcagtatccgggttgtcctgtattgttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 11293 - DNA, 203 bp, Homo sapiens
  source 1..203: mol_type = other DNA
ggcgcgccagtcctgtcgcagcatttcagattaactcctccctctccgcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggacccgactcggaccgatg

SEQ ID NO: 11294 - DNA, 203 bp, Homo sapiens
  source 1..203: mol_type = other DNA
ggcgcgccagtcctgcacaggaatttcatttggggatagtgtaccgttaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 11295 - DNA, 203 bp, Homo sapiens
  source 1..203: mol_type = other DNA
ggcgcgccagtcctggtacctaatttcatttgggttgcaacagtttggaagcaagtgctgtgtgtcctagtctaagggtttcgtgttccggacgacttgaattgtctacaaacgccttactcgaggttccgtctcgtgtttgtgtggaagcaaagttctgtctttgtggaaaccagtaactgttcctacgactcggaccgatg

SEQ ID NO: 11296 - DNA, 203 bp, Homo sapiens
  source 1..203: mol_type = other DNA
ggcgcgccagtcctgtccgtcgatttcatttgggttgcaacagtttggaagcaagtgctgtgtgtcctagtctaagggtttcgtgttccgtcacgagattccatgtccttgggtttcgactcgaggttccgtctcgtgtttgtgtggaagcaaagttctgtctttgtggaaaccagtaactgttcctacgactcggaccgatg

SEQ ID NO: 11297 - DNA, 203 bp, Homo sapiens
  source 1..203: mol_type = other DNA
ggcgcgccagtcctttactgtcatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgatcggtgtacgtgtagtaactgttcctacgactcggaccgatg

SEQ ID NO: 11298 - DNA, 203 bp, Homo sapiens
  source 1..203: mol_type = other DNA
ggcgcgccagtcctatcggtatatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 11299 - DNA, 203 bp, Homo sapiens
  source 1..203: mol_type = other DNA
ggcgcgccagtcctgcttaacaatttcatttgggttgcaacagtttggtctgcgacaacagctgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 11300 - DNA, 203 bp, Homo sapiens
  source 1..203: mol_type = other DNA
ggcgcgccagtcctctcgtgacatttgatctttaggttataatgttagagtccgctcccggtgcttaatgcatttagtaatttaaggcttagttatttaactttacttatcaagatggccgttggcagccccacgaaatctagattagtccgaatgtcctattttgattaggtggtcagataggtcagcgactcggaccgatg

SEQ ID NO: 11301 - DNA, 203 bp, Homo sapiens
  source 1..203: mol_type = other DNA
ggcgcgccagtcctgatcgccgatttggctagcacctgcctgccacagccggactccgccactccggtaggattccccgcctgtcattccctagcccagctcttgggaaactgcagaggggtccagaggatttgcagttctgaacctgcacactccagtctaggatctccgagcaagagcgtagcctccgactcggaccgatg

SEQ ID NO: 11302 - DNA, 203 bp, Homo sapiens
  source 1..203: mol_type = other DNA
ggcgcgccagtccttgagcgtgatttggtggagcggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 11303 - DNA, 203 bp, Homo sapiens
  source 1..203: mol_type = other DNA
ggcgcgccagtcctccacaccacaaaaattgtctaagcagcagcaggaacgcgggagcgtttcttttccttttgtactgacatgatggcgctagacgtacgccttagagtttgcgagcagactctgctggcaggtgccgttcgcatgatggacaaattcttgcaaaagagaactgtttttgtcccccacgactcggaccgatg

SEQ ID NO: 11304 - DNA, 203 bp, Homo sapiens
  source 1..203: mol_type = other DNA
ggcgcgccagtcctactcgctccaaaaattgtctaagcagcagcaggaacgcgggagcgtttcttttccttttgtactgacatgatggcggcgtctaaggtgtaagttcccgcaatttagactctgctggcaggtgccgttcgcatgatggacaaattcttgcaaaagagaactgtttttgtcccccacgactcggaccgatg

SEQ ID NO: 11305 - DNA, 203 bp, Homo sapiens
  source 1..203: mol_type = other DNA
ggcgcgccagtcctttaaactccaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattctccacttctgccgtggtttttgtcccccacgactcggaccgatg

SEQ ID NO: 11306 - DNA, 203 bp, Homo sapiens
  source 1..203: mol_type = other DNA
ggcgcgccagtcctgggaagctcaaaaattgtctaagcagcagcaggaacgcgggagcgtttcttttccttttgtactgacatgatggcggcgtctaaggtgtatagagtttgcgagcagactctgctggcaggtgccgttcgcattggcatgggcgcaatgcaaaagagaactgtttttgtcccccacgactcggaccgatg

SEQ ID NO: 11307 - DNA, 203 bp, Homo sapiens
  source 1..203: mol_type = other DNA
ggcgcgccagtcctggtatagccaaaaattgtctaagcagcagcaggaacgcgggagcgtttcttttccttttgtactgacatgatggcggcgtctaaggtgtatagagtttgcgagcccgaaggtagctatggtgccgttcgcatgatggacaaattcttgcaaaagagaactgtttttgtcccccacgactcggaccgatg

SEQ ID NO: 11308 - DNA, 203 bp, Homo sapiens
  source 1..203: mol_type = other DNA
ggcgcgccagtcctgatcttatcaaaaattgtctaagcagcagcaggaacgcgggagcgttttcccagtcggccccctgacatgatggcggcgtctaaggtgtatagagtttgcgagcagactctgctggcaggtgccgttcgcatgatggacaaattcttgcaaaagagaactgtttttgtcccccacgactcggaccgatg

SEQ ID NO: 11309 - DNA, 203 bp, Homo sapiens
  source 1..203: mol_type = other DNA
ggcgcgccagtcctaatgtagacaaaccacgacggagtgctcctagaaaggcgcgggccgaggtaccaaaggcggcgtgtggagcgggaggagttacacgacgggggtgaaggtaagtacctacaccaaaaactgtagccagaaaaggcttgttatcctacctttagacaggtagaagattgtgggagcgactcggaccgatg

SEQ ID NO: 11310 - DNA, 203 bp, Homo sapiens
  source 1..203: mol_type = other DNA
ggcgcgccagtccttagtttctcaaaccacgacggagtgctcctagaaaggcgcgggccgaggtaccaaaggcggcgtgtggagcgggagtgaaagaggcctccgggtgaaggtaagtacctacaccaaaaactgtagccagaaaaggcttgttatcctaggcgggagtctagggaagattgtgggagcgactcggaccgatg

SEQ ID NO: 11311 - DNA, 203 bp, Homo sapiens
  source 1..203: mol_type = other DNA
ggcgcgccagtccttatggctgcaaaccacgacggagtgctcctagaaaggcgcgggccgaggtaccaaaggcggcgtgtggagcgggagtgaaagaggcctccgggtgaaggtaagtgagaggttatttggctgtagccagaaaaggcttgttatcctacctttagacaggtagaagattgtgggagcgactcggaccgatg

SEQ ID NO: 11312 - DNA, 203 bp, Homo sapiens
  source 1..203: mol_type = other DNA
ggcgcgccagtcctttctgttgcaaaccacgacggagtgctcctagaattagagattatttagtaccaaaggcggcgtgtggagcgggagtgaaagaggcctccgggtgaaggtaagtacctacaccaaaaactgtagccagaaaaggcttgttatcctacctttagacaggtagaagattgtgggagcgactcggaccgatg

SEQ ID NO: 11313 - DNA, 203 bp, Homo sapiens
  source 1..203: mol_type = other DNA
ggcgcgccagtcctaccgcacacaaaccgcaaaagacatcagtatcccacagcctctccaagtcccccggtctcctcctcttctcgaaggattgctttctagcttccaccacatccgacgacactcaattccccacccccaaaggagacaccgggaatcccagaatcaagactcatccagtgtccatccgactcggaccgatg

SEQ ID NO: 11314 - DNA, 203 bp, Homo sapiens
  source 1..203: mol_type = other DNA
ggcgcgccagtcctgaggagttcaaaccgcaaaagacatcagtatcccacagcctctccaagtcccccggtctcctcctcttctcgaagggaccaaaagatcaatccaccacatccgacgacactcaattccccacccccaaaggagacaccgggaatccacctgggccctgggatccagtgtccatccgactcggaccgatg

SEQ ID NO: 11315 - DNA, 203 bp, Homo sapiens
  source 1..203: mol_type = other DNA
ggcgcgccagtccttgaagagtcaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatccgactcggaccgatg

SEQ ID NO: 11316 - DNA, 203 bp, Homo sapiens
  source 1..203: mol_type = other DNA
ggcgcgccagtcctcttgacagcaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcccttctaacaacgacgactcggaccgatg

SEQ ID NO: 11317 - DNA, 203 bp, Homo sapiens
  source 1..203: mol_type = other DNA
ggcgcgccagtccttacgccctcaaaccgcaaaagacatcagtatcccacagcctctccaagtcccccggtctcctcctcttctcgaagggaccaaaagatcaatccaccacatccgatagaggcatcaagtccacccccaaaggagacaccgggaatcccagaatcaagactcatccagtgtccatccgactcggaccgatg

SEQ ID NO: 11318 - DNA, 203 bp, Homo sapiens
  source 1..203: mol_type = other DNA
ggcgcgccagtcctgacctgaacaaaccgcaaaagacatcagtatccctagtaagaaagtgctcccccggtctcctcctcttctcgaagggaccaaaagatcaatccaccacatccgacgacactcaattccccacccccaaaggagacaccgggaatcccagaatcaagactcatccagtgtccatccgactcggaccgatg

SEQ ID NO: 11319 - DNA, 203 bp, Homo sapiens
  source 1..203: mol_type = other DNA
ggcgcgccagtcctcccggaaccaaagacagaacgatgaagagtatgacaagattcgtggaagatagtctccactttttaatgcactaagcaatcggttgctaggagcccatcctgggtcagaggccgatccgcagaaccagaacgttttcccctcctggactgttagtaacttagtctccctcctcccgactcggaccgatg

SEQ ID NO: 11320 - DNA, 203 bp, Homo sapiens
  source 1..203: mol_type = other DNA
ggcgcgccagtcctgcgcaacgcaaagacagaacttaacctctgcaagcaagattcgtggaaacatacaagacagatttaatgcactaagcaatcggttgctaggagcccatcctgggtcagaggccgatccgcagaaccagaacgttttcccctcctggactgttagtaacttagtctccctcctcccgactcggaccgatg

SEQ ID NO: 11321 - DNA, 203 bp, Homo sapiens
  source 1..203: mol_type = other DNA
ggcgcgccagtcctcaacgaagcaaagacagaacttaacctctgcaagcaagattcgtggaagatagtctccacttcagctccacaccctcaatcggttgctaggagcccatcctgggtcagaggccgatccgcagaaccagaacgttttcccctcctggactgttagtaacttagtctccctcctcccgactcggaccgatg

SEQ ID NO: 11322 - DNA, 203 bp, Homo sapiens
  source 1..203: mol_type = other DNA
ggcgcgccagtccttaggatcacaaagacagaacttaacctctgcaagcaagattcgtggaagatagtctccactttttaatgcactaagcaatcggttgctaggagcccatcctgggcagctacttaccatgcagaaccagaacgttttcccctcctggactgttagtaacttagtctccctcctcccgactcggaccgatg

SEQ ID NO: 11323 - DNA, 203 bp, Homo sapiens
  source 1..203: mol_type = other DNA
ggcgcgccagtcctcgattccacaaagacagaacttaacctctgcaagcaagattcgtggaagatagtctccactttttaatgcactaaggccagttagcgggagagcccatcctgggtcagaggccgatccgcagaaccagaacgttttcccctcctggactgttagtaacttagtctccctcctcccgactcggaccgatg

SEQ ID NO: 11324 - DNA, 203 bp, Homo sapiens
  source 1..203: mol_type = other DNA
ggcgcgccagtcctaacactaccaaatcgctatcgccacaaggctagtccaccgctgcctatgggcgaagtcaagccctccaacctaatctccataaacagtgtctaagacgaacctcagcgaaagaaggaagatctctagacctactggaaataacataactctggacctattggaacttatataatcgactcggaccgatg

SEQ ID NO: 11325 - DNA, 203 bp, Homo sapiens
  source 1..203: mol_type = other DNA
ggcgcgccagtcctcggtcatccaaatcgctatcgccacaaggctagtgataataactaagggggcgaagtcaagccctccaacctaatcaagcacgctgaaacctaagacgaacctcagcgaaagaaggaagatctctagacctactggaaataacataactctggacctattggaacttatataatcgactcggaccgatg

SEQ ID NO: 11326 - DNA, 203 bp, Homo sapiens
  source 1..203: mol_type = other DNA
ggcgcgccagtcctcgtgcagtcaaatcgctatcgccacaaggctagtgataataactaagggggcgaagtcaagccctccaacctaatctccataaacagtgtctaagacgaacctcagcgaaagaaggaagatctctagacctaggattccgtcatgtactctggacctattggaacttatataatcgactcggaccgatg

SEQ ID NO: 11327 - DNA, 203 bp, Homo sapiens
  source 1..203: mol_type = other DNA
ggcgcgccagtccttcacccgccaacacccgagcaaggacgcgactctcccgacgcggggaggctattctgcccatttggggacacttccgtaagtgatgagatacccgcttctctgaaaggctctccttgcagctgcttagacgctggatttttttcgggtagtggaaaaccagcagcctcccgcgacgactcggaccgatg

SEQ ID NO: 11328 - DNA, 203 bp, Homo sapiens
  source 1..203: mol_type = other DNA
ggcgcgccagtcctcataaatacaacacccgagcaaggacgcgactctggatggcaaactccgctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 11329 - DNA, 203 bp, Homo sapiens
  source 1..203: mol_type = other DNA
ggcgcgccagtcctgagctagtcaacacccgagcgccacaagcgtatccccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 11330 - DNA, 203 bp, Homo sapiens
  source 1..203: mol_type = other DNA
ggcgcgccagtcctacattattcaaccaccttagatgaactttcagtagactcatgacgctcgcgtgatgacaagcgccaagcttgacttggatggccctgatgggcgttcatgggttcggtggtggtggcgctttaggcagcctccacgcccaccacctcccagatagagcggcggcactgtagggacgactcggaccgatg

SEQ ID NO: 11331 - DNA, 203 bp, Homo sapiens
  source 1..203: mol_type = other DNA
ggcgcgccagtcctgaacgagccaaccaccttagtatgtaggcggcgggactcatgacgctcgcgtgatgacaagcgccaagcttgacttggatggccctgatgggcgttcatgggttcggtggtggtggcgctttaggcagcctccacgcccaccacctcccagatagagcggcggcactgtagggacgactcggaccgatg

SEQ ID NO: 11332 - DNA, 203 bp, Homo sapiens
  source 1..203: mol_type = other DNA
ggcgcgccagtcctaatacccgcaaccaccttagtatgtaggcggcgggactcatgacgctcgcgtgatgacaagcgccaagcttgacttggatggccctgatgtctaaggcacatcccggtggtggtggcgctttaggcagcctccacgcccaccacctcccagatagagcggcggcactgtagggacgactcggaccgatg

SEQ ID NO: 11333 - DNA, 203 bp, Homo sapiens
  source 1..203: mol_type = other DNA
ggcgcgccagtccttgacgggccaaccagatcaaagaaaaaacagacagcgtcaatggcagagcaaaaatgtaacacctctacaatggatgccgacaagattgtattcaaagtcaataatcaggtggtctctttgaagcctgagattatcgtggatcaatcgcgtcgatgaatacctgccatcaaagacgactcggaccgatg

SEQ ID NO: 11334 - DNA, 203 bp, Homo sapiens
  source 1..203: mol_type = other DNA
ggcgcgccagtcctatcttagccaaccagcagagagggattgagcttcattgaactcaacagagccaacatttcatagcaccatgttcaactttgaacatccaaggcatggcaatggttagagaccctgctgggcgtgaacaccctctggctacctagggacctgtgggcctaccacctggtgccctccgactcggaccgatg

SEQ ID NO: 11335 - DNA, 203 bp, Homo sapiens
  source 1..203: mol_type = other DNA
ggcgcgccagtccttggactgacaaccagcagagagggattgagcttcattgaactcaacagagccaacatttcatagcaccatgttcaagaggaggttgaagtggcatggcaatggttagagaccctgctgcctcactgggggtcctggctacctagggacctgtgggcctaccacctggtgccctccgactcggaccgatg

SEQ ID NO: 11336 - DNA, 203 bp, Homo sapiens
  source 1..203: mol_type = other DNA
ggcgcgccagtcctgcaaggttcaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctacattacaacagtactcgactcggaccgatg

SEQ ID NO: 11337 - DNA, 203 bp, Homo sapiens
  source 1..203: mol_type = other DNA
ggcgcgccagtccttctaacgacaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctccgactcggaccgatg

SEQ ID NO: 11338 - DNA, 203 bp, Homo sapiens
  source 1..203: mol_type = other DNA
ggcgcgccagtcctgcagattccaaccagcagagagggattgagcttcattgaactcaacagagccaacatttcatagcaccatgttcaagaggaggttgaagtggcatggcaatggttagagaccctgctgggcgtgaacacccttgattggagcgataacctgtgggcctaccacctggtgccctccgactcggaccgatg

SEQ ID NO: 11339 - DNA, 203 bp, Homo sapiens
  source 1..203: mol_type = other DNA
ggcgcgccagtcctggctttcacaaccagcagagagggattgagcttcattgaactcaacagagccaacatttcatgaacgtgctaaagggaggaggttgaagtggcatggcaatggttagagaccctgctgggcgtgaacaccctctggctacctagggacctgtgggcctaccacctggtgccctccgactcggaccgatg

SEQ ID NO: 11340 - DNA, 203 bp, Homo sapiens
  source 1..203: mol_type = other DNA
ggcgcgccagtcctgctctatacaaccagcagagagggattgagcttcccccctgaatctgcagccaacatttcatagcaccatgttcaagaggaggttgaagtggcatggcaatggttagagaccctgctgggcgtgaacaccctctggctacctagggacctgtgggcctaccacctggtgccctccgactcggaccgatg

SEQ ID NO: 11341 - DNA, 203 bp, Homo sapiens
  source 1..203: mol_type = other DNA
ggcgcgccagtcctggcggtgtcaaccagcagagccaccagtcctgaaattgaactcaacagagccaacatttcatagcaccatgttcaagaggaggttgaagtggcatggcaatggttagagaccctgctgggcgtgaacaccctctggctacctagggacctgtgggcctaccacctggtgccctccgactcggaccgatg

SEQ ID NO: 11342 - DNA, 203 bp, Homo sapiens
  source 1..203: mol_type = other DNA
ggcgcgccagtcctggacccatcaacggccacctcttccaagccaagcgctttaacaggagacgtcgaacttcgttgtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 11343 - DNA, 203 bp, Homo sapiens
  source 1..203: mol_type = other DNA
ggcgcgccagtcctcacgtagccaacggccacctcttccaagccaagcgctttaacaggagagcgtactgcggtcacgtggaacccccagtatggggcctcgcgaggcaaggctacaggtgcatcaactgcaaactgctggtccataagcgctgccacggcctcgtcccgctgacctgcaggaagcatcgactcggaccgatg

SEQ ID NO: 11344 - DNA, 203 bp, Homo sapiens
  source 1..203: mol_type = other DNA
ggcgcgccagtcctgaccactccaacggccacctcttccaagccaagcgctttaacaggagagcgtactgcggtcagtgcagcgagaggaaccctcctagtaataggcaaggctacaggtgcatcaactgcaaactgctggtccataagcgctgccacggcctcgtcccgctgacctgcaggaagcatcgactcggaccgatg

SEQ ID NO: 11345 - DNA, 203 bp, Homo sapiens
  source 1..203: mol_type = other DNA
ggcgcgccagtcctgtcattctcaacggccacctcttccaagccaagcgctttaacaggagagcgtactgcggtcagtgcagcgagaggatatggggcctcgcgaggcaaggctacagcacacggccactggaactgctggtccataagcgctgccacggcctcgtcccgctgacctgcaggaagcatcgactcggaccgatg

SEQ ID NO: 11346 - DNA, 203 bp, Homo sapiens
  source 1..203: mol_type = other DNA
ggcgcgccagtcctctgcaatacaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 11347 - DNA, 203 bp, Homo sapiens
  source 1..203: mol_type = other DNA
ggcgcgccagtcctcggatcgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggtgatacgggagactcctgcaggaagcatcgactcggaccgatg

SEQ ID NO: 11348 - DNA, 203 bp, Homo sapiens
  source 1..203: mol_type = other DNA
ggcgcgccagtccttgcaggaccaacggccacctcttccaagccaagcttaccgggcacgccgcgtactgcggtcagtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 11349 - DNA, 203 bp, Homo sapiens
  source 1..203: mol_type = other DNA
ggcgcgccagtcctcaatgggtcaactgctgctcctatgtacagaatacccgctcctttgggggctacctgtactacccaggctcctaccccagcagcctggtctacagcactgccctctgctctcccagcacctgccagctgcgttcctctctctacagggactgtcagaagacctgctgggagccccgactcggaccgatg

SEQ ID NO: 11350 - DNA, 203 bp, Homo sapiens
  source 1..203: mol_type = other DNA
ggcgcgccagtcctatccttcccaactgctgctctagaaacttcagaggtagctcctttgggggctacctggctgcagcaggctcctaccccagcagcctggtctacagcactgccctctgctctcccagcacctgccagctgcgttcctctctctacagggactgtcagaagacctgctgggagccccgactcggaccgatg

SEQ ID NO: 11351 - DNA, 203 bp, Homo sapiens
  source 1..203: mol_type = other DNA
ggcgcgccagtcctgattcgcccaactgctgctctagaaacttcagaggtagctcctttgggggctacctgtactacccaggctcctaccccagcagcctggtctacagcactgccctctgctctcccagcacctgccagctgcgttcctctctctacagggactgtcagaagacctgctgggagccccgactcggaccgatg

SEQ ID NO: 11352 - DNA, 203 bp, Homo sapiens
  source 1..203: mol_type = other DNA
ggcgcgccagtcctggatgggacaactgctgctctagaaacttctcctcccgctcctttgggggctacctggctgcagcaggctcctaccccagcagcctggtctacagcactgccctctgctctcccagcacctgccagctgcgttcctctctctacagggactgtcagaagacctgctgggagccccgactcggaccgatg

SEQ ID NO: 11353 - DNA, 203 bp, Homo sapiens
  source 1..203: mol_type = other DNA
ggcgcgccagtcctatccactacaactgctgctctagaaacttctcctcccgctcctttgggggctacctgtactacccaggctcctaccccagcagcctggtctacagcactgccctagcggtaatatcgtcctgccagctgcgttcctctctctacagggactgtcagaagacctgctgggagccccgactcggaccgatg

SEQ ID NO: 11354 - DNA, 203 bp, Homo sapiens
  source 1..203: mol_type = other DNA
ggcgcgccagtcctaccaactgcaactgctgctctagaaacttctcctcccgctcctttgggggctacctgtactacccaggctcctaccccagcagcctggtctacagcactgccctctgctctcccagcacctgccagctgcgttcctctctctacagaagaccggtacttccctgctgggagccccgactcggaccgatg

SEQ ID NO: 11355 - DNA, 203 bp, Homo sapiens
  source 1..203: mol_type = other DNA
ggcgcgccagtcctagccagcacaactgctgctctagaaacttctcctcccgctcctttgggggctacctgtactacccaggctcctaccccagcagcctggtctacagcactgccctctgctctcccagcacctgccagctgcgttcctctctctacagggactgtcagaagatactgctatccttacgactcggaccgatg

SEQ ID NO: 11356 - DNA, 203 bp, Homo sapiens
  source 1..203: mol_type = other DNA
ggcgcgccagtcctaggtaactcaactgctgctctagaaacttctcctcccgctcctttgggggctacctgtactacccaggctcctaccccagcagcctggtctacagcactgccctctgctctcccagcagtatatccgcagagtcctctctctacagggactgtcagaagacctgctgggagccccgactcggaccgatg

SEQ ID NO: 11357 - DNA, 203 bp, Homo sapiens
  source 1..203: mol_type = other DNA
ggcgcgccagtcctaatcacttcaactgctgctctagaaacttctcctcccgctcctttgggttgccatcagcgctcccaggctcctaccccagcagcctggtctacagcactgccctctgctctcccagcacctgccagctgcgttcctctctctacagggactgtcagaagacctgctgggagccccgactcggaccgatg

SEQ ID NO: 11358 - DNA, 203 bp, Homo sapiens
  source 1..203: mol_type = other DNA
ggcgcgccagtccttaagggttcaactgctgctgtggaaacttcggaatggattcctgtgagggctacctgtgctactcaggcactggaagtggtggctcctcgtaccccagcaacctggtctacagcactgaacctttgatctcccagcacctgccagctgggttcctctctctgcaagggctttcacgactcggaccgatg

SEQ ID NO: 11359 - DNA, 203 bp, Homo sapiens
  source 1..203: mol_type = other DNA
ggcgcgccagtcctacaagcgccaactgctgctgtggaaacttcggaatggattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 11360 - DNA, 203 bp, Homo sapiens
  source 1..203: mol_type = other DNA
ggcgcgccagtcctttaccacacaactgctgctgtggaaacttctcctcccattcctgtgagactgcagccctggtctcaggctactcccgtggtggctcctcgtaccccagcaacctggtctacagcactgaacctttgatctcccagcacctgccagctgggttcctctctctgcaagggctttcacgactcggaccgatg

SEQ ID NO: 11361 - DNA, 203 bp, Homo sapiens
  source 1..203: mol_type = other DNA
ggcgcgccagtcctttgtcctgcaactgctgctgtggaaacttctcctcccattcctgtgagggctacctgtgctactcaggcactggaagtggtggctcctcgtaccccagcaacctggtctacagcactgaacctttgatctcccagcacctgccagctgggttcctctctctgcaagggctttcacgactcggaccgatg

SEQ ID NO: 11362 - DNA, 203 bp, Homo sapiens
  source 1..203: mol_type = other DNA
ggcgcgccagtccttctctgagcaactgctgctgtggaaacttctcctcccattcctgtgagggctacctgtgctactcaggctactcccgtggtggctcctcgagaatttaggtggcggtctacagcactgaacctttgatctcccagcacctgccagctgggttcctctctctgcaagggctttcacgactcggaccgatg

SEQ ID NO: 11363 - DNA, 203 bp, Homo sapiens
  source 1..203: mol_type = other DNA
ggcgcgccagtcctcttactagcaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctccttgttcttggatccgactcggaccgatg

SEQ ID NO: 11364 - DNA, 203 bp, Homo sapiens
  source 1..203: mol_type = other DNA
ggcgcgccagtcctagttcctccaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 11365 - DNA, 203 bp, Homo sapiens
  source 1..203: mol_type = other DNA
ggcgcgccagtcctcctggacacaactgctgctgtggaaacttctcctcccattcctgtgagggctacctgtgctactcaggctactcccgtggtggctcctcgtaccccagcaacctggtctacagcactgaacctttgatctcctttactggaaagcatgggttcctctctctgcaagggctttcacgactcggaccgatg

SEQ ID NO: 11366 - DNA, 203 bp, Homo sapiens
  source 1..203: mol_type = other DNA
ggcgcgccagtcctaactgattcaactgctgctgtggaaacttctcctcccattcctgtgagggctacctgtgctactcaggctactcccgtggtggctcctcgtaccccagcaaccttacgactgaggactaacctttgatctcccagcacctgccagctgggttcctctctctgcaagggctttcacgactcggaccgatg

SEQ ID NO: 11367 - DNA, 203 bp, Homo sapiens
  source 1..203: mol_type = other DNA
ggcgcgccagtcctttacctaccaactgctgctgtggaaacttctcctcccattcctgtgagggctacctgtgctactcaggctactccctcacctttcgaggataccccagcaacctggtctacagcactgaacctttgatctcccagcacctgccagctgggttcctctctctgcaagggctttcacgactcggaccgatg

SEQ ID NO: 11368 - DNA, 203 bp, Homo sapiens
  source 1..203: mol_type = other DNA
ggcgcgccagtcctcaggtacacaagagacggcccaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttcgactcggaccgatg

SEQ ID NO: 11369 - DNA, 203 bp, Homo sapiens
  source 1..203: mol_type = other DNA
ggcgcgccagtcctctatacaacaagcggcttctaacaggttggaataccgtcgcagatgacaacaccgtccacttcaattccaccctcatggctctgatccgcacagccctggacatcaagattgccaagggaggagccgacaaacagcagatggacgctgagctgcggaaggagatgatggcgattcgactcggaccgatg

SEQ ID NO: 11370 - DNA, 203 bp, Homo sapiens
  source 1..203: mol_type = other DNA
ggcgcgccagtcctcccatttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgattcgactcggaccgatg

SEQ ID NO: 11371 - DNA, 203 bp, Homo sapiens
  source 1..203: mol_type = other DNA
ggcgcgccagtcctataatatccaagcggcttctgcggatggacctgcccgtcgcagatgacaacaccgtccacttcaattccaccctcatggctctgatccgcacagccctggacatgcctgcgaatccatgaggagccgacaaacagcagatggacgctgagctgcggaaggagatgatggcgattcgactcggaccgatg

SEQ ID NO: 11372 - DNA, 203 bp, Homo sapiens
  source 1..203: mol_type = other DNA
ggcgcgccagtcctgggccggccaagcggcttctgcggatggacctgcccgtcgcagatgacaacaccgtccacttcaattccaccctcatggctctgatccgccgttaatactgatacaagattgccaagggaggagccgacaaacagcagatggacgctgagctgcggaaggagatgatggcgattcgactcggaccgatg

SEQ ID NO: 11373 - DNA, 203 bp, Homo sapiens
  source 1..203: mol_type = other DNA
ggcgcgccagtccttttacgaccaagtacgtaatgacgacagacgttcaactggatgattccctactgcgagaatgaagactattctcagcaatcagactgtcgacattccagaaaatgtcgacattactctgaagggacgcacagttatcgtgaagggccccagaggaaccctgcggagggacttcacgactcggaccgatg

SEQ ID NO: 11374 - DNA, 203 bp, Homo sapiens
  source 1..203: mol_type = other DNA
ggcgcgccagtcctccgccatgcaagttcagatcaggcaaggaacaaaaaaatctgagtgccacaagaccaaagaagagtacacttaagttgaagacacaacacttgatctgaaacaagaagtttgtgcctactcaacagctttgaaagagcacttcccaacgctgctagtagtctttgttttcttcacgactcggaccgatg

SEQ ID NO: 11375 - DNA, 203 bp, Homo sapiens
  source 1..203: mol_type = other DNA
ggcgcgccagtcctcccaggcccaagttcagatcaggcaaggaacaaacctcgtaacaactaacaagaccaaagaagagtacacttaagttgaagacacaacacagatgtgtggtgtggaagtttgtgcctactcaacagctttgaaagagcacttcccaacgctgctagtagtctttgttttcttcacgactcggaccgatg

SEQ ID NO: 11376 - DNA, 203 bp, Homo sapiens
  source 1..203: mol_type = other DNA
ggcgcgccagtcctggtgatatcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccagacagagacaagtgctttgttttcttcacgactcggaccgatg

SEQ ID NO: 11377 - DNA, 203 bp, Homo sapiens
  source 1..203: mol_type = other DNA
ggcgcgccagtcctgcacgatgcaagttcctggtgcaaaggtggctctgcagcataatttaggcattggaggagctgtggttgtaacactctacaagatgggttttccggaagccgccagttcttttagaaccaggagtgcgattactgttccaaccagctctgcaagtgatggatttaaggcaaatccgactcggaccgatg

SEQ ID NO: 11378 - DNA, 203 bp, Homo sapiens
  source 1..203: mol_type = other DNA
ggcgcgccagtcctatcccgtgcaagttcctggtgcaaaggtggctctgcagcataatttaggcattggaggagctgtggttgtaacactctacaagatgggttttccggaagccgccagttcttttagaactcatcaaattgaagctgttccaaccagccacttggtcatcatatttaaggcaaatccgactcggaccgatg

SEQ ID NO: 11379 - DNA, 203 bp, Homo sapiens
  source 1..203: mol_type = other DNA
ggcgcgccagtcctcatatcttcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggccacttctaggggtcgactcggaccgatg

SEQ ID NO: 11380 - DNA, 203 bp, Homo sapiens
  source 1..203: mol_type = other DNA
ggcgcgccagtcctatgttccacaagttcctggtgcaaaggtggctctgcagcataatttaggcattggaggagctgtggttgtaacactctacaagatgggttttccggaagccgccttcgtgcacctttttcatcaaattgaagctgttccaaccagctctgcaagtgatggatttaaggcaaatccgactcggaccgatg

SEQ ID NO: 11381 - DNA, 203 bp, Homo sapiens
  source 1..203: mol_type = other DNA
ggcgcgccagtcctaccacatccaagttcctggtgcaaaggtggctctgcagcataatttaggcattggaggagcttgaccccattgcagctacaagatgggttttccggaagccgccagttcttttagaactcatcaaattgaagctgttccaaccagctctgcaagtgatggatttaaggcaaatccgactcggaccgatg

SEQ ID NO: 11382 - DNA, 203 bp, Homo sapiens
  source 1..203: mol_type = other DNA
ggcgcgccagtcctaatgctatcaagttcctggtgcaaaggtggctcttttcgtcctaaactgcattggaggagctgtggttgtaacactctacaagatgggttttccggaagccgccagttcttttagaactcatcaaattgaagctgttccaaccagctctgcaagtgatggatttaaggcaaatccgactcggaccgatg

SEQ ID NO: 11383 - DNA, 203 bp, Homo sapiens
  source 1..203: mol_type = other DNA
ggcgcgccagtcctcgtttgttcaagttcctggttacggccctagctcgcagcataatttaggcattggaggagctgtggttgtaacactctacaagatgggttttccggaagccgccagttcttttagaactcatcaaattgaagctgttccaaccagctctgcaagtgatggatttaaggcaaatccgactcggaccgatg

SEQ ID NO: 11384 - DNA, 203 bp, Homo sapiens
  source 1..203: mol_type = other DNA
ggcgcgccagtcctctcttctacaataagtctgcttccaccttccagcttactggcttcccactgcctagttcataacatcactggatattcatcccattattggcagcctacatctccatacttcttggcaatggcactcttctctttctcatcaggaatgatcataacctccatgagcccatgtaccgactcggaccgatg

SEQ ID NO: 11385 - DNA, 203 bp, Homo sapiens
  source 1..203: mol_type = other DNA
ggcgcgccagtcctagacaatacaataagtctgcttccaccttccagcttactggcttcccaggcatggagaaggcacatcactggatatcgcgtgacaagcgagcagcctacatctccatacttcttggcaatggcactcttctctttctcatcaggaatgatcataacctccatgagcccatgtaccgactcggaccgatg

SEQ ID NO: 11386 - DNA, 203 bp, Homo sapiens
  source 1..203: mol_type = other DNA
ggcgcgccagtcctccacttggcaataagtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 11387 - DNA, 203 bp, Homo sapiens
  source 1..203: mol_type = other DNA
ggcgcgccagtcctgagcattgcaataagtctgcttccaccttccagcttactggcttcccaggcatggagaaggcacatcactggatattcatcccattattggcagcctacatctccatacttcttggcataactgaaacctcgtttctcatcaggaatgatcataacctccatgagcccatgtaccgactcggaccgatg

SEQ ID NO: 11388 - DNA, 203 bp, Homo sapiens
  source 1..203: mol_type = other DNA
ggcgcgccagtcctacgtcgctcaatcaagaaaccaaaagacaactcacaatctccctaaaacagcaacgacaccatgtcagctttgctcaaatctctctgggagaaacttttgcccaatggtctcttgatacacaaccatctcaagaaaagaaactgggcaaaacagcatccaagagacaaatagcacgactcggaccgatg

SEQ ID NO: 11389 - DNA, 203 bp, Homo sapiens
  source 1..203: mol_type = other DNA
ggcgcgccagtcctcctagtgacaatcaagaaaccaaaagacaactcacaatctccctaaaacagcaacgacaccatgtcagctttgctcctggaatgtgccacgaaacttttgcccacatactaacaacatcacaaccatctcaagaaaagaaactgggcaaaacagcatccaagagacaaatagcacgactcggaccgatg

SEQ ID NO: 11390 - DNA, 203 bp, Homo sapiens
  source 1..203: mol_type = other DNA
ggcgcgccagtcctgctgaagtcaatcgggtgtcaattttggatctccccccccccacccccctttggatcttgtcgggctttccacgttagcaccggtgtttcttcttgtaacgtccaaggcaagctccccacgacccgaacacgcccagaggaaccttggggcctctggggacttggctagcaggtcgactcggaccgatg

SEQ ID NO: 11391 - DNA, 203 bp, Homo sapiens
  source 1..203: mol_type = other DNA
ggcgcgccagtccttaaacgcgcaatcgggtgtcaattttggatctccccccccccacccccctttggatcttgtcgggctttccacgtttcacttaaaaaaaattcttgtaacgtccaaggcaagctccccacgacccgaacacgagttccccgtagcgggggcctctggggacttggctagcaggtcgactcggaccgatg

SEQ ID NO: 11392 - DNA, 203 bp, Homo sapiens
  source 1..203: mol_type = other DNA
ggcgcgccagtcctgccaagatcaatcgggtgtcaattttggatctccccccccccacccccctttggatcttgtcgggctttccacgtttcacttaaaaaaaattcttgtaacgtcctttcgcttggtttgacgacccgaacacgcccagaggaaccttggggcctctggggacttggctagcaggtcgactcggaccgatg

SEQ ID NO: 11393 - DNA, 203 bp, Homo sapiens
  source 1..203: mol_type = other DNA
ggcgcgccagtcctacccaagtcaatcgggtgtctccgaactcatatgccccccccacccccctttggatcttgtcgggctttccacgtttcacttaaaaaaaattcttgtaacgtccaaggcaagctccccacgacccgaacacgcccagaggaaccttggggcctctggggacttggctagcaggtcgactcggaccgatg

SEQ ID NO: 11394 - DNA, 203 bp, Homo sapiens
  source 1..203: mol_type = other DNA
ggcgcgccagtccttatgtactcaatgagcgcgcctgctaaaaactcgcggctggtgcgcgagacgccgccgagaggggcactatggcagacaaagttaggaggcagaggccgaggaggcgagtctgttgggccttggtggctgtgctcttggcagacctgttggcactgagtgatacactggcagtgcgactcggaccgatg

SEQ ID NO: 11395 - DNA, 203 bp, Homo sapiens
  source 1..203: mol_type = other DNA
ggcgcgccagtcctacgggaaacaatgagcgcgcgccgcgtccggggccggctggtgcgcgagacgccgccgagaggggcactatggcagacaaagttaggaggggttatttagaccagcgagtctgttgggccttggtggctgtgctcttggcagacctgttggcactgagtgatacactggcagtgcgactcggaccgatg

SEQ ID NO: 11396 - DNA, 203 bp, Homo sapiens
  source 1..203: mol_type = other DNA
ggcgcgccagtcctagtagttccaatgcaggcattagtttctcagttaaaaaacaaggagagacagtagctgatgttaggacactacccaatgcctcaaccgtgcggctctgcgtaagcatctttggaaatgctgttagtcgagaactgatagaaattggatgtgaggataaaaccctagccttcaaacgactcggaccgatg

SEQ ID NO: 11397 - DNA, 203 bp, Homo sapiens
  source 1..203: mol_type = other DNA
ggcgcgccagtcctgttacaatcaatgcaggcattagtttctcagttaaaaaacaaggagagacagtagctgatgttaggacactacccaatgcctcaaccgtggacaatattcgctccatctttggaaatgaaagggcagagcgtctgatagaaattggatgtgaggataaaaccctagccttcaaacgactcggaccgatg

SEQ ID NO: 11398 - DNA, 203 bp, Homo sapiens
  source 1..203: mol_type = other DNA
ggcgcgccagtcctgggcatcacaatgcaggcattagtttctcagttaaaaaacaaggagagacagtagctgatgttaggacactacccaatgcctcaaccgtggacaatattcgctctggaagcaattcatctgttagtcgagaactgatagaaattggatgtgaggataaaaccctagccttcaaacgactcggaccgatg

SEQ ID NO: 11399 - DNA, 203 bp, Homo sapiens
  source 1..203: mol_type = other DNA
ggcgcgccagtccttaccgcagcaatgcaggcattagtttctcagttaaaaaacaaggagagacagtagctgatgttaggacactacccatccttcgctattaagacaatattcgctccatctttggaaatgctgttagtcgagaactgatagaaattggatgtgaggataaaaccctagccttcaaacgactcggaccgatg

SEQ ID NO: 11400 - DNA, 203 bp, Homo sapiens
  source 1..203: mol_type = other DNA
ggcgcgccagtcctgcgacagccaatgcaggcattagtttctcagttaaaaaacaaggagagcattagaaaatgtctaggacactacccaatgcctcaaccgtggacaatattcgctccatctttggaaatgctgttagtcgagaactgatagaaattggatgtgaggataaaaccctagccttcaaacgactcggaccgatg

SEQ ID NO: 11401 - DNA, 203 bp, Homo sapiens
  source 1..203: mol_type = other DNA
ggcgcgccagtcctttgacgcacacactaatattatccagattagagagcttaattagctctgtattaataataacactactattccaataactggaatcaccaagagttcgacatggcaaaatgattcaaagaaaacaaatcatattaagactatcctaagcacgaacccatatcgtccttcaaatccgactcggaccgatg

SEQ ID NO: 11402 - DNA, 203 bp, Homo sapiens
  source 1..203: mol_type = other DNA
ggcgcgccagtccttgcaccggcacactaatattatccagattagagagcttaattagctctgtattaataataacactactattccaataactggaatcaccagcttgatttatctccaaaatgattcaaagaaaacaaatcataagggtggaggagagagcacgaacccatatcgtccttcaaatccgactcggaccgatg

SEQ ID NO: 11403 - DNA, 203 bp, Homo sapiens
  source 1..203: mol_type = other DNA
ggcgcgccagtcctggttagtccacactaatattatccagattagagagcttaattagctctgtattaataataacactactattccaataactggaatcaccagcttgatttatctccaaaatgattcaaatcgcctgggctcgcttaagactatcctaagcacgaacccatatcgtccttcaaatccgactcggaccgatg

SEQ ID NO: 11404 - DNA, 203 bp, Homo sapiens
  source 1..203: mol_type = other DNA
ggcgcgccagtcctgatgccagcacagatcagctcaaccagacaccaccagcatacacgaaaccaaccttcacagtggatacctcagcatccaaaactctccttcccgaatggatcaggatgccttcttttttgagagggatcctgaagccgaaggagaggcaccacgaaaacaagaatcactctcagcgactcggaccgatg

SEQ ID NO: 11405 - DNA, 203 bp, Homo sapiens
  source 1..203: mol_type = other DNA
ggcgcgccagtcctggattatccacagatcagctcaaccagacaccaccagcatacacgaaaccaaccttcacagtggatacctcagcatccaaaactctccttcccgaatggatcaggatgccttcttttttgagagggatcctgaagccgaaggagagtataggacccggagagaatcactctcagcgactcggaccgatg

SEQ ID NO: 11406 - DNA, 203 bp, Homo sapiens
  source 1..203: mol_type = other DNA
ggcgcgccagtcctgataatcacacatctctctggccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcaccgactcggaccgatg

SEQ ID NO: 11407 - DNA, 203 bp, Homo sapiens
  source 1..203: mol_type = other DNA
ggcgcgccagtcctcggttaatcacccgccatagcaatggagaccccgaaaggacaatgcaataattaatccttcttttttgcttcacaataaaaatagcatggctcttctgattgtaaaaagtgatatacactccttatttaacgaaaaattcaaagaatttgataaatgacaggcgaaaagtcaaacgactcggaccgatg

SEQ ID NO: 11408 - DNA, 203 bp, Homo sapiens
  source 1..203: mol_type = other DNA
ggcgcgccagtcctggaagtctcacccgccatagcaatggagaccccgcctcctgctacagttaattaatccttcttttttgcttcacaataaaaatagcatggctcttctgattgtaaaaagtgatatacactccttatttaacgaaaaattcaaagaaggctggtgtctcatggcgaaaagtcaaacgactcggaccgatg

SEQ ID NO: 11409 - DNA, 203 bp, Homo sapiens
  source 1..203: mol_type = other DNA
ggcgcgccagtcctggtccgtgcacccgccatagttgcctcccggtaccctcctgctacagttaattaatccttcttttttgcttcacaataaaaatagcatggctcttctgattgtaaaaagtgatatacactccttatttaacgaaaaattcaaagaatttgataaatgacaggcgaaaagtcaaacgactcggaccgatg

SEQ ID NO: 11410 - DNA, 203 bp, Homo sapiens
  source 1..203: mol_type = other DNA
ggcgcgccagtcctcggagacccaccgaggatgctctgaatgatatcaagcgagacatcataagaagcgccatatgaactcaccaggaacaccagactcacgggcccgatgcgtgggagaaagccacaatgattccctgtttaataaaaaataagcacgaacacaagtccaatccaaccatagcagcacgactcggaccgatg

SEQ ID NO: 11411 - DNA, 203 bp, Homo sapiens
  source 1..203: mol_type = other DNA
ggcgcgccagtcctggacaacccaccgggccggttggggccccgctcgccggcgggagccaccggagccccggccaacccatttgtaacacccccgccggccccgccctcccggctgcggcctggccaatcagagcggctcttactggcgggtgggctgagccggcccagctgctcggaggctctggccgactcggaccgatg

SEQ ID NO: 11412 - DNA, 203 bp, Homo sapiens
  source 1..203: mol_type = other DNA
ggcgcgccagtcctaggaacggcaccgggccggttggggccccgctcgttacgtctggccaccggagccccggccacgaaggggtgcgaccccccgccggccccgccctcccggctgcggcctggccaatcagagcggctcttagaactaccagggctgagccggcccagctgctcggaggctctggccgactcggaccgatg

SEQ ID NO: 11413 - DNA, 203 bp, Homo sapiens
  source 1..203: mol_type = other DNA
ggcgcgccagtcctagcaatatcacgccttcatgtaaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtccgactcggaccgatg

SEQ ID NO: 11414 - DNA, 203 bp, Homo sapiens
  source 1..203: mol_type = other DNA
ggcgcgccagtcctatcgggtccacgcgagccgttggtggttgttgtgatgattatactggataccaggagttagtaatcaaaacttcacatgacgactaagttcgtctttgattcattgcactgatctcttgttagatctttttgcaatctagcatttgttaaagttcttaaggccacgccctattacgactcggaccgatg

SEQ ID NO: 11415 - DNA, 203 bp, Homo sapiens
  source 1..203: mol_type = other DNA
ggcgcgccagtcctcacaagaccacgttggttagtccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagcccgactcggaccgatg

SEQ ID NO: 11416 - DNA, 203 bp, Homo sapiens
  source 1..203: mol_type = other DNA
ggcgcgccagtcctcctggcgtcactggtgacagcggcgtacaataaatcaggtaccccgaggtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 11417 - DNA, 203 bp, Homo sapiens
  source 1..203: mol_type = other DNA
ggcgcgccagtcctcattaggacactggtgacaggctaaggatgccctgactacgaggttttgtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 11418 - DNA, 203 bp, Homo sapiens
  source 1..203: mol_type = other DNA
ggcgcgccagtcctgttgtaaccactggtgacaggctaaggatgcccttcaggtaccccgaggtaacacgcgacactcgggatctgagaaggggactggggcttctataaaagcgctcccggattgccctgactatgcctgaataggtgaccggaggtcggcacctttcctttacaattaatgaccctcgactcggaccgatg

SEQ ID NO: 11419 - DNA, 203 bp, Homo sapiens
  source 1..203: mol_type = other DNA
ggcgcgccagtcctgcgcatgccactggtgacaggctaaggatgcccttcaggtaccccgaggtaacacgcgacactcgggatctgagaaggggactggggcttctataaaagcgctcggtttaaaaagcttaagctgagtctactgtgaccggaggtcggcacctttcctttacaattaatgaccctcgactcggaccgatg

SEQ ID NO: 11420 - DNA, 203 bp, Homo sapiens
  source 1..203: mol_type = other DNA
ggcgcgccagtcctcctgggtccactggtgacaggctaaggatgcccttcaggtaccccgaggtaacacgcgacactcgggatctgagaaggggactggggcttctataaaagcgctcggtttaaaaagcttctatgcctgaatagacctatcttctaatgcacctttcctttacaattaatgaccctcgactcggaccgatg

SEQ ID NO: 11421 - DNA, 203 bp, Homo sapiens
  source 1..203: mol_type = other DNA
ggcgcgccagtcctatggtgagcactggtgacaggctaaggatgcccttcaggtaccccgaggtaacacgcgacactcgggatctgagaaggggactggggcttctataaaagcgctcggtttaaaaagcttctatgcctgaatagcgacttattctcacgcacctttcctttacaattaatgaccctcgactcggaccgatg

SEQ ID NO: 11422 - DNA, 203 bp, Homo sapiens
  source 1..203: mol_type = other DNA
ggcgcgccagtcctgggctccccactggtgacaggctaaggatgcccttcaggtaccccgaggtaacacgcgacactcgggatctgagaaggggactggggcttctataaaagcgctcggtttaaaaagcttctatgcctgaataggtgaccggaggtcgcgcttaaagagagtcaattaatgaccctcgactcggaccgatg

SEQ ID NO: 11423 - DNA, 203 bp, Homo sapiens
  source 1..203: mol_type = other DNA
ggcgcgccagtcctctcccaaacactggtgacaggctaaggatgcccttcaggtaccccgaggtaacacgcgacactcgggatctgagaaggggactggggcttctataaaagcgctcggtttaaaaagcttctatgcctgaataggtgaccggaggtcgtacgggcgggggcccaattaatgaccctcgactcggaccgatg

SEQ ID NO: 11424 - DNA, 203 bp, Homo sapiens
  source 1..203: mol_type = other DNA
ggcgcgccagtcctgtgtttagcactggtgacaggctaaggatgcccttcaggtaccccgaggtaacacgcgacactcgggatctgagaaggggactggggcttgacacgccataggaggtttaaaaagcttctatgcctgaataggtgaccggaggtcggcacctttcctttacaattaatgaccctcgactcggaccgatg

SEQ ID NO: 11425 - DNA, 203 bp, Homo sapiens
  source 1..203: mol_type = other DNA
ggcgcgccagtcctctctccaccactggtgacaggctaaggatgcccttcaggtaccccgaggtaacacgcgacactcgggatctgagaaggggactggggcttgccctcgtagtgggggtttaaaaagcttctatgcctgaataggtgaccggaggtcggcacctttcctttacaattaatgaccctcgactcggaccgatg

SEQ ID NO: 11426 - DNA, 203 bp, Homo sapiens
  source 1..203: mol_type = other DNA
ggcgcgccagtcctttgtagtacactggtgacagttacctatcaagtatcaggtaccccgaggtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 11427 - DNA, 203 bp, Homo sapiens
  source 1..203: mol_type = other DNA
ggcgcgccagtcctctcggccacactgtaacgatggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgacgactcggaccgatg

SEQ ID NO: 11428 - DNA, 203 bp, Homo sapiens
  source 1..203: mol_type = other DNA
ggcgcgccagtcctatgagccccacttcctctgtaaagctctcaacccctgggaagcgaatgtctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 11429 - DNA, 203 bp, Homo sapiens
  source 1..203: mol_type = other DNA
ggcgcgccagtcctatgggctgcacttcctctgtaaagctctcaaccctgtccccttccccctctctcctgggaaaagaaaaagaagcttctagctgctgctcttagggaccctgtggctaggtgcgcggatggaaatccaggatctccgcctggttcggcccgcctgcctccactcctgcctctacccgactcggaccgatg

SEQ ID NO: 11430 - DNA, 203 bp, Homo sapiens
  source 1..203: mol_type = other DNA
ggcgcgccagtccttccaccatcacttcctctgtaaagctctcaaccctgtccccttccccctctctcctgggaaagagccctcccatgcctagctgctgctctcgtatgaatgtgttctaggtgcgcggatggaaatccaggatctccgcctggttcggcccgcctgcctccactcctgcctctacccgactcggaccgatg

SEQ ID NO: 11431 - DNA, 203 bp, Homo sapiens
  source 1..203: mol_type = other DNA
ggcgcgccagtccttgcttgtgcacttcctctgtaaagctctcaaccctgtccccttccccctctctcctgggaaagagccctcccatgcctagctgctgctcttagggaccctgtggctaggtgcgcggatggaaatccaggatcataagtatacatctcccgcctgcctccactcctgcctctacccgactcggaccgatg

SEQ ID NO: 11432 - DNA, 203 bp, Homo sapiens
  source 1..203: mol_type = other DNA
ggcgcgccagtcctcgctgacacacttcctctgtaaagctctcaaccctgtccccttccccctctctcctgggaaagagccctcccatgcctagctgctgctcttagggaccctgtggctaggtgcgcggatggaaatccaggatctccgcctggttcggaataagaaagcgttctcctgcctctacccgactcggaccgatg

SEQ ID NO: 11433 - DNA, 203 bp, Homo sapiens
  source 1..203: mol_type = other DNA
ggcgcgccagtcctgttaagcccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccaacgagtgagtagtacgactcggaccgatg

SEQ ID NO: 11434 - DNA, 203 bp, Homo sapiens
  source 1..203: mol_type = other DNA
ggcgcgccagtcctcctaattccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 11435 - DNA, 203 bp, Homo sapiens
  source 1..203: mol_type = other DNA
ggcgcgccagtcctgcccgcttcacttcctctgtaaagctctcaaccctgtccccttccccctctctcctgggaaagagccctcccatgcctagctgctgctcttagggaccctgtggctaggtgcgcggattagttgaattccgttccgcctggttcggcccgcctgcctccactcctgcctctacccgactcggaccgatg

SEQ ID NO: 11436 - DNA, 203 bp, Homo sapiens
  source 1..203: mol_type = other DNA
ggcgcgccagtccttgaccgaacacttcctctgtaaagctctcaaccctgtccccttccccctctctcctgggaaagagccctcccatgcctagctgctgctcttagggaccctgtggtctaacatatcctcggaaatccaggatctccgcctggttcggcccgcctgcctccactcctgcctctacccgactcggaccgatg

SEQ ID NO: 11437 - DNA, 203 bp, Homo sapiens
  source 1..203: mol_type = other DNA
ggcgcgccagtcctggaggcagcacttcctctgtaaagctctcaaccctgtccccttccccctctctcctgggaaagagccctcccatgctactacaggttagctagggaccctgtggctaggtgcgcggatggaaatccaggatctccgcctggttcggcccgcctgcctccactcctgcctctacccgactcggaccgatg

SEQ ID NO: 11438 - DNA, 203 bp, Homo sapiens
  source 1..203: mol_type = other DNA
ggcgcgccagtcctcgcaatcgcacttcctctgtgttagaacgcgtgttgtccccttccccctctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 11439 - DNA, 203 bp, Homo sapiens
  source 1..203: mol_type = other DNA
ggcgcgccagtcctccgtggtgcagacatgaggttcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 11440 - DNA, 203 bp, Homo sapiens
  source 1..203: mol_type = other DNA
ggcgcgccagtcctcggcctcccagagagcgcaaggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggatacgactcggaccgatg

SEQ ID NO: 11441 - DNA, 203 bp, Homo sapiens
  source 1..203: mol_type = other DNA
ggcgcgccagtcctccgggccccagagatacagctgccactcacacactcatccagacaaatcaaactagactcacatcattcggaaacaattctctcataatttaaagaaaaaatcataggccggacgggttagaaatccggtgcttgttcgtgatcagataacctccacaccagaatcatacaatccgactcggaccgatg

SEQ ID NO: 11442 - DNA, 203 bp, Homo sapiens
  source 1..203: mol_type = other DNA
ggcgcgccagtcctgacggcggcagagatacagctgccactcacacactcatccagacaaatttcgggctcggatgatcattcggaaacaattctctcataatttaaagaaaaaatcataggccggacgggttagaaatccggtgcttgttcgtgatcagataacctccacaccagaatcatacaatccgactcggaccgatg

SEQ ID NO: 11443 - DNA, 203 bp, Homo sapiens
  source 1..203: mol_type = other DNA
ggcgcgccagtcctcaggaaatcagagccctgcacccctaattcccggctcgtttgcaaatgtgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 11444 - DNA, 203 bp, Homo sapiens
  source 1..203: mol_type = other DNA
ggcgcgccagtcctgacgtgcccagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 11445 - DNA, 203 bp, Homo sapiens
  source 1..203: mol_type = other DNA
ggcgcgccagtcctatgtagaccagagccctgcagatgagtagtgttctggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 11446 - DNA, 203 bp, Homo sapiens
  source 1..203: mol_type = other DNA
ggcgcgccagtcctgtctgagtcagaggatttatttagtcactggcaaacggaaagatggcgccggtttactggcaaacacaaattgaggtgggtccgggagcaaccaatgccactataaactttgaagcaggaattctggagtgctatgaaaggttttcatggcaaagagcccttgactatcctggtcgactcggaccgatg

SEQ ID NO: 11447 - DNA, 203 bp, Homo sapiens
  source 1..203: mol_type = other DNA
ggcgcgccagtccttgtcccagcagaggatttatttagtcactggcaaacggaaagatggcggacaacatgaccacaacacaaattgagggccccttctagtacaccaatgccactataaactttgaagcaggaattctggagtgctatgaaaggttttcatggcaaagagcccttgactatcctggtcgactcggaccgatg

SEQ ID NO: 11448 - DNA, 203 bp, Homo sapiens
  source 1..203: mol_type = other DNA
ggcgcgccagtcctatctaacacagaggatttatttagtcactggcaaacggaaagatggcggacaacatgaccacaacacaaattgaggtgggtccgggagcaaccaatgccactataaactttgaagcaggaattctggagtgctatgaaaggttttcatggcaaagagcccttgactatcctggtcgactcggaccgatg

SEQ ID NO: 11449 - DNA, 203 bp, Homo sapiens
  source 1..203: mol_type = other DNA
ggcgcgccagtcctgcccttagcagaggatttatttagtcactggcaaacggaaagatggcggacaacatgaccacaacacaaattgaggtgggtccgggagcaaccaatgccactataaactttgaagcagttggcagcagagtgtatgaaaggttttcatggcaaagagcccttgactatcctggtcgactcggaccgatg

SEQ ID NO: 11450 - DNA, 203 bp, Homo sapiens
  source 1..203: mol_type = other DNA
ggcgcgccagtcctattggacccagagtattgatgaggaaactgaagtttggagcgatcacatcattttcccaaggtaacacaagtggcaagacagccgggaacccctaccccatccccttattcagcacatgaaataaacaaggggcatccaaatcttgcggcaacgcccccgggacatgcatcgtccgactcggaccgatg

SEQ ID NO: 11451 - DNA, 203 bp, Homo sapiens
  source 1..203: mol_type = other DNA
ggcgcgccagtcctaacattggcagagtattgatgaggaaactgaagtttggagcgatcacatcattttcccaaggtaacacaagtggcaagacagccgggaacccctaccccatccccttattcagcacatttttcccgtgtaatgcatccaaatcttgcggcaacgcccccgggacatgcatcgtccgactcggaccgatg

SEQ ID NO: 11452 - DNA, 203 bp, Homo sapiens
  source 1..203: mol_type = other DNA
ggcgcgccagtcctggtttcggcagagtattgatgaggaaactgaagtttggagcgatcacatcattttcccaaggtaacacaagtggcaagacagccgggaactttaggtatcgagacttattcagcacatgaaataaacaaggggcatccaaatcttgcggcaacgcccccgggacatgcatcgtccgactcggaccgatg

SEQ ID NO: 11453 - DNA, 203 bp, Homo sapiens
  source 1..203: mol_type = other DNA
ggcgcgccagtcctcagcgctacagagtctgagccgttcagaggctcatttgataaatagaagatttatttgggcttggtggtaagtgtgattttatgttttctttgattttcttgtagacttgttcctgacgctgctacaggagccctcactctgattccttcatttatttttccaggtaagcaaaccgactcggaccgatg

SEQ ID NO: 11454 - DNA, 203 bp, Homo sapiens
  source 1..203: mol_type = other DNA
ggcgcgccagtcctctggataacagataagagccccaggccctgcagtcaactctgggaggcaacccagacacacgtcaggctgaacccaccccacatttctccctcgggaatctgattaaggcagtgattcttcattgcctgccctcctgtccacactcctgcctactgccacccacaagggtcatccgactcggaccgatg

SEQ ID NO: 11455 - DNA, 203 bp, Homo sapiens
  source 1..203: mol_type = other DNA
ggcgcgccagtcctcgttgctgcagataagagccccaggccctgcagtcaactctgggaggccgtgggctggacttgacccaaatggtttccccacatttctccctcgggaatctgattaaggcagtgattcttcattgcctgccctcctgtccacactcctgcctactgccacccacaagggtcatccgactcggaccgatg

SEQ ID NO: 11456 - DNA, 203 bp, Homo sapiens
  source 1..203: mol_type = other DNA
ggcgcgccagtccttctcagtccagataagagccccaggccctgcagtcaactctgggaggccgtgggctggactttcaggctgaacccaccccacatcatcgtttcgggaatctgattaaggcagtgattcttcattgcctgccctcctgtccacactcctgcccgtatggacccacaagggtcatccgactcggaccgatg

SEQ ID NO: 11457 - DNA, 203 bp, Homo sapiens
  source 1..203: mol_type = other DNA
ggcgcgccagtccttgatggcgcagataagagccccaggccctgcagtcaactctgggaggccgtgggctggactttcaggctgaacccaccccacatttctccctcgggaatctgattaaggcagtgattcttcattgcctgcccgaaacagtcgtggtctgcctactgccacccacaagggtcatccgactcggaccgatg

SEQ ID NO: 11458 - DNA, 203 bp, Homo sapiens
  source 1..203: mol_type = other DNA
ggcgcgccagtcctgagcggcacagataagagccccaggccctgcagtcaactctgggaggccgtgggctggactttcaggctgaacccaccccacatttctccctcgggaatctgattaaggcagtgattcttcattgcctgccctcctgtccacactcctgcccgtatggacccacaagggtcatccgactcggaccgatg

SEQ ID NO: 11459 - DNA, 203 bp, Homo sapiens
  source 1..203: mol_type = other DNA
ggcgcgccagtccttgcgagtacagataagagccccaggccctgcagtcaactctgggaggccgtgggctggactttcaggctgaacccaggtactcaagtgtgctcgggaatctgattaaggcagtgattcttcattgcctgccctcctgtccacactcctgcctactgccacccacaagggtcatccgactcggaccgatg

SEQ ID NO: 11460 - DNA, 203 bp, Homo sapiens
  source 1..203: mol_type = other DNA
ggcgcgccagtcctggagccgccagataagagccgtgccatgcaacagcaactctgggaggccgtgggctggactttcaggctgaacccaccccacatttctccctcgggaatctgattaaggcagtgattcttcattgcctgccctcctgtccacactcctgcctactgccacccacaagggtcatccgactcggaccgatg

SEQ ID NO: 11461 - DNA, 203 bp, Homo sapiens
  source 1..203: mol_type = other DNA
ggcgcgccagtccttttgatgacagatcgtgctacggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 11462 - DNA, 203 bp, Homo sapiens
  source 1..203: mol_type = other DNA
ggcgcgccagtcctcggtcgagcagattattcctatgcatcctgccttcctcacccaggactggtctgagagggattcatgatggaagcactcatcgaggcgttcctggttctcgcctaaatgtggtcaacagtgtcagcagttcagaggacatcaagcccttaccagggcttcccgggattggaaaccgactcggaccgatg

SEQ ID NO: 11463 - DNA, 203 bp, Homo sapiens
  source 1..203: mol_type = other DNA
ggcgcgccagtcctattccttccagattattcctatgcatcctgccttcctcacccaggactggtctgagagggattcatgatggaagcatgttcattctgtgacctggttctcgcctaaatgtggtcaacagtgtcagcagttcagaggacatcaagccagcggtccaatagaccgggattggaaaccgactcggaccgatg

SEQ ID NO: 11464 - DNA, 203 bp, Homo sapiens
  source 1..203: mol_type = other DNA
ggcgcgccagtcctgttctaggcagattattccttccgtatgcctgaccctcacccaggactggtctgagagggattcatgatggaagcatgttcattctgtgacctggttctcgcctaaatgtggtcaacagtgtcagcagttcagaggacatcaagcccttaccagggcttcccgggattggaaaccgactcggaccgatg

SEQ ID NO: 11465 - DNA, 203 bp, Homo sapiens
  source 1..203: mol_type = other DNA
ggcgcgccagtcctacatctgccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtgggcacatagaagtcgactcggaccgatg

SEQ ID NO: 11466 - DNA, 203 bp, Homo sapiens
  source 1..203: mol_type = other DNA
ggcgcgccagtcctaagaatgccagcagcctgcagccgccgccgggttgtgcctcagactgtcagataaatcggcgggccgggccggcggtatttcactgcttacccgggccggacatggcggcgctctacgcctgcaccaagtgccaccagcgcttccccttcgaggcgctgtctcaggggcagcagcgactcggaccgatg

SEQ ID NO: 11467 - DNA, 203 bp, Homo sapiens
  source 1..203: mol_type = other DNA
ggcgcgccagtcctcgcagaatcagcagcctgcagccgccgccgggttgtgcctcagactgtcagataaatcggcgttggttaagtcaacgtcggtgagcgcggcccgggccggacatggcggcgctctacgcctgcaccaagtgccaccagcgcttccccttcgaggcgctgtctcaggggcagcagcgactcggaccgatg

SEQ ID NO: 11468 - DNA, 203 bp, Homo sapiens
  source 1..203: mol_type = other DNA
ggcgcgccagtcctaaatcgaccagcatccaccgcgcggcccaggactcgagcatgccctaccgttgcgtgaggcgggtaaatgttcgcggaagcggcaaagacgacacggccttgtgggatggcggagtttaaggagaagcctgaggccccgactgagcagctggatgtcgcgtgcggccaggaaaacgactcggaccgatg

SEQ ID NO: 11469 - DNA, 203 bp, Homo sapiens
  source 1..203: mol_type = other DNA
ggcgcgccagtccttaacgccccagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgccatctagaatttgcgactcggaccgatg

SEQ ID NO: 11470 - DNA, 203 bp, Homo sapiens
  source 1..203: mol_type = other DNA
ggcgcgccagtcctcgtacgatcagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagccaaacccaaagatatgcggccaggaaaacgactcggaccgatg

SEQ ID NO: 11471 - DNA, 203 bp, Homo sapiens
  source 1..203: mol_type = other DNA
ggcgcgccagtcctgcgggtggcagcatccaccgcgcggcccaggactgtcagggtagtgggcgttgcgtgaggcgggtaaatgttcgcggaagcggcaaagacgacacggccttgtgggatggcggagtttaaggagaagcctgataattgcgtccgatagctggatgtcgcgtgcggccaggaaaacgactcggaccgatg

SEQ ID NO: 11472 - DNA, 203 bp, Homo sapiens
  source 1..203: mol_type = other DNA
ggcgcgccagtcctccatcacacagcatccaccgcgcggcccaggactgtcagggtagtgggcgttgcgtgaggcgtagcgcccacactcgaagcggcaaagacgacacggccttgtgggatggcggagtttaaggagaagcctgaggccccgactgagcagctggatgtcgcgtgcggccaggaaaacgactcggaccgatg

SEQ ID NO: 11473 - DNA, 203 bp, Homo sapiens
  source 1..203: mol_type = other DNA
ggcgcgccagtcctcagcgtatcagcatccaccgcgcggcccaggactgtcagggtagtggggagacaaactcaacggtaaatgttcgcggaagcggcaaagacgacacggccttgtgggatggcggagtttaaggagaagcctgaggccccgactgagcagctggatgtcgcgtgcggccaggaaaacgactcggaccgatg

SEQ ID NO: 11474 - DNA, 203 bp, Homo sapiens
  source 1..203: mol_type = other DNA
ggcgcgccagtcctgaactgctcagcatcccagacagacttccagattccttacgtaggggaccaacacgtaggtgtatgggagaccacatcatttcatgacttatgtttgaggaacactaggctgttgtctagacgaggcaagctctggaaagcaacgccgagtctctgagaagagggagcataggccgactcggaccgatg

SEQ ID NO: 11475 - DNA, 203 bp, Homo sapiens
  source 1..203: mol_type = other DNA
ggcgcgccagtcctcaccaaggcagcatcccagacagacttccagatttgaacatctaccccccaacacgtaggtggtgctctacgtgtgtcatttcatgacttatgtttgaggaacactaggctgttgtctagacgaggcaagctctggaaagcaacgccgagtctctgagaagagggagcataggccgactcggaccgatg

SEQ ID NO: 11476 - DNA, 203 bp, Homo sapiens
  source 1..203: mol_type = other DNA
ggcgcgccagtcctacgactagcagcatcccagacagacttccagatttgaacatctaccccccaacacgtaggtgtatgggagaccacatcatttcatgacttatgtttgaggaacactaggctgttgtctagacgaggcaagcttcaccctaacggagcgagtctctgagaagagggagcataggccgactcggaccgatg

SEQ ID NO: 11477 - DNA, 203 bp, Homo sapiens
  source 1..203: mol_type = other DNA
ggcgcgccagtcctaattacggcagcatcccagacagacttccagatttgaacatctaccccccaacacgtaggtgtatgggagaccacatcatttcatgacttgcaacgcgccccgtctaggctgttgtctagacgaggcaagctctggaaagcaacgccgagtctctgagaagagggagcataggccgactcggaccgatg

SEQ ID NO: 11478 - DNA, 203 bp, Homo sapiens
  source 1..203: mol_type = other DNA
ggcgcgccagtcctaacctcctcagcatcccagatgtggcatatcgaatgaacatctaccccccaacacgtaggtgtatgggagaccacatcatttcatgacttatgtttgaggaacactaggctgttgtctagacgaggcaagctctggaaagcaacgccgagtctctgagaagagggagcataggccgactcggaccgatg

SEQ ID NO: 11479 - DNA, 203 bp, Homo sapiens
  source 1..203: mol_type = other DNA
ggcgcgccagtccttataacctcagccccgggggcagggagagcctagattacggaagtaccgcgagcaaggagacttaggggatatcgcgtccggagctagctggatcctctaggcaggatggtgatgggaatctttgcaaattgtatcttctgtttgaaagtgaagtacttacctcagcagcagaacgactcggaccgatg

SEQ ID NO: 11480 - DNA, 203 bp, Homo sapiens
  source 1..203: mol_type = other DNA
ggcgcgccagtcctaagggcgtcagccccgggggcagggagagcctagattacggaagtaccgcgagcaaggagcgcggaatcggggagcgtccggagctagctggatcctctaggcaggatggtgatgggaatctttgcaaattgtatcttctgtttgattccatttagtaagcctcagcagcagaacgactcggaccgatg

SEQ ID NO: 11481 - DNA, 203 bp, Homo sapiens
  source 1..203: mol_type = other DNA
ggcgcgccagtcctttcagcctcagccccgggggcagggagagcctagattacggaagtaccgcgagcaaggagcgcggaatcggggagctgaaacctggtcaaggatcctctaggcaggatggtgatgggaatctttgcaaattgtatcttctgtttgaaagtgaagtacttacctcagcagcagaacgactcggaccgatg

SEQ ID NO: 11482 - DNA, 203 bp, Homo sapiens
  source 1..203: mol_type = other DNA
ggcgcgccagtcctttgctaaccagcctagctaatggtggtggcgctttaggcagcctccacgcccaccacctcccagatagagcggcggcactgtagggaagaccggggaccggtcactaccaaggacgcagacctctttttgagtatcacgcctccggaagtagttgggcaagcccacctatatgtcgactcggaccgatg

SEQ ID NO: 11483 - DNA, 203 bp, Homo sapiens
  source 1..203: mol_type = other DNA
ggcgcgccagtcctttcaaagtcagcgcacgtagtcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 11484 - DNA, 203 bp, Homo sapiens
  source 1..203: mol_type = other DNA
ggcgcgccagtcctggtaacaccagcgtcatcaggcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactcgactcggaccgatg

SEQ ID NO: 11485 - DNA, 203 bp, Homo sapiens
  source 1..203: mol_type = other DNA
ggcgcgccagtccttactattccaggaagtggacggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagttttaacgactcggaccgatg

SEQ ID NO: 11486 - DNA, 203 bp, Homo sapiens
  source 1..203: mol_type = other DNA
ggcgcgccagtcctcgaacttacaggacccagacagagacacacggtcactgcagctgaagccgctgcccctgctaagtccctctgtccagaggctgggagagccaaggatcacgcagcaaggaagaaacagacccaggtgcagactcaggcaccaccaggaccagctgatcattccagcccacagcacgactcggaccgatg

SEQ ID NO: 11487 - DNA, 203 bp, Homo sapiens
  source 1..203: mol_type = other DNA
ggcgcgccagtcctccggcactcaggacccagacagagacacacggtcactgcagctgaagccgctgcccctgctacagatgaagaaaaggaggctgggagagccaaggatcacgcagcaaggaagaaacagacccaggtgcagacgagacatgacagcagaccagctgatcattccagcccacagcacgactcggaccgatg

SEQ ID NO: 11488 - DNA, 203 bp, Homo sapiens
  source 1..203: mol_type = other DNA
ggcgcgccagtcctggtcggaacaggacccagacagagacacacggtcactgcagctgaagccgctgcccctgctacagatgaagaaaaggaggctgggagagccaaggatcacgcagcaaggaagaaacagacccaggtgcagactcaggcaccaccagccgagttgagggcctccagcccacagcacgactcggaccgatg

SEQ ID NO: 11489 - DNA, 203 bp, Homo sapiens
  source 1..203: mol_type = other DNA
ggcgcgccagtcctgaggctgtcaggacccagacagagacacacggtcactgcagctgaagccgctgcccctgctacagatgaagaaaaggaggctgggagagccaaggatcacgcagcaaggaagaaacagacccaggtgcagactcaggcaccaccaggaccagctgatcatattcattacaccttcgactcggaccgatg

SEQ ID NO: 11490 - DNA, 203 bp, Homo sapiens
  source 1..203: mol_type = other DNA
ggcgcgccagtcctgcaccagtcaggacccagactattcgcggtaccgactgcagctgaagccgctgcccctgctacagatgaagaaaaggaggctgggagagccaaggatcacgcagcaaggaagaaacagacccaggtgcagactcaggcaccaccaggaccagctgatcattccagcccacagcacgactcggaccgatg

SEQ ID NO: 11491 - DNA, 203 bp, Homo sapiens
  source 1..203: mol_type = other DNA
ggcgcgccagtcctcctctccgcaggaggaggagcccgggcgggcgaggggcggccggagagcgccagggcctgagctgccggagcggcgcctgtgagtgagtgcagaaagcaggcgcccgcgcgctagccggttactttttctgacgcacgccgcgctctctccctgggcgacctgcagtttgcaatcgactcggaccgatg

SEQ ID NO: 11492 - DNA, 203 bp, Homo sapiens
  source 1..203: mol_type = other DNA
ggcgcgccagtcctcctacgcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatcgactcggaccgatg

SEQ ID NO: 11493 - DNA, 203 bp, Homo sapiens
  source 1..203: mol_type = other DNA
ggcgcgccagtccttacttcttcaggaggcttctctgggtataaagcagctgaaatgtggagttcgacattaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11494 - DNA, 203 bp, Homo sapiens
  source 1..203: mol_type = other DNA
ggcgcgccagtccttcccgaggcaggaggcttctctgggtataaagcagctgaaatgtggagttcgacggtaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11495 - DNA, 203 bp, Homo sapiens
  source 1..203: mol_type = other DNA
ggcgcgccagtcctaaactaggcaggaggcttctctgggtataaagcagctgaaatgtggagtttcctcccaggagctgagagcgtgtccatgggcccagtgcctggcgtgtcctccccctttcaagcaactacgcatgaccaggattctgggagggcagaggacagaccacaggcacccaggataaccgactcggaccgatg

SEQ ID NO: 11496 - DNA, 203 bp, Homo sapiens
  source 1..203: mol_type = other DNA
ggcgcgccagtccttagcaactcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11497 - DNA, 203 bp, Homo sapiens
  source 1..203: mol_type = other DNA
ggcgcgccagtcctaatccgagcaggaggcttctctgggtataaagcagctgaaatgtggagtttcctcccaggagctgagagcgtgtccatgggcccagtgcctggcgtgtcctccctgggagcttgctggacgcatgaccaggattctgggagggcagctatggttgtgttagcacccaggataaccgactcggaccgatg

SEQ ID NO: 11498 - DNA, 203 bp, Homo sapiens
  source 1..203: mol_type = other DNA
ggcgcgccagtcctcggcagcgcaggaggcttctctgggtataaagcagctgaaatgtggagtttcctcccaggagctgagagcgtgtccatgggcccagtgcctggcgtgtcctccctgggagcttgctggttagtgtgttttacttctgggagggcagaggacagaccacaggcacccaggataaccgactcggaccgatg

SEQ ID NO: 11499 - DNA, 203 bp, Homo sapiens
  source 1..203: mol_type = other DNA
ggcgcgccagtcctgttcataccaggaggcttctctgggtataaagcagctgaaatgtggagtttcctcccaggagtaccagtgcaacaaatgggcccagtgcctggcgtgtcctccctgggagcttgctggacgcatgaccaggattctgggagggcagaggacagaccacaggcacccaggataaccgactcggaccgatg

SEQ ID NO: 11500 - DNA, 203 bp, Homo sapiens
  source 1..203: mol_type = other DNA
ggcgcgccagtcctcaaccacccaggaggcttctctgggtataaagcattcagctgtctttctttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11501 - DNA, 203 bp, Homo sapiens
  source 1..203: mol_type = other DNA
ggcgcgccagtcctcagagagtcaggaggcttcttaccaacatgcaatgctgaaatgtggagtttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 11502 - DNA, 203 bp, Homo sapiens
  source 1..203: mol_type = other DNA
ggcgcgccagtcctgggactatcaggcaagattgaagtgaccctccctgggctgctttctttcgattatcatcagtgaccctaccccggctgctcttcccagcacaactccggtgcaaaggcttgggcatcctggtgctttgcctctagcccatgctccacagcgaggagagagaaaaccctgaggcacgactcggaccgatg

SEQ ID NO: 11503 - DNA, 203 bp, Homo sapiens
  source 1..203: mol_type = other DNA
ggcgcgccagtcctgaagggaacagggccttgtgattaccctatctaaccgagggcaaggcagtggcggcggccgccccaacggagctgcagacgaaaggcaagaacggcgatggccgccgtaggtcagctaaagatcatcaccctggtaaaactttgccagagaacccagcaggattcaccagcacgcgactcggaccgatg

SEQ ID NO: 11504 - DNA, 203 bp, Homo sapiens
  source 1..203: mol_type = other DNA
ggcgcgccagtcctggacgttccagggccttgtgcgacatgggctgcgagacatcaggctgggtggcggcggccgccccaacggagctgcagacgaaaggcaagaacggcgatggccgccgtaggtcagctaaagatcatcaccctggtaaaactttgccagagaacccagcaggattcaccagcacgcgactcggaccgatg

SEQ ID NO: 11505 - DNA, 203 bp, Homo sapiens
  source 1..203: mol_type = other DNA
ggcgcgccagtcctatgacaaccagggccttgtgcgacatgggctgcgccgagggcaaggcatctctccatttaatcccaacggagctgcagacgaaaggcaagaacggcgatggccgccgtaggtcagctaaagatcatcaccctggtaaaactttgccagagaacccagcaggattcaccagcacgcgactcggaccgatg

SEQ ID NO: 11506 - DNA, 203 bp, Homo sapiens
  source 1..203: mol_type = other DNA
ggcgcgccagtccttgcgtcgtcagggctgagggagctcaagtttcagcctgaggcatgggcacctgaaggtctcggacctgagacccgtggattctgtccagtacaccctgttgctccttctgcctcccctctcctgtattgaaagcgtttgtgttcatcttatcagggacctgaccctaagagaatcgactcggaccgatg

SEQ ID NO: 11507 - DNA, 203 bp, Homo sapiens
  source 1..203: mol_type = other DNA
ggcgcgccagtcctacgatatgcagggctgagggagctcaagtttcagcctgaggcatgggccaggaggccatggtatggatgtcgttccggattctgtccagtacaccctgttgctccttctgcctcccctctcctgtattgaaagcgtttgtgttcatcttatcagggacctgaccctaagagaatcgactcggaccgatg

SEQ ID NO: 11508 - DNA, 203 bp, Homo sapiens
  source 1..203: mol_type = other DNA
ggcgcgccagtcctgatttctacagggctgagggagctcaagtttcagcctgaggcatgggccaggaggccatggtgacctgagacccgtggattctgtccagtacaccctgttgctccttctgcctcccctctcctgtattgaaacatcactccgcacgcttatcagggacctgaccctaagagaatcgactcggaccgatg

SEQ ID NO: 11509 - DNA, 203 bp, Homo sapiens
  source 1..203: mol_type = other DNA
ggcgcgccagtcctatctcaatcagggctgagggagctcaagtttcagcctgaggcatgggccaggaggccatggtgacctgagacccgtggattctgtccagtacaccctgttgctccttctgcctcccctctcctgtattgaaagcgtttgtgttcattgaccatatactaggaccctaagagaatcgactcggaccgatg

SEQ ID NO: 11510 - DNA, 203 bp, Homo sapiens
  source 1..203: mol_type = other DNA
ggcgcgccagtcctcgctcgcccagggctgagggagctcaagtttcagcctgaggcatgggccaggaggccatggtgacctgagacccgtggattctgtccagtacaccctgttgctccttctgcctcccctgagagcagcgtgctgcgtttgtgttcatcttatcagggacctgaccctaagagaatcgactcggaccgatg

SEQ ID NO: 11511 - DNA, 203 bp, Homo sapiens
  source 1..203: mol_type = other DNA
ggcgcgccagtcctcactttcccagggctgagggagctcaagtttcagcctgaggcatgggccaggaggccatggtgacctgagacccgtggattctgtccagtcactaaatccttctcttctgcctcccctctcctgtattgaaagcgtttgtgttcatcttatcagggacctgaccctaagagaatcgactcggaccgatg

SEQ ID NO: 11512 - DNA, 203 bp, Homo sapiens
  source 1..203: mol_type = other DNA
ggcgcgccagtccttggccctacagggctgagggagctcaagtttcagttctgatagctattcaggaggccatggtgacctgagacccgtggattctgtccagtacaccctgttgctccttctgcctcccctctcctgtattgaaagcgtttgtgttcatcttatcagggacctgaccctaagagaatcgactcggaccgatg

SEQ ID NO: 11513 - DNA, 203 bp, Homo sapiens
  source 1..203: mol_type = other DNA
ggcgcgccagtcctactgtaagcaggggaggcgcaaagcgttggttagcctgccccggggcgaagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11514 - DNA, 203 bp, Homo sapiens
  source 1..203: mol_type = other DNA
ggcgcgccagtcctgaagaaggcaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11515 - DNA, 203 bp, Homo sapiens
  source 1..203: mol_type = other DNA
ggcgcgccagtccttgccacaccaggggaggcgcctgtgaggcccggacctgccccggggcgaagggtatgtggcgagacagagccctgcgtaggggtgctaatgtggaaaactcctgttgccgtttccctccaccggcctggagtctcccagtcttgtcccggcagtgccgccctccccactaagaccgactcggaccgatg

SEQ ID NO: 11516 - DNA, 203 bp, Homo sapiens
  source 1..203: mol_type = other DNA
ggcgcgccagtccttgtattcccaggggaggcgcctgtgaggcccggaggccagggtaaaataagggtatgtggcgagacagagccctgcacccctaattcccggtggaaaactcctgttgccgtttccctccaccggcctggagtctcccagtcttgtcccggcagtgccgccctccccactaagaccgactcggaccgatg

SEQ ID NO: 11517 - DNA, 203 bp, Homo sapiens
  source 1..203: mol_type = other DNA
ggcgcgccagtccttcggtaggcaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccacgccctaagaaattcccagggcgaagagcgactcggaccgatg

SEQ ID NO: 11518 - DNA, 203 bp, Homo sapiens
  source 1..203: mol_type = other DNA
ggcgcgccagtccttcggcccacaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgaggacaccgatgagtcgactcggaccgatg

SEQ ID NO: 11519 - DNA, 203 bp, Homo sapiens
  source 1..203: mol_type = other DNA
ggcgcgccagtcctccctgccgcaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccatttatcaatctacgcccagggcgaagagcgactcggaccgatg

SEQ ID NO: 11520 - DNA, 203 bp, Homo sapiens
  source 1..203: mol_type = other DNA
ggcgcgccagtcctgacagggtcaggggcgccgccgccggcgctcgcaggccgcggatgaagaagaaaacccggcgccgctcgacccggagcgaggagttgacccggagcgaggagttgaccctgagtgaggcgagataactacaggaagaggcgacccagagtgaggaggcgacccagggcgaagagcgactcggaccgatg

SEQ ID NO: 11521 - DNA, 203 bp, Homo sapiens
  source 1..203: mol_type = other DNA
ggcgcgccagtcctgggttgcgcaggggcgccgctagaatgttctcatggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagcgactcggaccgatg

SEQ ID NO: 11522 - DNA, 203 bp, Homo sapiens
  source 1..203: mol_type = other DNA
ggcgcgccagtcctgctagtatcaggtcaattatattcagtatggaaagaataaaagaactacggaacctgatgtcgcagtctcgcactcgcgagatactgacaaaaaccacagtggaccatatggccataattaagaagtacacatcggggagacaggaggtatctttaaagattaggatgaaatggcgactcggaccgatg

SEQ ID NO: 11523 - DNA, 203 bp, Homo sapiens
  source 1..203: mol_type = other DNA
ggcgcgccagtcctggcgaagacaggtcaattatattcagtatggaaagaataaaagaactagcccgatctgctgggcagtctcgcactcgcgagatactgacaaaaaccacagtggaccatatggccataattaagaagtacacatcggggagacaggaaaagaacccgtcacttaggatgaaatggcgactcggaccgatg

SEQ ID NO: 11524 - DNA, 203 bp, Homo sapiens
  source 1..203: mol_type = other DNA
ggcgcgccagtcctgagacgaacaggttcagaaaatttaaaaagtcttgcaccgcagtctctcgtcatttggtgcatacacgcagaagagaaagtgaaagatactgaaggagcaaaacaaatagtgcggagacatctagtggcagaaacaggaactgcagagaaaatgccaagcacaagtagaccaaccgactcggaccgatg

SEQ ID NO: 11525 - DNA, 203 bp, Homo sapiens
  source 1..203: mol_type = other DNA
ggcgcgccagtcctagtgaattcaggttcagaaaatttaaaaagtctttttaatactgtctgcgtcatttggtgcatacacgcagaagagaaagtgaaagatactgaaggagcaaaacaaatagtgcggagatcagggtccctcttaacaggaactgcagagaaaatgccaagcacaagtagaccaaccgactcggaccgatg

SEQ ID NO: 11526 - DNA, 203 bp, Homo sapiens
  source 1..203: mol_type = other DNA
ggcgcgccagtcctgtaagacacaggttcagaaaatttaaaaagtctttttaatactgtctgcgtcatttggtgcatacacgcagaagagaaagtgaaagatactgaaggagcaaaactttccagagcatcgcatctagtggcagaaacaggaactgcagagaaaatgccaagcacaagtagaccaaccgactcggaccgatg

SEQ ID NO: 11527 - DNA, 203 bp, Homo sapiens
  source 1..203: mol_type = other DNA
ggcgcgccagtccttagaactacagtgaccgggtggtttgcttaggcgcagacggggaagcggagccaacatgccaacatatgttgctgaggtttgtcgcaaaacttatgtgaccccgcggagacccttcgagaaatctcgtctcgaccaagagctgaagctgatcggcgagtatgggctccggaacacgactcggaccgatg

SEQ ID NO: 11528 - DNA, 203 bp, Homo sapiens
  source 1..203: mol_type = other DNA
ggcgcgccagtcctcttaccgtcagtgaccgggtggtttgcttaggcgcagacggggaagcggagccaacatgccagtggcccggagctgggtttgtcgcaaaaaacgcaacgtttttcggagacccttcgagaaatctcgtctcgaccaagagctgaagctgatcggcgagtatgggctccggaacacgactcggaccgatg

SEQ ID NO: 11529 - DNA, 203 bp, Homo sapiens
  source 1..203: mol_type = other DNA
ggcgcgccagtccttgagataacagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtacctctctaacgtaccgactcggaccgatg

SEQ ID NO: 11530 - DNA, 203 bp, Homo sapiens
  source 1..203: mol_type = other DNA
ggcgcgccagtcctaacgatttcagtgaccgggtggtttgcttaggcgcagacggggaagcggagccaacatgccagtggcccggagctgggtttgtcgcaaaacttatgtgaccccggatctgggacgtaggaaatctcgtctcgaccaagagctgaagctgatcggcgagtatgggctccggaacacgactcggaccgatg

SEQ ID NO: 11531 - DNA, 203 bp, Homo sapiens
  source 1..203: mol_type = other DNA
ggcgcgccagtcctgaatcctccagtgcctccggaggaaatctgctcggtccccggcagccgccgcttcccctttgatgttttggtacgccgtgcgcatgcgcccgcgcacgttcgggctgcactgggcagactaagttggatctcctctcttcagtgaaaccctcaattccatcaaaaactaaagggcgactcggaccgatg

SEQ ID NO: 11532 - DNA, 203 bp, Homo sapiens
  source 1..203: mol_type = other DNA
ggcgcgccagtcctagctgcggcagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatagggtgtgggtccacgactcggaccgatg

SEQ ID NO: 11533 - DNA, 203 bp, Homo sapiens
  source 1..203: mol_type = other DNA
ggcgcgccagtcctcttatgtgcagtgcctccggaggaaatctgctcggtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11534 - DNA, 203 bp, Homo sapiens
  source 1..203: mol_type = other DNA
ggcgcgccagtccttaaacaatcagtgcctccggaggaaatctgctcggtccccggcagccgccgcttcccctttgatgttttggtacgccgtgcgcatgcgcctcacattagaattactgcactgggcagactaagttggatctcctctcttcagtgaaggttgtggccgagccaaaaactaaagggcgactcggaccgatg

SEQ ID NO: 11535 - DNA, 203 bp, Homo sapiens
  source 1..203: mol_type = other DNA
ggcgcgccagtcctggagtagtcagtgcctccggaggaaatctgctcgtatgtaattgaatcccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11536 - DNA, 203 bp, Homo sapiens
  source 1..203: mol_type = other DNA
ggcgcgccagtcctctgtgaagcagtgcctccgggtcgctgtacaaacgtccccggcagccgccgcttcccctttgatgttttggtacgccgtgcgcatgcgcctcacattagaattactgcactgggcagactaagttggatctcctctcttcagtgaaaccctcaattccatcaaaaactaaagggcgactcggaccgatg

SEQ ID NO: 11537 - DNA, 203 bp, Homo sapiens
  source 1..203: mol_type = other DNA
ggcgcgccagtccttcgttatacagttgctttctcgtggctctgcagcgagagcgcagagaagcagaggaccaagaggcagaatgccggcgctccaccgcccgagactgtgtttcctgtgagtccagatgtgtgatccagatatgctgcaatggtgacataaactgttgactgagactaggagcgtgccgactcggaccgatg

SEQ ID NO: 11538 - DNA, 203 bp, Homo sapiens
  source 1..203: mol_type = other DNA
ggcgcgccagtcctgtcctacacagttggcccgtgtgaggagaaggccggggcagcggaggcttccggcggaaaatccaagaggaagaaggatctacggatatcgacgggtggagtctcacccgcacccaaccccacacccccccggaacctggactcccggaccttcatcaccattggagacagaaacgactcggaccgatg

SEQ ID NO: 11539 - DNA, 203 bp, Homo sapiens
  source 1..203: mol_type = other DNA
ggcgcgccagtcctctctctcgcagttggcccgtgtgaggagaaggcctattacaattctctttccggcggaaaatccaagaggaagaaggatctacggatatcctgcatgtccaagccacccgcacccaaccccacacccccccggaacctggactcccggaccttcatcaccattggagacagaaacgactcggaccgatg

SEQ ID NO: 11540 - DNA, 203 bp, Homo sapiens
  source 1..203: mol_type = other DNA
ggcgcgccagtcctacatggagcataacaaacacttcaacatcacagtacaggctgaatcatttcttcacatcatgctacccacacaactaagctagatccttaactcatagttacataaaaacctcaagtatcacaatcaaacacccgccgggggtccaattcacaaaattaacagctggggcaaatcgactcggaccgatg

SEQ ID NO: 11541 - DNA, 203 bp, Homo sapiens
  source 1..203: mol_type = other DNA
ggcgcgccagtcctggcttggtcataacaaacacttcaacatcacagtacaggctgaatcatttcttcacatcatggctagttgcaggtgaagctagatccttaactcatagttacataaaaacctcaagtatcacaatcaaacactaaatcaacacatcattcacaaaattaacagctggggcaaatcgactcggaccgatg

SEQ ID NO: 11542 - DNA, 203 bp, Homo sapiens
  source 1..203: mol_type = other DNA
ggcgcgccagtcctttgaagatcataagagtctaattcaccaaaaaagttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 11543 - DNA, 203 bp, Homo sapiens
  source 1..203: mol_type = other DNA
ggcgcgccagtccttatacacccataagagtctatcattgatttctttttgtggtaaaaatcacctggaccaatgcgaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 11544 - DNA, 203 bp, Homo sapiens
  source 1..203: mol_type = other DNA
ggcgcgccagtccttcatcggacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 11545 - DNA, 203 bp, Homo sapiens
  source 1..203: mol_type = other DNA
ggcgcgccagtcctcagggtgccataagccaaattgtgagccatgatagtggcactgaatttctaaatacaagaaattgcttagacaattggtttagtatctgtatatgggcaatactctgtcctgcagtaggcagcatgtcagctgaaacaccaatcacggctccagctacggctcaggatctgcagcgactcggaccgatg

SEQ ID NO: 11546 - DNA, 203 bp, Homo sapiens
  source 1..203: mol_type = other DNA
ggcgcgccagtcctagtatctgcataagccaaattgtgagccatgatagtggcactgaatttctaaatacaagaaattgcttagacaattttgcattcgctcagatatgggcaatactctgtcctgcagtaggcagcatgtcagctgaaacaccaatcacattgaatatcgatcctcaggatctgcagcgactcggaccgatg

SEQ ID NO: 11547 - DNA, 203 bp, Homo sapiens
  source 1..203: mol_type = other DNA
ggcgcgccagtcctccttatctcataaggtatacgcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 11548 - DNA, 203 bp, Homo sapiens
  source 1..203: mol_type = other DNA
ggcgcgccagtcctatccgcgtcatacaatgcacggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagcgactcggaccgatg

SEQ ID NO: 11549 - DNA, 203 bp, Homo sapiens
  source 1..203: mol_type = other DNA
ggcgcgccagtcctgttcaattcatcctgggtcactaatgatgttaaggaaccagaacgttttcccctcctggactgttagtaacttagtctccctcctcccctaaccacccccgcccccccccaccccccgcagtaataaaggcccctgaacgtgtatgttggtctcccgggagctgcttgctgaagcgactcggaccgatg

SEQ ID NO: 11550 - DNA, 203 bp, Homo sapiens
  source 1..203: mol_type = other DNA
ggcgcgccagtcctgggtagaacatcctgggtcagaggccgatccgcagaaccagaacgttttcccctcctggactgttagtaacttagtctccctcctcccctaaccacccccgcccggatatctaattgccagtaataaaggcccctgaacgtgtatgttggtctcccgggagctgcttgctgaagcgactcggaccgatg

SEQ ID NO: 11551 - DNA, 203 bp, Homo sapiens
  source 1..203: mol_type = other DNA
ggcgcgccagtcctgaggttcgcatcctgggtcagaggccgatccgcagaaccagaacgttttcccctcctggactgttagtaacttagtctccctcctcccctcggggttgatctaaccccccaccccccgcagtaataaaggcccctgaacgtgtatgttggtctcccgggagctgcttgctgaagcgactcggaccgatg

SEQ ID NO: 11552 - DNA, 203 bp, Homo sapiens
  source 1..203: mol_type = other DNA
ggcgcgccagtcctgggctgatcatctgcctgggatcatcaagccctaattagcccccaatcttaaattagggctgccgttttctgtttctccctgggctgcggaaagccagaagattttatctagcttatacaaggctgctggtgttccctctttttttccacgagggtgtttttggctgcaattgccgactcggaccgatg

SEQ ID NO: 11553 - DNA, 203 bp, Homo sapiens
  source 1..203: mol_type = other DNA
ggcgcgccagtcctatatccttcatctgcctgggatcatcaagccctagaagctgggtttctttaaattagggctgccgttttctgtttctccctgggctgcggcggatagcttagcgttatctagcttatacaaggctgctggtgttccctctttttttccacgagggtgtttttggctgcaattgccgactcggaccgatg

SEQ ID NO: 11554 - DNA, 203 bp, Homo sapiens
  source 1..203: mol_type = other DNA
ggcgcgccagtcctaggatagacatgaaatgtccagggattacgactcgcgtggtcggacagcacatgttagtcatgtattatggtgtttcccaacacgtatctttgctctagtattgaactttagtgatgagtgtacttggcatgtacacctgattagttagcccttgtggatacgccactgccgctcgactcggaccgatg

SEQ ID NO: 11555 - DNA, 203 bp, Homo sapiens
  source 1..203: mol_type = other DNA
ggcgcgccagtcctatatgaaccatgagccggaacctatcaataacgtgcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 11556 - DNA, 203 bp, Homo sapiens
  source 1..203: mol_type = other DNA
ggcgcgccagtcctcgtgacgacatgagccggaagaccgtcccggatgaagctccactaatacagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 11557 - DNA, 203 bp, Homo sapiens
  source 1..203: mol_type = other DNA
ggcgcgccagtcctctgtttgacatgagccggaagaccgtcccggatggcctcggggactgccagtgtgtggaggtacttattacctgatccggcattcccgcttctgctggttgcttcatgctgcaggctgcggccgtcagccctcgctcgcattggtggcgctgaggtgccggggcagcaagtgaccgactcggaccgatg

SEQ ID NO: 11558 - DNA, 203 bp, Homo sapiens
  source 1..203: mol_type = other DNA
ggcgcgccagtcctcgagcccgcatgagccggaagaccgtcccggatggcctcggggactgccagtgtgtggaggtgagctccgggattgccggcattcccgcttctgctggttgcttcatgctgcaggctgcggccgtcagccctcgctcgcattggtgaattgtgaccttgagggcagcaagtgaccgactcggaccgatg

SEQ ID NO: 11559 - DNA, 203 bp, Homo sapiens
  source 1..203: mol_type = other DNA
ggcgcgccagtcctgccgtcctcatgagccggaagaccgtcccggatggcctcggggactgccagtgtgtggaggtgagctccgggattgccggcattcccgcttctgctggttgcttcatgctgcaggctgcggccgtcagccctcgctcgcattggtgcgagctcacacgatgggcagcaagtgaccgactcggaccgatg

SEQ ID NO: 11560 - DNA, 203 bp, Homo sapiens
  source 1..203: mol_type = other DNA
ggcgcgccagtcctcaagcgatcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccgactattttctcacacgactcggaccgatg

SEQ ID NO: 11561 - DNA, 203 bp, Homo sapiens
  source 1..203: mol_type = other DNA
ggcgcgccagtcctcagtacagcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 11562 - DNA, 203 bp, Homo sapiens
  source 1..203: mol_type = other DNA
ggcgcgccagtcctttggaatccatgagccggaagaccgtcccggatggcctcggggactgccagtgtgtggaggtgagctccgggattgccggcattcccgcttctgctggttgcttcatgctgcaggctggattttatctttaccgctcgcattggtggcgctgaggtgccggggcagcaagtgaccgactcggaccgatg

SEQ ID NO: 11563 - DNA, 203 bp, Homo sapiens
  source 1..203: mol_type = other DNA
ggcgcgccagtcctgttcgcgacatgagccggaagaccgtcccggatggcctcggggactgccagtgtgtggaggtgagctccgggattgccggcattcccgcttctgctggttgcttcatgctgcaggctgtctgtacttcagaacgctcgcattggtggcgctgaggtgccggggcagcaagtgaccgactcggaccgatg

SEQ ID NO: 11564 - DNA, 203 bp, Homo sapiens
  source 1..203: mol_type = other DNA
ggcgcgccagtccttgctcaaacatgagccggaagaccgtcccggatggcctcggggactgccagtgtgtggaggttgagagttttcaacccggcattcccgcttctgctggttgcttcatgctgcaggctgcggccgtcagccctcgctcgcattggtggcgctgaggtgccggggcagcaagtgaccgactcggaccgatg

SEQ ID NO: 11565 - DNA, 203 bp, Homo sapiens
  source 1..203: mol_type = other DNA
ggcgcgccagtcctgcgatgcacatgccttacctcacgtgtaccagtttgctgagacacatgtctccgcccctgggtctggggaagaagtgtccggccagagtggcttacaagcggcttctgcggatggacctgcccgtcgcagatgacaacaccgtccacttcaattccaccctcatggctctgatccgactcggaccgatg

SEQ ID NO: 11566 - DNA, 203 bp, Homo sapiens
  source 1..203: mol_type = other DNA
ggcgcgccagtcctaaccgtaacatgccttacctggacatgtatcagagaagcccggctgcctctccgcccctgggtctggggaagaagtgtccggccagagtggcttacaagcggcttctgcggatggacctgcccgtcgcagatgacaacaccgtccacttcaattccaccctcatggctctgatccgactcggaccgatg

SEQ ID NO: 11567 - DNA, 203 bp, Homo sapiens
  source 1..203: mol_type = other DNA
ggcgcgccagtcctaggccaagcatgccttacctggacatgtatcagatgctgagacacatgtctccgcccctgggtctggggaagaagtgtccggccagagtgctacgatgaaccggtctgcggatggacctgcccgtcgcagatgacaacaccgtccacttcaattccaccctcatggctctgatccgactcggaccgatg

SEQ ID NO: 11568 - DNA, 203 bp, Homo sapiens
  source 1..203: mol_type = other DNA
ggcgcgccagtcctataaatcccatgccttacctggacatgtatcagatgctgagacacatgtctccgcccctgggtctggggaagaagtgtccggccagagtggcttacaagcggctgagtgcataatctatgcccgtcgcagatgacaacaccgtccacttcaattccaccctcatggctctgatccgactcggaccgatg

SEQ ID NO: 11569 - DNA, 203 bp, Homo sapiens
  source 1..203: mol_type = other DNA
ggcgcgccagtcctgcgttctgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccacccctcataggacatcacgactcggaccgatg

SEQ ID NO: 11570 - DNA, 203 bp, Homo sapiens
  source 1..203: mol_type = other DNA
ggcgcgccagtcctgtctacttcatgccttacctggacatgtatcagatgctgagacacatgtctccgcccctgggtctggggaagaagttgatccaggttccagcttacaagcggcttctgcggatggacctgcccgtcgcagatgacaacaccgtccacttcaattccaccctcatggctctgatccgactcggaccgatg

SEQ ID NO: 11571 - DNA, 203 bp, Homo sapiens
  source 1..203: mol_type = other DNA
ggcgcgccagtcctcggccgttcatggccgagaggccggggcctccgggcggcgccgtgtccgcgaccgcgtaccctgacacccccgcggaattccctccgcacctccaggcgggtgcgatgcggcgccgctccaccttgactgataactgtctgtgcgccggcgcgttcggggccctggccgccgcccgactcggaccgatg

SEQ ID NO: 11572 - DNA, 203 bp, Homo sapiens
  source 1..203: mol_type = other DNA
ggcgcgccagtccttccaaggccatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgcaccgcaccaacaccccctggccgccgcccgactcggaccgatg

SEQ ID NO: 11573 - DNA, 203 bp, Homo sapiens
  source 1..203: mol_type = other DNA
ggcgcgccagtcctacctatgacatggtgagaaaagggttgcggtaccttccagcaaggtcatacatgaaatcaagactggtggattggaaatgtatgtcccaggatggcaggccatgttccgctggatgcgcttccatgacctcggattgtggacaggagatcgcgatcttctgcccgaattcgtaacgactcggaccgatg

SEQ ID NO: 11574 - DNA, 203 bp, Homo sapiens
  source 1..203: mol_type = other DNA
ggcgcgccagtcctctcagctgcatggtgagaaattttacagaaagatttccagcaaggtcatacatgaaatcaagactggtggattggaaatgtatgtcccaggatggcaggccatgccaattctttcaaccttccatgacctcggattgtggacaggagatcgcgatcttctgcccgaattcgtaacgactcggaccgatg

SEQ ID NO: 11575 - DNA, 203 bp, Homo sapiens
  source 1..203: mol_type = other DNA
ggcgcgccagtccttgacttctcatggtgagaaattttacagaaagatttccagcaaggtcatacatgaaatcaagactggtggattggaaatgtatgtcccaggatggcaggccatgttccgctggatgcgcttccatgacctcggattgtggacaggagatcgcgatcttctgcccgaattcgtaacgactcggaccgatg

SEQ ID NO: 11576 - DNA, 203 bp, Homo sapiens
  source 1..203: mol_type = other DNA
ggcgcgccagtcctattcgtagcatggttacccaatgcgcactcccgattccaataaacttgaatgtaaggcttgaaacagtggtctaggtgccctatttagggtgaggagcctagctggcagccccagtgaatcctctattggatagaaaccgctatatcgggtagctatagcagtcggatagtaatcgactcggaccgatg

SEQ ID NO: 11577 - DNA, 203 bp, Homo sapiens
  source 1..203: mol_type = other DNA
ggcgcgccagtcctgtgaatggcatggttacccatcatttgaggaaatttccaataaacttgaatgtaaggcttgaaacagtggtctaggtgccctatttagggtgaggagcctagctggcagccccagtgaatcctctattggatagaaaccgctatatcgggtagctatagcagtcggatagtaatcgactcggaccgatg

SEQ ID NO: 11578 - DNA, 203 bp, Homo sapiens
  source 1..203: mol_type = other DNA
ggcgcgccagtcctatgcggcgcatggttacccatcatttgaggaaatttccaataaacttgaatgtaaggcttgaaacagtggtctaggtgccctatttagggtgaggagcctagctggcagccccagtgaatcctctattggattagtttaatacctacgggtagctatagcagtcggatagtaatcgactcggaccgatg

SEQ ID NO: 11579 - DNA, 203 bp, Homo sapiens
  source 1..203: mol_type = other DNA
ggcgcgccagtccttgggctcgcattcagcgcaacagccgtcggtcctctcgctttcccgtaggggccgtcggcgttcgtttgaaacgcggtccacccgtcccagcgtagccggcgctcttcggcgccgcgcgcaaacttcccgagccggcgggtgcgggcggtggcagcggggagtctcctatacgtcgactcggaccgatg

SEQ ID NO: 11580 - DNA, 203 bp, Homo sapiens
  source 1..203: mol_type = other DNA
ggcgcgccagtcctctgccgggcattcagcgcaacagccgtcggtcctctcgctttcccgtaggggccgtcggcgttcgtttgaaacgcggtccacccgtcccagcgtagccggcgctcttcggcgccgcgcgcaaacttcccgagccggcgggtgcgggtatacctgtgtcaccccggatgggcgcccgactcggaccgatg

SEQ ID NO: 11581 - DNA, 203 bp, Homo sapiens
  source 1..203: mol_type = other DNA
ggcgcgccagtcctaagccggtcattcatttctaccggtctctagtagtgcagcttcggctgagacacgtcccagtcttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 11582 - DNA, 203 bp, Homo sapiens
  source 1..203: mol_type = other DNA
ggcgcgccagtcctcttggtaccattcatttctaccggtctctagtagtgcagcttcggctggtgtcatcggtgtccttcctccgctgccgcccccgcaaggcttcgccgtcatcgagctttcacatgcatccttgtcgcacgcttttctatatacttcgttccccgccaaccgcaaccattgacgcccgactcggaccgatg

SEQ ID NO: 11583 - DNA, 203 bp, Homo sapiens
  source 1..203: mol_type = other DNA
ggcgcgccagtcctatttatgtcattcatttctaccggtctctagtagtgcagcttcggctggtgtcatcggtgtctgaatgatttaattgcccccgcaaggcttcgccgtcatcgaggccatttccagcgacttgtcgcacgcttttctatatacttcgttccccgccaaccgcaaccattgacgcccgactcggaccgatg

SEQ ID NO: 11584 - DNA, 203 bp, Homo sapiens
  source 1..203: mol_type = other DNA
ggcgcgccagtccttggttcaacattcatttctaggttctctattatctgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 11585 - DNA, 203 bp, Homo sapiens
  source 1..203: mol_type = other DNA
ggcgcgccagtcctaccttacgcatttgggccttacgagcccacaggccccggagtagcagcggggaggccgggagcccgcgggccggagccgcccggccgaggcgtgggggctgcggatgtactttgagactgggggcgacttgagcgttgagggcgcgcggggaggcgagccaccatgttcagccacgactcggaccgatg

SEQ ID NO: 11586 - DNA, 203 bp, Homo sapiens
  source 1..203: mol_type = other DNA
ggcgcgccagtcctttactgtccatttgggccttacgagcccacaggccccggagtagcagctactgataacccttcccgcgggccggagccgcccggccgaggcgtgggggctgcggggccggcccatccgtgggggcgacttgagcgttgagggcgcgcggggaggcgagccaccatgttcagccacgactcggaccgatg

SEQ ID NO: 11587 - DNA, 203 bp, Homo sapiens
  source 1..203: mol_type = other DNA
ggcgcgccagtcctactgtgcaccaaaacgaggggatatcagcttaccgaggccgcaggttttcctagtccctaccgatcgccccaagctgacatccccgggcccggaatgcggctctctgaccctctctgtgccctcccccgccccccgaaccaggcttggcgggcggaggcgccagcggatgtctccgactcggaccgatg

SEQ ID NO: 11588 - DNA, 203 bp, Homo sapiens
  source 1..203: mol_type = other DNA
ggcgcgccagtcctctgctgaaccaaaacgaggggatatcagcttaccgaggccgcaggttttcctagtccctacctcatagatatgtaggacatccccgggcccggaatgcggctctctgaccctctctgtgccctcccccgcccatgatgtagttgcaggcgggcggaggcgccagcggatgtctccgactcggaccgatg

SEQ ID NO: 11589 - DNA, 203 bp, Homo sapiens
  source 1..203: mol_type = other DNA
ggcgcgccagtcctgtaactgcccaaaacgaggggatatcagcttaccgaggccgcaggttttcctagtccctacctcatagatatgtaggacatccccgggcccggaatgcggctctctgaccctctctgtgccctcccccgccccccgaaccaggcttaaattaacactaacccagcggatgtctccgactcggaccgatg

SEQ ID NO: 11590 - DNA, 203 bp, Homo sapiens
  source 1..203: mol_type = other DNA
ggcgcgccagtcctccgtaagaccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcggttagacgacggcgcgactcggaccgatg

SEQ ID NO: 11591 - DNA, 203 bp, Homo sapiens
  source 1..203: mol_type = other DNA
ggcgcgccagtcctcgggcgcaccaaaacgaggggatatcagcttaccgaggccgcaggttttcctagtccctacctcatagatatgtaggacatccccgggccgctctacatatgagctgaccctctctgtgccctcccccgccccccgaaccaggcttggcgggcggaggcgccagcggatgtctccgactcggaccgatg

SEQ ID NO: 11592 - DNA, 203 bp, Homo sapiens
  source 1..203: mol_type = other DNA
ggcgcgccagtccttctagttgccaaaacgaggggatatcagcttacctgtagttggcccactcctagtccctacctcatagatatgtaggacatccccgggcccggaatgcggctctctgaccctctctgtgccctcccccgccccccgaaccaggcttggcgggcggaggcgccagcggatgtctccgactcggaccgatg

SEQ ID NO: 11593 - DNA, 203 bp, Homo sapiens
  source 1..203: mol_type = other DNA
ggcgcgccagtccttcgcttcgccaaaatacctcattaccttaacgggttcagctgttaggattccagaaccttcttgaatggcaggccctgctctttgtcattttcctgctcatctactgcctgaccattatagggaatgttgtcatcatcaccgtggtgagccagggcctgcgactgcactcccctcgactcggaccgatg

SEQ ID NO: 11594 - DNA, 203 bp, Homo sapiens
  source 1..203: mol_type = other DNA
ggcgcgccagtcctggaaagtgccaaaatacctccactgtgactaactttcagctgttaggaaagggcgtgtggggtgaatggcaggccctgctctttgtcattttcctgctcatctactgcctgaccattatagggaatgttgtcatcatcaccgtggtgagccagggcctgcgactgcactcccctcgactcggaccgatg

SEQ ID NO: 11595 - DNA, 203 bp, Homo sapiens
  source 1..203: mol_type = other DNA
ggcgcgccagtcctttaaactcccaaaatacctccactgtgactaactttcagctgttaggattccagaaccttcttgaatggcaggccctgctctttgtcattttcctgctcatctactgcctgaccattatagggaatgttgtcatcatcaccgtggtcttggttacatactgactgcactcccctcgactcggaccgatg

SEQ ID NO: 11596 - DNA, 203 bp, Homo sapiens
  source 1..203: mol_type = other DNA
ggcgcgccagtcctctttattgccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgagggatactcgactcggaccgatg

SEQ ID NO: 11597 - DNA, 203 bp, Homo sapiens
  source 1..203: mol_type = other DNA
ggcgcgccagtcctgggaagctccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgcactcccctcgactcggaccgatg

SEQ ID NO: 11598 - DNA, 203 bp, Homo sapiens
  source 1..203: mol_type = other DNA
ggcgcgccagtcctgatggtgaccaaaatacctccactgtgactaactttcagctgttaggattccagaaccttcttgaatggcaggccctgctctttgtcattttcctgctcatctactgcctgaccattatagggaatgttgtctagggagtaccctagagccagggcctgcgactgcactcccctcgactcggaccgatg

SEQ ID NO: 11599 - DNA, 203 bp, Homo sapiens
  source 1..203: mol_type = other DNA
ggcgcgccagtcctggtatagcccaaaatacctccactgtgactaactttcagctgttaggattccagaaccttcttgaatggcaggccctgctctttgtcattttcctgctcatctagaaaagtgaggaactagggaatgttgtcatcatcaccgtggtgagccagggcctgcgactgcactcccctcgactcggaccgatg

SEQ ID NO: 11600 - DNA, 203 bp, Homo sapiens
  source 1..203: mol_type = other DNA
ggcgcgccagtccttaatccagccaacagaaagtctgcaagcaatgccatgaggtcctgaccagagggtcttctgccaatgcctccaagtggtcaccacctcagaactataagaagcgaagtcggaagagataagccaagcaaaagcccagcacttcccagagccagggactgacacgacaagaccagcgactcggaccgatg

SEQ ID NO: 11601 - DNA, 203 bp, Homo sapiens
  source 1..203: mol_type = other DNA
ggcgcgccagtccttttcgtccccaacagaaagtctgcaagcaatgccatgaggtcctgaccagagggtcttctgccaatgcctccaagtggtcaccacctcagaactataagaagcgtgtggcagccttggaagccaagcaaaagcccagcacttcccagagccagggactgacacgacaagaccagcgactcggaccgatg

SEQ ID NO: 11602 - DNA, 203 bp, Homo sapiens
  source 1..203: mol_type = other DNA
ggcgcgccagtcctggccaaatccaacctactaacaggtgggtgggtagacctcagcaggaaactcagttcttctcatggggtttctctgagctccattcataccagaaagggagcaggagagagaggacaagtggatccaacagccttcgctccaggggaatcagggcatcgcctccttttctgggacgactcggaccgatg

SEQ ID NO: 11603 - DNA, 203 bp, Homo sapiens
  source 1..203: mol_type = other DNA
ggcgcgccagtccttatggctgccaacctactaacaggtgggtgggtatggtgtgtggtttcactcagttcttctcatggggtttctctgagctccattcatacactgggtccttgcagagagagaggacaagtggatccaacagccttcgctccaggggaatcagggcatcgcctccttttctgggacgactcggaccgatg

SEQ ID NO: 11604 - DNA, 203 bp, Homo sapiens
  source 1..203: mol_type = other DNA
ggcgcgccagtccttgtgtgggccaacctactaacaggtgggtgggtatggtgtgtggtttcactcagttcttctcatggggtttctctgagctccattcataccagaaagggagcagcgttcgcgttcagggtggatccaacagccttcgctccaggggaatcagggcatcgcctccttttctgggacgactcggaccgatg

SEQ ID NO: 11605 - DNA, 203 bp, Homo sapiens
  source 1..203: mol_type = other DNA
ggcgcgccagtcctagaggagaccaacctactaacaggtgggtgggtatggtgtgtggtttcactcagttcttctcatggggtttctctgagctccattcataccagaaagggagcaggagagagaggacaagtggatccaacagccttcgctccaggggtgagcctaaccatgctccttttctgggacgactcggaccgatg

SEQ ID NO: 11606 - DNA, 203 bp, Homo sapiens
  source 1..203: mol_type = other DNA
ggcgcgccagtcctcttgacagccaacctactaatgaacactcaacgttggtgtgtggtttcactcagttcttctcatggggtttctctgagctccattcataccagaaagggagcaggagagagaggacaagtggatccaacagccttcgctccaggggaatcagggcatcgcctccttttctgggacgactcggaccgatg

SEQ ID NO: 11607 - DNA, 203 bp, Homo sapiens
  source 1..203: mol_type = other DNA
ggcgcgccagtcctcgagtaacccaactccacttatattggaagggatggacaggtggctcttgccctttagactacagttcccagcatgcccaggcgattgcgtcccagaaccgacgtcccaccgccttcccacatcggatcgcagggctcccaaaatggcctataacattcacgtgaatggagtcccgactcggaccgatg

SEQ ID NO: 11608 - DNA, 203 bp, Homo sapiens
  source 1..203: mol_type = other DNA
ggcgcgccagtcctgtcaaatgccaactccactttgggctccctatcccttggacatatgtctgccctttagactacagttcccagcatgcccaggcgattgcgtcccagaaccgacgtcccaccgccttcccacatcggatcgcagggctcccaaaatggcctataacattcacgtgaatggagtcccgactcggaccgatg

SEQ ID NO: 11609 - DNA, 203 bp, Homo sapiens
  source 1..203: mol_type = other DNA
ggcgcgccagtcctattacggaccaactccactttgggctccctatccggacaggtggctcttgccctttagactacagttcccagcatgcccaggcgattgcgtcccagaaccgacgtcccaccgccttcccacatcggatcgcagggctcccaaaatggcctataacattcatcgtcccctgcagtcgactcggaccgatg

SEQ ID NO: 11610 - DNA, 203 bp, Homo sapiens
  source 1..203: mol_type = other DNA
ggcgcgccagtcctctacgcggccaactccactttgggctccctatccggacaggtggctcttgccctttagactacagttcccagcatgcccaggcgattgcgtcccagaaccgacgtcccaccgccttccgtagcaccggacacgggctcccaaaatggcctataacattcacgtgaatggagtcccgactcggaccgatg

SEQ ID NO: 11611 - DNA, 203 bp, Homo sapiens
  source 1..203: mol_type = other DNA
ggcgcgccagtcctcgattccaccaagccccttgggtcgcgtatctggctggatccagcctctccgcatcttgatccaagtttgctagggaggaggcatccctacaccctatgactacaggcctgattctcttctttcagtcagggcgacccttgggcgctggagtacgcttgggactggggctgcgacgactcggaccgatg

SEQ ID NO: 11612 - DNA, 203 bp, Homo sapiens
  source 1..203: mol_type = other DNA
ggcgcgccagtcctgtgcagagccaagccccttgggtcgcgtatctggctggatccagcctctccgcatcttgatcttttcccctcttctaggaggcatccctaataagctgcggacaaggcctgattctcttctttcagtcagggcgacccttgggcgctggagtacgcttgggactggggctgcgacgactcggaccgatg

SEQ ID NO: 11613 - DNA, 203 bp, Homo sapiens
  source 1..203: mol_type = other DNA
ggcgcgccagtcctccatacggccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttggactgtcaaagctatcgactcggaccgatg

SEQ ID NO: 11614 - DNA, 203 bp, Homo sapiens
  source 1..203: mol_type = other DNA
ggcgcgccagtcctcggtcatcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgacgactcggaccgatg

SEQ ID NO: 11615 - DNA, 203 bp, Homo sapiens
  source 1..203: mol_type = other DNA
ggcgcgccagtccttattgtgcccaataaactcagtattaaggcttgttgtgttggacaaggtgccctatttagggtgaggagccttactctagttgggtcaacatcctccattggataggaacagctatattgggtagttgtagcagttgtattcaaatgaatgcagcgttccgaaatatcatacctcgactcggaccgatg

SEQ ID NO: 11616 - DNA, 203 bp, Homo sapiens
  source 1..203: mol_type = other DNA
ggcgcgccagtccttctcctgaccaataaactctggtgtaaggcttagagtgatggtcgaggtgccctatttagggcattctagaaaaagggcagccccaccaaatcctctattggataggaacagctgtactgggcagttacagcagtcgtatggtaacacatgcggcgttccgaaataccatgcctcgactcggaccgatg

SEQ ID NO: 11617 - DNA, 203 bp, Homo sapiens
  source 1..203: mol_type = other DNA
ggcgcgccagtccttttagctaccaataaactctggtgtaaggcttagagtgatggtcgaggtgccctatttagggtgaggagcctcggtggcagccccaccaaatcctctattggataggaacagctgtactgggcagttacagcagtcgtatggtaaccatgatccacacgagaaataccatgcctcgactcggaccgatg

SEQ ID NO: 11618 - DNA, 203 bp, Homo sapiens
  source 1..203: mol_type = other DNA
ggcgcgccagtcctgaccatgtccaataaactctggtgtaaggcttagagtgatggtcgaggtgccctatttagggtgaggagcctcggtggcagccccaccaaatcctctattggataggaacagctgtactgggcagttacagcgcggcatcaaatggacatgcggcgttccgaaataccatgcctcgactcggaccgatg

SEQ ID NO: 11619 - DNA, 203 bp, Homo sapiens
  source 1..203: mol_type = other DNA
ggcgcgccagtcctgccgcgggccaataaactctggtgtaaggcttagagtgatggtcgaggtgccctatttagggtgaggagcctcggtggcagccccaccaacaaggtgtagcagcaggaacagctgtactgggcagttacagcagtcgtatggtaacacatgcggcgttccgaaataccatgcctcgactcggaccgatg

SEQ ID NO: 11620 - DNA, 203 bp, Homo sapiens
  source 1..203: mol_type = other DNA
ggcgcgccagtcctagttagcgccaataaactctggtgtaaggcttaggtatcctcctcccctgccctatttagggtgaggagcctcggtggcagccccaccaaatcctctattggataggaacagctgtactgggcagttacagcagtcgtatggtaacacatgcggcgttccgaaataccatgcctcgactcggaccgatg

SEQ ID NO: 11621 - DNA, 203 bp, Homo sapiens
  source 1..203: mol_type = other DNA
ggcgcgccagtccttcacccgcccaataaacttgaatgtaaggcttgaaacagtggtctaggtgccctatttagggtgaggagcctagctggcagccccagtgaatcctctattggatagaaaccgctatatcgggtagctatagcagtcggatagtaatatatccggcgtttcgaaataccatacctcgactcggaccgatg

SEQ ID NO: 11622 - DNA, 203 bp, Homo sapiens
  source 1..203: mol_type = other DNA
ggcgcgccagtcctcataaataccaataaacttgaatgtaaggcttgaaacagtggtctaggtgccctatttagggtgaggagcctagctggcagccccagtgaatcctctattggatagaaaccgctatatcgggtagctatagcagtcggatagtaatatatccggcgtttctcgcccgggagtggcgactcggaccgatg

SEQ ID NO: 11623 - DNA, 203 bp, Homo sapiens
  source 1..203: mol_type = other DNA
ggcgcgccagtcctagtccgccccaataaacttggtgtcgtactccagaacagtggtctaggtgccctatttagggtgaggagcctagctggcagccccagtgaatcctctattggatagaaaccgctatatcgggtagctatagcagtcggatagtaatatatccggcgtttcgaaataccatacctcgactcggaccgatg

SEQ ID NO: 11624 - DNA, 203 bp, Homo sapiens
  source 1..203: mol_type = other DNA
ggcgcgccagtcctgaacctggccaatcggtgtgctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggcgactcggaccgatg

SEQ ID NO: 11625 - DNA, 203 bp, Homo sapiens
  source 1..203: mol_type = other DNA
ggcgcgccagtccttgaaaccaccacaagccacagcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttacttcactccagatccgcgactcggaccgatg

SEQ ID NO: 11626 - DNA, 203 bp, Homo sapiens
  source 1..203: mol_type = other DNA
ggcgcgccagtccttgttatggccacaagccacagcgctgagctgcaggcgcggcgaaacttccctctacccgcccggcccgcggcgcgcaccgttggcgctggacgcttcctccttggaagcgcctctccctcagttatggagaacctggtatgtacctcacttcctcttactatgaattcttcagacgactcggaccgatg

SEQ ID NO: 11627 - DNA, 203 bp, Homo sapiens
  source 1..203: mol_type = other DNA
ggcgcgccagtcctgcccgtgaccacaagccacagcgctgagctgcaggcgcggcgaaacttccctctacccgcccggcccgcggcgcgcaccgttggcgctgggtctgggtctgccagaagcgcctctccctcagttatggagaaaacttgtatagatgcacttcctcttactatgaattcttcagacgactcggaccgatg

SEQ ID NO: 11628 - DNA, 203 bp, Homo sapiens
  source 1..203: mol_type = other DNA
ggcgcgccagtccttcctggctccacaagccacagcgctgagctgcaggcgcggcgaaacttccctctacccgcccggcccgcggcgcgcggacagccgtgcttacgcttcctccttggaagcgcctctccctcagttatggagaaaacttgtatagatgcacttcctcttactatgaattcttcagacgactcggaccgatg

SEQ ID NO: 11629 - DNA, 203 bp, Homo sapiens
  source 1..203: mol_type = other DNA
ggcgcgccagtccttgccgaccccacaagccacagcgctgagctgcaggcgcggcgaaacttccctctacccgccctagggttcaacgttaccgttggcgctggacgcttcctccttggaagcgcctctccctcagttatggagaaaacttgtatagatgcacttcctcttactatgaattcttcagacgactcggaccgatg

SEQ ID NO: 11630 - DNA, 203 bp, Homo sapiens
  source 1..203: mol_type = other DNA
ggcgcgccagtcctgcgtgtaaccacaatgccgtggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagccgactcggaccgatg

SEQ ID NO: 11631 - DNA, 203 bp, Homo sapiens
  source 1..203: mol_type = other DNA
ggcgcgccagtcctgacaaaccccacacgggcccgtcatgtgtgcaaccccagcacggcgacagattgtgaggtgtcactttaaagtgacattgaaactggtacccacacactggtgacaggctaaggatgcccttcaggtaccccgaggtaacacgcgacactcgggatctgagaaggggactggggcgactcggaccgatg

SEQ ID NO: 11632 - DNA, 203 bp, Homo sapiens
  source 1..203: mol_type = other DNA
ggcgcgccagtccttcagaagaccacacgggcccgtcatgtgtgcaaccccagcacggcgactttactgcgaaacccactttaaagtgacattgaaactggtacccacacactggtgaagttaggcatcacgccttcaggtaccccgaggtaacacgcgacactcgggatctgagaaggggactggggcgactcggaccgatg

SEQ ID NO: 11633 - DNA, 203 bp, Homo sapiens
  source 1..203: mol_type = other DNA
ggcgcgccagtccttggactgaccacacgggcccgtcatgtgtgcaaccccagcacggcgactttactgcgaaacccactttaaagtgacattgaaactggtacccacacactggtgacaggctaaggatgcccttcaggtaccccgaggtaacacgcgacactcgggatctgatctataagggcttccgactcggaccgatg

SEQ ID NO: 11634 - DNA, 203 bp, Homo sapiens
  source 1..203: mol_type = other DNA
ggcgcgccagtcctgtttggacccacacgggcccgtcatgtgtgcaaccccagcacggcgactttactgcgaaacccactttaaagtgacattgaaactggtactgtttagagccgaccaggctaaggatgcccttcaggtaccccgaggtaacacgcgacactcgggatctgagaaggggactggggcgactcggaccgatg

SEQ ID NO: 11635 - DNA, 203 bp, Homo sapiens
  source 1..203: mol_type = other DNA
ggcgcgccagtcctgcagattcccacacgggcccgtcatgtgtgcaaccccagcacggcgactttactgcgaaacccactttaaagtgacgggatggaaatgttccacacactggtgacaggctaaggatgcccttcaggtaccccgaggtaacacgcgacactcgggatctgagaaggggactggggcgactcggaccgatg

SEQ ID NO: 11636 - DNA, 203 bp, Homo sapiens
  source 1..203: mol_type = other DNA
ggcgcgccagtcctatggacgcccacacgggcccgtcatgtgtgcaacggtctgcgatgttgtttactgcgaaacccactttaaagtgacattgaaactggtacccacacactggtgacaggctaaggatgcccttcaggtaccccgaggtaacacgcgacactcgggatctgagaaggggactggggcgactcggaccgatg

SEQ ID NO: 11637 - DNA, 203 bp, Homo sapiens
  source 1..203: mol_type = other DNA
ggcgcgccagtcctggctttcaccaccagcctcggccagctggttgtggaccagccgtgaccgacctatcaggtttcaacctcaccgtccaatgggctgcagccacctctctccagtgaggtctgagacccagccttaacgaggctacccccttccaggtccggccgtagcacctccgcgccgtcgcccgactcggaccgatg

SEQ ID NO: 11638 - DNA, 203 bp, Homo sapiens
  source 1..203: mol_type = other DNA
ggcgcgccagtcctacagatagccaccagcctcggccagctggttgtggaccagccgtgacctggggcaacccagccaacctcaccgtccaatgggctgcagccacctctctccagtgaggtctgagacccagccttaacgaggctacccccttccaggaatcatgacagcacctccgcgccgtcgcccgactcggaccgatg

SEQ ID NO: 11639 - DNA, 203 bp, Homo sapiens
  source 1..203: mol_type = other DNA
ggcgcgccagtccttgcgtatcccaccagcctcggccagctggttgtggaccagccgtgacctggggcaacccagccaacctcaccgtccaatgggctgcagccacctctctccagtgaggtctgagacccagccttaacgaggctgagtttgcgagttgccggccgtagcacctccgcgccgtcgcccgactcggaccgatg

SEQ ID NO: 11640 - DNA, 203 bp, Homo sapiens
  source 1..203: mol_type = other DNA
ggcgcgccagtccttactaccaccaccagcctcggccagctggttgtggaccagccgtgacctggggcaacccagccaacctcaccgtccaatgggctgcagccacctctctccagtgtaccagtttgaggtgccttaacgaggctacccccttccaggtccggccgtagcacctccgcgccgtcgcccgactcggaccgatg

SEQ ID NO: 11641 - DNA, 203 bp, Homo sapiens
  source 1..203: mol_type = other DNA
ggcgcgccagtcctgattagatccaccagcctcggccagctggttgtggaccagccgtgacctggggcaacccagccaacctcaccgtccaatgggctgcagccggtctgacattaccaggtctgagacccagccttaacgaggctacccccttccaggtccggccgtagcacctccgcgccgtcgcccgactcggaccgatg

SEQ ID NO: 11642 - DNA, 203 bp, Homo sapiens
  source 1..203: mol_type = other DNA
ggcgcgccagtccttcggatacccacccctaatgagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 11643 - DNA, 203 bp, Homo sapiens
  source 1..203: mol_type = other DNA
ggcgcgccagtcctatagcaggccacggctagccttgacaaccgccagtgtgttcaagattcagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 11644 - DNA, 203 bp, Homo sapiens
  source 1..203: mol_type = other DNA
ggcgcgccagtcctgacatattccactaccagccaacaagtcacgggcgtcgagacaactatttttgaggtatctgaggctaccccacagcactctctggcattggcaagactcgtggctgtgacccatgggcctctgaggaggcgttgtaagtccgcccagctccccacttgctgtgctctcactcacgactcggaccgatg

SEQ ID NO: 11645 - DNA, 203 bp, Homo sapiens
  source 1..203: mol_type = other DNA
ggcgcgccagtcctgcctggtcccactaccagccggagccagggcctggtcgagacaactatttttgaggtatctgaggctaccccacagcactctctggcattataggcgaggacacctgtgacccatgggcctctgaggaggcgttgtaagtccgcccagctccccacttgctgtgctctcactcacgactcggaccgatg

SEQ ID NO: 11646 - DNA, 203 bp, Homo sapiens
  source 1..203: mol_type = other DNA
ggcgcgccagtcctaagtctgaccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgcaagtaaggtgtaagcgactcggaccgatg

SEQ ID NO: 11647 - DNA, 203 bp, Homo sapiens
  source 1..203: mol_type = other DNA
ggcgcgccagtcctagtctacaccactaccagccggagccagggcctggtcgagacaactatttttgaggtatctgaggctaccccacagcactctctggcattggcaagactcgtggctgtgacccatgggcctctgaggaggcgttgtaagtccgcccgatcgaggtgcatatgtgctctcactcacgactcggaccgatg

SEQ ID NO: 11648 - DNA, 203 bp, Homo sapiens
  source 1..203: mol_type = other DNA
ggcgcgccagtcctatcaagagccactaccagccggagccagggcctggtcgagacaactatttttgaggtatctgaggctaccccacagcactctctggcattggcaagactcgtggtctgtctgggaaaacctctgaggaggcgttgtaagtccgcccagctccccacttgctgtgctctcactcacgactcggaccgatg

SEQ ID NO: 11649 - DNA, 203 bp, Homo sapiens
  source 1..203: mol_type = other DNA
ggcgcgccagtcctataaagttccactaccagccggagccagggcctggtcgagacaactatttttgaggtatctgtctaacggagcatacactctctggcattggcaagactcgtggctgtgacccatgggcctctgaggaggcgttgtaagtccgcccagctccccacttgctgtgctctcactcacgactcggaccgatg

SEQ ID NO: 11650 - DNA, 203 bp, Homo sapiens
  source 1..203: mol_type = other DNA
ggcgcgccagtcctctgcaataccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtgctgggtggttgaagcgactcggaccgatg

SEQ ID NO: 11651 - DNA, 203 bp, Homo sapiens
  source 1..203: mol_type = other DNA
ggcgcgccagtcctgaattccgccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtggcccagcaagtgcacgactcggaccgatg

SEQ ID NO: 11652 - DNA, 203 bp, Homo sapiens
  source 1..203: mol_type = other DNA
ggcgcgccagtccttcttcacgccagaactttacacagaaaaggtgctcaaaggatatttgtttaatgaatgtggtatgctgacatttaagttacctccgtagcgtagaacttcatggaggaacacggagtgacccaaaccgaacatatggctaccatagaagcacatgcagtggcccagcaagtgcacgactcggaccgatg

SEQ ID NO: 11653 - DNA, 203 bp, Homo sapiens
  source 1..203: mol_type = other DNA
ggcgcgccagtcctaccaactgccagaagacagcggggcgttccttgctgcatttctattggttggcgtttgttactcccagccaatagaaagtgagcgcaactttttatgccaaaatggcgatgcctaccacctagaactggattgtgcgctggccgccaccgctgccacctgctcagagtgaaatacgactcggaccgatg

SEQ ID NO: 11654 - DNA, 203 bp, Homo sapiens
  source 1..203: mol_type = other DNA
ggcgcgccagtcctaatcacttccagaagacagcggggcgttccttgctgcatttctattggttggcgtttgttactcccagccaatagaaagtgagcttcttgacaagtgccaaaattagccctaacgaggcctagaactggattgtgcgctggccgccaccgctgccacctgctcagagtgaaatacgactcggaccgatg

SEQ ID NO: 11655 - DNA, 203 bp, Homo sapiens
  source 1..203: mol_type = other DNA
ggcgcgccagtccttgaaccacccagaatcaagtgttccgcgtgattgaagacaccccctcgcttcgagcctgtctgcacatccaataaaatagctggattataactcctcttctttctctgggggccgtggggtgggagctggggcgagaggtgccgttggcccccgttgcttttcctctgggaaggcgactcggaccgatg

SEQ ID NO: 11656 - DNA, 203 bp, Homo sapiens
  source 1..203: mol_type = other DNA
ggcgcgccagtcctttgtcctgccagaatcaagtgttccgcgtgattgaagacaccccctcgtccaagaatgcaaacgggccgtggggttatagctggattataactcctcttctttctctgggggccgtggggtgggagctggggcgagaggtgccgttggcccccgttgcttttcctctgggaaggcgactcggaccgatg

SEQ ID NO: 11657 - DNA, 203 bp, Homo sapiens
  source 1..203: mol_type = other DNA
ggcgcgccagtccttctctgagccagaatcaagtgttccgcgtgattgaagacaccccctcgtccaagaatgcaaagcacatccaataaaatagctggattataactcctcttctttcatccccaaggtataggtgggagctggggcgagaggtgccgttggcccccgttgcttttcctctgggaaggcgactcggaccgatg

SEQ ID NO: 11658 - DNA, 203 bp, Homo sapiens
  source 1..203: mol_type = other DNA
ggcgcgccagtcctagattcgtccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttaattctatttcgcacgactcggaccgatg

SEQ ID NO: 11659 - DNA, 203 bp, Homo sapiens
  source 1..203: mol_type = other DNA
ggcgcgccagtccttcgatcgtccagaatcaagtgttccgcgtgattgaagacaccccctcgtccaagaatgcaaagcacatccaataaaggcttacccacgccactcctcttctttctctgggggccgtggggtgggagctggggcgagaggtgccgttggcccccgttgcttttcctctgggaaggcgactcggaccgatg

SEQ ID NO: 11660 - DNA, 203 bp, Homo sapiens
  source 1..203: mol_type = other DNA
ggcgcgccagtccttctatgctccagaatcaagtgttccgcgtgattgtcactcagttagactccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 11661 - DNA, 203 bp, Homo sapiens
  source 1..203: mol_type = other DNA
ggcgcgccagtcctaatctttaccagacagtggctcagccttcaggacctgagcttccagcagccgaagacacctattcacacaagatggtaaaaacaaatcataggcgctgtcgcacaaaattcacagaagaacagttgaaaatcctcatcaataccttcaatcaaaagccttacccaggttatgctcgactcggaccgatg

SEQ ID NO: 11662 - DNA, 203 bp, Homo sapiens
  source 1..203: mol_type = other DNA
ggcgcgccagtcctacttgtcaccagacagtggctcagccttcaggactctcttccagcatggccgaagacacctattcacacaagatggtaaaaacaaatcataggcgctgtcgcacaaaattcacagaagaacagttgaaaatcctcatcaataccttcaatcaaaagccttacccaggttatgctcgactcggaccgatg

SEQ ID NO: 11663 - DNA, 203 bp, Homo sapiens
  source 1..203: mol_type = other DNA
ggcgcgccagtcctgtcgtcaaccagacagtggctcagccttcaggactctcttccagcatggccgaagacacctattcacacaagatggtaaaaacaaatcataggcgctgtcgcacaaaattcacagaagcttgtaacgtggaactcatcaataccttcaatcaaaagccttacccaggttatgctcgactcggaccgatg

SEQ ID NO: 11664 - DNA, 203 bp, Homo sapiens
  source 1..203: mol_type = other DNA
ggcgcgccagtcctactccagcccagccttgaactcgctggacagagcgttgctttctctaagcctggaagtgcccgctgagaaagggagaagacagcagaggggttgccgagagcatatatcagagggaccccctgaagctggtggccactttcagacaaatacttcaaggagagaaaaaagctgttcgactcggaccgatg

SEQ ID NO: 11665 - DNA, 203 bp, Homo sapiens
  source 1..203: mol_type = other DNA
ggcgcgccagtccttaaggaacccagccttgaactcgctggacagagctacagacctatggggcctggaagtgccccggagttcctcttcaagacagcagaggggttgccgagagcatatatcagagggaccccctgaagctggtggccactttcagacaaatacttcaaggagagaaaaaagctgttcgactcggaccgatg

SEQ ID NO: 11666 - DNA, 203 bp, Homo sapiens
  source 1..203: mol_type = other DNA
ggcgcgccagtcctatcccgtgccagccttgaactcgctggacagagctacagacctatggggcctggaagtgcccgctgagaaagggagaagacagcagaggggttgccgagagcatatatcagagggaccccctgaagctggtggccactttcagacaaatacttcaaggaggcggtggcctcacgcgactcggaccgatg

SEQ ID NO: 11667 - DNA, 203 bp, Homo sapiens
  source 1..203: mol_type = other DNA
ggcgcgccagtcctgcgctgggccagccttgaactcgctggacagagctacagacctatggggcctggaagtgcccgctgagaaagggagaagacagcagaggggttgccgagagcatatatcagagggaccccctgaagctggtggccactttcagacagtgctgcatgacctagaaaaaagctgttcgactcggaccgatg

SEQ ID NO: 11668 - DNA, 203 bp, Homo sapiens
  source 1..203: mol_type = other DNA
ggcgcgccagtcctatgttccaccagccttgaactcgctggacagagctacagacctatggggcctggaagtgcccgctgagaaagggagaagacagcagagggtaccgttgcccgtaatatcagagggaccccctgaagctggtggccactttcagacaaatacttcaaggagagaaaaaagctgttcgactcggaccgatg

SEQ ID NO: 11669 - DNA, 203 bp, Homo sapiens
  source 1..203: mol_type = other DNA
ggcgcgccagtcctcaccacaaccagctgattaccgacgagaattcaacctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcacccgactcggaccgatg

SEQ ID NO: 11670 - DNA, 203 bp, Homo sapiens
  source 1..203: mol_type = other DNA
ggcgcgccagtcctcgtttgttccagctgattacttgtcctgcgagttcctcttgagactggccgaaaggcagccacggggccaccaaggcggcgcagcgctgcatgcggcaaggggaaaaatccttcgggtagggttatcctcttatcccttcccttaggagcatgagtgtggtcgacacattcacccgactcggaccgatg

SEQ ID NO: 11671 - DNA, 203 bp, Homo sapiens
  source 1..203: mol_type = other DNA
ggcgcgccagtcctaaatggcaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttagatagggcgtgaacctcgacacattcacccgactcggaccgatg

SEQ ID NO: 11672 - DNA, 203 bp, Homo sapiens
  source 1..203: mol_type = other DNA
ggcgcgccagtccttggcattcccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtgggtactgatgcagagcgactcggaccgatg

SEQ ID NO: 11673 - DNA, 203 bp, Homo sapiens
  source 1..203: mol_type = other DNA
ggcgcgccagtcctcccaccgaccagctgattacttgtcctgcgagttcctcttgagactggccgaaaggcagccacggggccaccaaggcggcgcagcgctgcatgcggcaaggggactttaggagttcaggacccctggtggcaatcccttcccttaggagcatgagtgtggtcgacacattcacccgactcggaccgatg

SEQ ID NO: 11674 - DNA, 203 bp, Homo sapiens
  source 1..203: mol_type = other DNA
ggcgcgccagtcctctcttctaccagctgattacttgtcctgcgagttcctcttgagactggccgaaaggcagccacggggccaccaaggcggcgcagcgctgctgcgtatgttttagaaaatccttcgggtgacccctggtggcaatcccttcccttaggagcatgagtgtggtcgacacattcacccgactcggaccgatg

SEQ ID NO: 11675 - DNA, 203 bp, Homo sapiens
  source 1..203: mol_type = other DNA
ggcgcgccagtcctacatactcccaggccgccccgaggcttggggtctctcccactcccagagcgcccggggccgaacagcgggggcacacggggcgctgccgaagtgcaaggccacggccagagctcgagcccgacgcgctgtctggagtcgtaggaccctgacgtggctgaagcggccccgggagccgactcggaccgatg

SEQ ID NO: 11676 - DNA, 203 bp, Homo sapiens
  source 1..203: mol_type = other DNA
ggcgcgccagtcctgagcattgccaggccgccccgaggcttggggtcttcgaaggataatcggcgcccggggccgaacagcgggggcacacggggcgctgccgaagtgcaaggccacggccagagctcgagcccgacgcgctgtctcttccgcggcttagctgacgtggctgaagcggccccgggagccgactcggaccgatg

SEQ ID NO: 11677 - DNA, 203 bp, Homo sapiens
  source 1..203: mol_type = other DNA
ggcgcgccagtccttgtaagagccaggccgccccgaggcttggggtcttcgaaggataatcggcgcccggggccgatttcgctacaagagcggggcgctgccgaagtgcaaggccacggccagagctcgagcccgacgcgctgtctggagtcgtaggaccctgacgtggctgaagcggccccgggagccgactcggaccgatg

SEQ ID NO: 11678 - DNA, 203 bp, Homo sapiens
  source 1..203: mol_type = other DNA
ggcgcgccagtcctggtgtacgccaggtgcgtacgcgacggagcggggtgtgaagatggcggacgaagaggccgagcaggagaggttgagttgcggcgaaggcggctgcgtcgcggagctgcagcgcctgggcgagcggctccaggagctggagctacagctgcgggagagccgggtaccggccgtggcgactcggaccgatg

SEQ ID NO: 11679 - DNA, 203 bp, Homo sapiens
  source 1..203: mol_type = other DNA
ggcgcgccagtccttatgacacccaggtgcgtacgcgacggagcggggtgtgaagatggcggctcccagactatgacaggagaggttgagttgcggcgaaggcggctgcgtcgcggagctgcagcgcctgggcgagcggctccaggagctggagctacagctgcgggagagccgggtaccggccgtggcgactcggaccgatg

SEQ ID NO: 11680 - DNA, 203 bp, Homo sapiens
  source 1..203: mol_type = other DNA
ggcgcgccagtcctgtcctggcccagttcccatgcgacaagaacagtttcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 11681 - DNA, 203 bp, Homo sapiens
  source 1..203: mol_type = other DNA
ggcgcgccagtcctacccaagtccatgagggggatccaatttaggaaacattctgtttaagagttgacaaggtctcaatgaataatggacaagcaacaattacaagaaatggaggaaggttcgaaatcaggtgtcgtcacttggaccgtgactacaccatgccactaccaaatgctactagtaatgatcgactcggaccgatg

SEQ ID NO: 11682 - DNA, 203 bp, Homo sapiens
  source 1..203: mol_type = other DNA
ggcgcgccagtccttccactccccattggacctctcaagacttgattgatgcaattcaaaattttctacaacatctaggtattactgatgggcgcaggcttcagtatatattagtgtcataacactcaatcctaatgcttaccacatcatcaaactattaactcaaacaattcaagccatgggacaaacgactcggaccgatg

SEQ ID NO: 11683 - DNA, 203 bp, Homo sapiens
  source 1..203: mol_type = other DNA
ggcgcgccagtcctcacggatgccattttgtgaagagacgaagactgactatcaggcagatgatttctggcctcgagccgcagtcagcttctccccgtagaacccggcagtaggagacttagaatcgaatctcttctccctcccgcctcctgtttttggctttttgagaaaccttatcatccaacacacgactcggaccgatg

SEQ ID NO: 11684 - DNA, 203 bp, Homo sapiens
  source 1..203: mol_type = other DNA
ggcgcgccagtccttaaagtaaccattttgtgaagagacgaagactgagctgttttggctgcatttctggcctcgaatgcataaatcagcctccccgtagaacccggcagtaggagacttagaatcgaatctcttctccctcccgcctcctgtttttggctttttgagaaaccttatcatccaacacacgactcggaccgatg

SEQ ID NO: 11685 - DNA, 203 bp, Homo sapiens
  source 1..203: mol_type = other DNA
ggcgcgccagtcctcgacacagccattttgtgaagagacgaagactgagctgttttggctgcatttctggcctcgagccgcagtcagcttctccccgtagaacccggcagtaggagacactcccctccgctgcttctccctcccgcctcctgtttttggctttttgagaaaccttatcatccaacacacgactcggaccgatg

SEQ ID NO: 11686 - DNA, 203 bp, Homo sapiens
  source 1..203: mol_type = other DNA
ggcgcgccagtcctggttagtcccattttgtgaagagacgaagactgagctgttttggctgcatttctggcctcgagccgcagtcagcttctccccgtagaacccggcagtaggagacttagaatcgaatctcttctccctcccgcaaatgtagccctcatttttgagaaaccttatcatccaacacacgactcggaccgatg

SEQ ID NO: 11687 - DNA, 203 bp, Homo sapiens
  source 1..203: mol_type = other DNA
ggcgcgccagtccttaggtggacccaatagatcactaatacatagcacttatttctcttgctttacggcaggtgaagtaagaagagccatcagaggggaaaagttattgtcctgctgcaactatccccaagctcataaagcacaggtaccatcacttcaatacctagccctagtagtagtacaacaaacgactcggaccgatg

SEQ ID NO: 11688 - DNA, 203 bp, Homo sapiens
  source 1..203: mol_type = other DNA
ggcgcgccagtcctcgcgtggacccacccggcaggggaggcggcctaacgactctttcactgggtcgccatcttggtcccgggactccaaggaacttaggaatttagtctgcttaggtgagagtctgtaccacctgggaactgccaaagcaacacagtgtctgagaaaggtcctgttttgggccttctcgactcggaccgatg

SEQ ID NO: 11689 - DNA, 203 bp, Homo sapiens
  source 1..203: mol_type = other DNA
ggcgcgccagtcctgatgccagcccacccggcaggggaggcggcctaagccacagcagcagcccaacaatctcctatcccgggactccaaggaacttaggaatttagtctgcttaggtgagagtctgtaccacctgggaactgccaaagcaacacagtgtctgagaaaggtcctgttttgggccttctcgactcggaccgatg

SEQ ID NO: 11690 - DNA, 203 bp, Homo sapiens
  source 1..203: mol_type = other DNA
ggcgcgccagtcctggattatccccacccggcaggggaggcggcctaagccacagcagcagcggtcgccatcttggtcccgggactccaaggaacttaggaattctcctgttagcaaagagagtctgtaccacctgggaactgccaaagcaacacagtgtctgagaaaggtcctgttttgggccttctcgactcggaccgatg

SEQ ID NO: 11691 - DNA, 203 bp, Homo sapiens
  source 1..203: mol_type = other DNA
ggcgcgccagtcctagaaccgacccacccggcagtatctagcttaatggccacagcagcagcggtcgccatcttggtcccgggactccaaggaacttaggaatttagtctgcttaggtgagagtctgtaccacctgggaactgccaaagcaacacagtgtctgagaaaggtcctgttttgggccttctcgactcggaccgatg

SEQ ID NO: 11692 - DNA, 203 bp, Homo sapiens
  source 1..203: mol_type = other DNA
ggcgcgccagtcctaggagtgtcccattgttccactagaatgctcatagcaggctcctccggaagaccaggggcagacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 11693 - DNA, 203 bp, Homo sapiens
  source 1..203: mol_type = other DNA
ggcgcgccagtccttcccataacccattgttccaggcaggattcagccatgtaacataagttaagaccaggggcagacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 11694 - DNA, 203 bp, Homo sapiens
  source 1..203: mol_type = other DNA
ggcgcgccagtcctcccgagctcccattgttccaggcaggattcagccgcaggctcctccggaagaccaggggcagacggggcggtggcggggtcgtgcccagtgggaggggtcgggtctgcccaatgggttctcccgggcgggggagcccttagcgacccagcagctctcagggccttgggctcatccgactcggaccgatg

SEQ ID NO: 11695 - DNA, 203 bp, Homo sapiens
  source 1..203: mol_type = other DNA
ggcgcgccagtcctggtccgtgcccattgttccaggcaggattcagccgcaggctcctccggaagaccaggggcagacggggcggtggcgtatgttaatagctggggaggggtcgggtctgcccaatgggttctcccgggcggggggcggggctctatttcagcagctctcagggccttgggctcatccgactcggaccgatg

SEQ ID NO: 11696 - DNA, 203 bp, Homo sapiens
  source 1..203: mol_type = other DNA
ggcgcgccagtcctttatgtgacccattgttccaggcaggattcagccgcaggctcctccgggttcggttcctggcacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 11697 - DNA, 203 bp, Homo sapiens
  source 1..203: mol_type = other DNA
ggcgcgccagtcctatgtgagaccccaacaatcgactcagcttcaaaaagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 11698 - DNA, 203 bp, Homo sapiens
  source 1..203: mol_type = other DNA
ggcgcgccagtcctcagtatttccccaacaatcgctgtgtgccgctttagtgcgctcgccgtaatagtccgaccattgctttagctccttctcgcctgatccttctgtctctcccaaccccggacacccggcttcgactggttatatcttcggtgttcttttcctctcttcttctttcgcggttcagccgactcggaccgatg

SEQ ID NO: 11699 - DNA, 203 bp, Homo sapiens
  source 1..203: mol_type = other DNA
ggcgcgccagtccttccctgtaccccaacaatcgctgtgtgccgctttagtgcgctcgccgtcggctctacctgcggctggctataatggctcgcctgatccttctgtctctcccaaccccggacacccggcttcgactggttatatcttcggtgttcttttcctctcttcttctttcgcggttcagccgactcggaccgatg

SEQ ID NO: 11700 - DNA, 203 bp, Homo sapiens
  source 1..203: mol_type = other DNA
ggcgcgccagtcctctttggcgccccaacaatcgctgtgtgccgctttagtgcgctcgccgtcggctctacctgcgtgctttagctccttctcgcctgatccttctgtctctcccaacaagttttcagaaaattcgactggttatatcttcggtgttcttttcctctcttcttctttcgcggttcagccgactcggaccgatg

SEQ ID NO: 11701 - DNA, 203 bp, Homo sapiens
  source 1..203: mol_type = other DNA
ggcgcgccagtccttatactgtccccaacaatcgctgtgtgccgctttagtgcgctcgccgtcggctctacctgcgtgctttagctccttctcgcctgatccttctgtctctcccaaccccggacacccggcaattcaactgctgctcttcggtgttcttttcctctcttcttctttcgcggttcagccgactcggaccgatg

SEQ ID NO: 11702 - DNA, 203 bp, Homo sapiens
  source 1..203: mol_type = other DNA
ggcgcgccagtcctcggagaccccccaacaatcgctgtgtgccgctttagtgcgctcgccgtcggctctacctgcgtgctttagctccttctcgcctgatccttctgtctctcccaaccccggacacccggcttcgactggttatagtcatacatcaaagttcctctcttcttctttcgcggttcagccgactcggaccgatg

SEQ ID NO: 11703 - DNA, 203 bp, Homo sapiens
  source 1..203: mol_type = other DNA
ggcgcgccagtcctaagagacaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttcagcttgcagctgctcgactcggaccgatg

SEQ ID NO: 11704 - DNA, 203 bp, Homo sapiens
  source 1..203: mol_type = other DNA
ggcgcgccagtcctgtacggccccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 11705 - DNA, 203 bp, Homo sapiens
  source 1..203: mol_type = other DNA
ggcgcgccagtcctctgcacacccccaacaatcgctgtgtgccgctttagtgcgctcgccgtcggctctacctgcgtgctttagctccttgcgaatatgaaaccctgtctctcccaaccccggacacccggcttcgactggttatatcttcggtgttcttttcctctcttcttctttcgcggttcagccgactcggaccgatg

SEQ ID NO: 11706 - DNA, 203 bp, Homo sapiens
  source 1..203: mol_type = other DNA
ggcgcgccagtccttcacgcatccccatgccttccctttcacgcttccgtcctgacgcaaacccattaaatttcgacgcactgcgggcttgtccttggccctgccctactcagtttcctgaagcatgcgcagttgcctttccgtcaattcctgtcctgggcgtacgtcaagatggcggcgtctgtattcgactcggaccgatg

SEQ ID NO: 11707 - DNA, 203 bp, Homo sapiens
  source 1..203: mol_type = other DNA
ggcgcgccagtcctgtggaccaccccatgccttccctttcacgcttccgtcctgacgcaaacgtggggccgccttcattgaacaatcgacgtccttggccctgccctactcagtttcctgaagcatgcgcagttgcctttccgtcaattcctgtcctgggcgtacgtcaagatggcggcgtctgtattcgactcggaccgatg

SEQ ID NO: 11708 - DNA, 203 bp, Homo sapiens
  source 1..203: mol_type = other DNA
ggcgcgccagtcctagtattaaccccatgccttccctttcacgcttccgtcctgacgcaaacgtggggccgccttccgcactgcgggcttgtccttggccctgccctactcagtttcctgaagcatgcgcagaccagccagtcaatattcctgtcctgggcgtacgtcaagatggcggcgtctgtattcgactcggaccgatg

SEQ ID NO: 11709 - DNA, 203 bp, Homo sapiens
  source 1..203: mol_type = other DNA
ggcgcgccagtcctactgcgtgccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatgaacatagtatagcacgactcggaccgatg

SEQ ID NO: 11710 - DNA, 203 bp, Homo sapiens
  source 1..203: mol_type = other DNA
ggcgcgccagtccttaagattgccccatgccttccctttcacgcttccgtcctgacgcaaacgtggggccgccttccgcactgcgggcttgtccttggccctgcgtataatttcggtttgaagcatgcgcagttgcctttccgtcaattcctgtcctgggcgtacgtcaagatggcggcgtctgtattcgactcggaccgatg

SEQ ID NO: 11711 - DNA, 203 bp, Homo sapiens
  source 1..203: mol_type = other DNA
ggcgcgccagtcctgcacctcaccccatgccttccctttcacgcttccgtcctgacgcaaacgtggggccgccttccgcactgcgggctttagtacaatatctgcctactcagtttcctgaagcatgcgcagttgcctttccgtcaattcctgtcctgggcgtacgtcaagatggcggcgtctgtattcgactcggaccgatg

SEQ ID NO: 11712 - DNA, 203 bp, Homo sapiens
  source 1..203: mol_type = other DNA
ggcgcgccagtcctaggaacggccccatgccttcttcccggactcaatgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattcgactcggaccgatg

SEQ ID NO: 11713 - DNA, 203 bp, Homo sapiens
  source 1..203: mol_type = other DNA
ggcgcgccagtcctgggagccacccccgccccccatgcgggaggttcctaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgcccgactcggaccgatg

SEQ ID NO: 11714 - DNA, 203 bp, Homo sapiens
  source 1..203: mol_type = other DNA
ggcgcgccagtcctgcggatctcccccggttgactaggagctggcggttttctacaacaaagggaagaccgacgcgatgaagcccagacctgcagggttcgtggataataaactcaagcagcgagtcatccagtaccttaccagtaacaaatgtggcaaatatgtggacattggagtcttagcgtctgcgactcggaccgatg

SEQ ID NO: 11715 - DNA, 203 bp, Homo sapiens
  source 1..203: mol_type = other DNA
ggcgcgccagtcctattgtcttcccccggttgactaggagctgggggtccgagctgtggcttatgtccttcggttcatgaagcccagacctgcagggttcgtggataataaactcaagcagcgagtcatccagtaccttaccagtaacaaatgtggcaaatatgtggacattggagtcttagcgtctgcgactcggaccgatg

SEQ ID NO: 11716 - DNA, 203 bp, Homo sapiens
  source 1..203: mol_type = other DNA
ggcgcgccagtcctcctgggtccccccggttgactaggagctgggggtccgagctgtggcttggaagaccgacgcgatgaagcccagacctgcagggttcgtggataataaactcaagcagcgagtcatccagtaccttaccagtacgcctccgctgtggtatgtggacattggagtcttagcgtctgcgactcggaccgatg

SEQ ID NO: 11717 - DNA, 203 bp, Homo sapiens
  source 1..203: mol_type = other DNA
ggcgcgccagtccttttagggtcccccggttgactaggagctgggggtccgagctgtggcttggaagaccgacgcgcgtcccgaagttggtgcagggttcgtggataataaactcaagcagcgagtcatccagtaccttaccagtaacaaatgtggcaaatatgtggacattggagtcttagcgtctgcgactcggaccgatg

SEQ ID NO: 11718 - DNA, 203 bp, Homo sapiens
  source 1..203: mol_type = other DNA
ggcgcgccagtcctattacatgccccggtcaccgcgaggatgtagcacccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 11719 - DNA, 203 bp, Homo sapiens
  source 1..203: mol_type = other DNA
ggcgcgccagtcctccagctacccccggtcaccggccctgcccccgggattatctagacgcgcctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 11720 - DNA, 203 bp, Homo sapiens
  source 1..203: mol_type = other DNA
ggcgcgccagtcctctcccaaaccccggtcaccggccctgcccccgggccctgtgcttataaaagccctactaggaccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 11721 - DNA, 203 bp, Homo sapiens
  source 1..203: mol_type = other DNA
ggcgcgccagtcctgtgtttagccccggtcaccggccctgcccccgggccctgtgcttataacctgggatgggcacccctgccagtcctgaggccggaatctgtaccgctgcccgagcccgagtggttcactgcactgtgaaaacagattccagacgccgggaactcacgcctccaatcccagacgctcgactcggaccgatg

SEQ ID NO: 11722 - DNA, 203 bp, Homo sapiens
  source 1..203: mol_type = other DNA
ggcgcgccagtcctgggtaaggccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctctccagggcttgtgacgactcggaccgatg

SEQ ID NO: 11723 - DNA, 203 bp, Homo sapiens
  source 1..203: mol_type = other DNA
ggcgcgccagtcctatgggctgccccggtcaccggccctgcccccgggccctgtgcttataacctgggatgggcacccctgccagtcctgctctgccgcctgcctaattacggtattgccgagtggttcactgcactgtgaaaacagattccagacgccgggaactcacgcctccaatcccagacgctcgactcggaccgatg

SEQ ID NO: 11724 - DNA, 203 bp, Homo sapiens
  source 1..203: mol_type = other DNA
ggcgcgccagtccttgcttgtgccccgtggccaaaagcccagtgtttacagcacctctcacatccaggacgaccccatcctggcgctcaccacctcggcgcctccttagtacgcattaggtggtaagccgagctctccctcggccttgttctgaatgcacacatgtctaggggctaaggatgtcctaccgactcggaccgatg

SEQ ID NO: 11725 - DNA, 203 bp, Homo sapiens
  source 1..203: mol_type = other DNA
ggcgcgccagtcctccgtggtgccccgtggccaaaagcccagtgtttacagcacctctcacatccaggacgacccccgggccatcgcgcgtcttagtagtatggcttagtacgcattaggtggtaagccgagctctccctcggccttgttctgaatgcacacatgtctaggggctaaggatgtcctaccgactcggaccgatg

SEQ ID NO: 11726 - DNA, 203 bp, Homo sapiens
  source 1..203: mol_type = other DNA
ggcgcgccagtcctcttcagatccccgtggccaatcatattcgtggatcagcacctctcacatccaggacgaccccatcctggcgctcactcttagtagtatggcttagtacgcattaggtggtaagccgagctctccctcggccttgttctgaatgcacacatgtctaggggctaaggatgtcctaccgactcggaccgatg

SEQ ID NO: 11727 - DNA, 203 bp, Homo sapiens
  source 1..203: mol_type = other DNA
ggcgcgccagtcctcggcctccccccgttcttccaacatcctccgctggcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 11728 - DNA, 203 bp, Homo sapiens
  source 1..203: mol_type = other DNA
ggcgcgccagtcctgcgtaattccccgttcttccctgcggagtgcgctcatttataaccgagtgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 11729 - DNA, 203 bp, Homo sapiens
  source 1..203: mol_type = other DNA
ggcgcgccagtcctccgggcccccccgttcttccctgcggagtgcgctgcgccgcccagccctgtcgccccccggaggtgatccctccctcctgcctgcccgccagcctgacctgtgcccggctcgcgggccgcagcctcggccccctactctaaattcgagctctcggcgcgatgagcatagagacgcgactcggaccgatg

SEQ ID NO: 11730 - DNA, 203 bp, Homo sapiens
  source 1..203: mol_type = other DNA
ggcgcgccagtcctcgagatgcccccgttcttccctgcggagtgcgctgcgccgcccagccctgtcgccccccggaggtgatccctccctcctgcctgcccgccagcctgacctgtgctacctgataaccgagcagcctcggcccccgcgcgcccccggcagctctcggcgcgatgagcatagagacgcgactcggaccgatg

SEQ ID NO: 11731 - DNA, 203 bp, Homo sapiens
  source 1..203: mol_type = other DNA
ggcgcgccagtcctcaggaaatcccctcccaaaccacctcccaaatgggagataatggggggccccggccttaccaatcagcggtggaaaggtccattgcaatccctccaggaagcggccggggcagccttgctctccatagacggctccccccggtggatcccgtggcgattcctgaaaaaagctgccgactcggaccgatg

SEQ ID NO: 11732 - DNA, 203 bp, Homo sapiens
  source 1..203: mol_type = other DNA
ggcgcgccagtccttcatgtaccccctcccaaaccacctcccaaatggttctattataaactccccggccttaccaatcagcggtggaaaaagaagcccagtctcctccaggaagcggccggggcagccttgctctccatagacggctccccccggtggatcccgtggcgattcctgaaaaaagctgccgactcggaccgatg

SEQ ID NO: 11733 - DNA, 203 bp, Homo sapiens
  source 1..203: mol_type = other DNA
ggcgcgccagtcctagacggttcccctcccaaaccacctcccaaatggttctattataaactccccggccttaccaatcagcggtggaaaggtccattgcaatccctccaggaagcggccggggcagccttgctctccatagacggctccccccggtggatcccgtggcgattcctgaaaaaagctgccgactcggaccgatg

SEQ ID NO: 11734 - DNA, 203 bp, Homo sapiens
  source 1..203: mol_type = other DNA
ggcgcgccagtcctgtgtgctacccctcccaaaccacctcccaaatggttctattataaactccccggccttaccaatcagcggtggaaaggtccattgcaatccctccaggaagcggccggggcagccttgctctccatagacggtgagaaggaaaaattcccgtggcgattcctgaaaaaagctgccgactcggaccgatg

SEQ ID NO: 11735 - DNA, 203 bp, Homo sapiens
  source 1..203: mol_type = other DNA
ggcgcgccagtcctatgtagaccccctctaggttgaaggatgcccagaaggtacccgcaggtaacaagagacactgtggatctgatctggggccacctacctctatcctggtgaggtggttaaaaaacgtctagtgggccaaacccaggggggatccctggtttccttattttagtgtaaatgtcattcgactcggaccgatg

SEQ ID NO: 11736 - DNA, 203 bp, Homo sapiens
  source 1..203: mol_type = other DNA
ggcgcgccagtccttaattagacccgaaaacacacccaactccacacaaacacccacagcatccgagccctctacatcaaattccacccaaaatacccaatcacatgcttagttattcaaaaactacatcttagcagaaaaccgtgacctatcaagcaagtcacggtaacctaatggggcaaataacccgactcggaccgatg

SEQ ID NO: 11737 - DNA, 203 bp, Homo sapiens
  source 1..203: mol_type = other DNA
ggcgcgccagtccttattaagtcccgaaaacacaggtgcgcgatagataacacccacagcatccgagccctctacatcaaattccacccaaaatacccaatcacatgcttagttattcaaaaactacatcttagcagaaaaccgtgacctatcaagcaagaacgaaattaaacctggggcaaataacccgactcggaccgatg

SEQ ID NO: 11738 - DNA, 203 bp, Homo sapiens
  source 1..203: mol_type = other DNA
ggcgcgccagtcctcgataacgcccgatcgtaaactccatgtattggttacccatctgcatcgaaaactctccgaacactaggtgcagtaaggctttcatggagcccggcctatgaccgcgtacgtgtaccataggcagccccaaaaacacgtgtgaggagaaagtcccagtcactttgggcaaagtacgactcggaccgatg

SEQ ID NO: 11739 - DNA, 203 bp, Homo sapiens
  source 1..203: mol_type = other DNA
ggcgcgccagtcctccaacggccccgatcgtaaactccatgtattggttacccatctgcatcgaaaactctccgaacactaggtgcagtaaggctttcatggagtggtttgctatttagcgtacgtgtaccataggcagccccaaatttgacgcacgattgaaagtcccagtcactttgggcaaagtacgactcggaccgatg

SEQ ID NO: 11740 - DNA, 203 bp, Homo sapiens
  source 1..203: mol_type = other DNA
ggcgcgccagtccttcgagagacccgcaggacgcgcctcccagccagcccgactcctaggaggaggggaggcgggaaagcagctcaagccagtagattgcgttcgcccccagccccgccactcccaggctcctcgggactcggcgggtcctcctgggagtctcggaggggaccggctgtgcagacgcccgactcggaccgatg

SEQ ID NO: 11741 - DNA, 203 bp, Homo sapiens
  source 1..203: mol_type = other DNA
ggcgcgccagtcctgctacggtcccgcaggacgcgcctcccagccagcccgactcctaggaggaggggaggcgggaaagcagctcaagcctcacccaccgccctaaatgtttttttctcactcccaggctcctcgggactcggcgggtcctcctgggagtctcggaggggaccggctgtgcagacgcccgactcggaccgatg

SEQ ID NO: 11742 - DNA, 203 bp, Homo sapiens
  source 1..203: mol_type = other DNA
ggcgcgccagtcctcatttaaacccgcaggacgcgcctcccagccagcccgactcctaggaggaggggaggcgggaaagcagctcaagcctcacccaccgccctgcccccagccccgccactcccaggctcctcgggacaacaactaacctcctgggagtctcggaggggaccggctgtgcagacgcccgactcggaccgatg

SEQ ID NO: 11743 - DNA, 203 bp, Homo sapiens
  source 1..203: mol_type = other DNA
ggcgcgccagtcctcagcgctacccgcaggacgcgcctcccagccagcccgactcctaggaggaggggaggcgggaaagcagctcaagcctcacccaccgccctgcccccagccccgccactcccaggctcctcgggactcggcgggtcctcctgggagtaattccatttcatagctgtgcagacgcccgactcggaccgatg

SEQ ID NO: 11744 - DNA, 203 bp, Homo sapiens
  source 1..203: mol_type = other DNA
ggcgcgccagtcctgggaaatccccgcaggacgcgcctcccagccagcccgactcctaggaggaggggaggcgggaaagcagctcaagcctcacccaccgccctgcccccagccccgctttcttgctagctttcgggactcggcgggtcctcctgggagtctcggaggggaccggctgtgcagacgcccgactcggaccgatg

SEQ ID NO: 11745 - DNA, 203 bp, Homo sapiens
  source 1..203: mol_type = other DNA
ggcgcgccagtccttctcagtccccgccgccatgacgctgcgcgcggccgtcttcgaccttgacggggtgctggcgacagtgatctaaggcggcgtcctcggccgcacggaggaggccctggcgctgcccaggacttctgaatgatgctttccagaaagggggaccagagggtgccactacccggcttcgactcggaccgatg

SEQ ID NO: 11746 - DNA, 203 bp, Homo sapiens
  source 1..203: mol_type = other DNA
ggcgcgccagtcctcttcatcacccgccgccatgacgctgcgcgcggccgtcttcgaccttgacggggtgctggcgctgccagcggtgttcggcgtcctcggccgcacggaggaggccggtcttaccaaggcgacttctgaatgatgctttccagaaagggggaccagagggtgccactacccggcttcgactcggaccgatg

SEQ ID NO: 11747 - DNA, 203 bp, Homo sapiens
  source 1..203: mol_type = other DNA
ggcgcgccagtcctaagctcgacccgccgccatgacgctgcgcgcggccgtcttcgaccttgcaaattaaaataatctgccagcggtgttcggcgtcctcggccgcacggaggaggccctggcgctgcccaggacttctgaatgatgctttccagaaagggggaccagagggtgccactacccggcttcgactcggaccgatg

SEQ ID NO: 11748 - DNA, 203 bp, Homo sapiens
  source 1..203: mol_type = other DNA
ggcgcgccagtccttgcgagtacccgccgccatgacgctgcgcgcggctaatccatttgactacggggtgctggcgctgccagcggtgttcggcgtcctcggccgcacggaggaggccctggcgctgcccaggacttctgaatgatgctttccagaaagggggaccagagggtgccactacccggcttcgactcggaccgatg

SEQ ID NO: 11749 - DNA, 203 bp, Homo sapiens
  source 1..203: mol_type = other DNA
ggcgcgccagtcctcgcgactgcccgcctgccggcctgcctgccacagccggactccgccaccagccctacgagatccgcctgtcattccctagcccagctcttgggaaactgcagaggggtccagaggatttgcagttctgaacctgcacactccagtctaggatctccgagcaagagcgtagcctccgactcggaccgatg

SEQ ID NO: 11750 - DNA, 203 bp, Homo sapiens
  source 1..203: mol_type = other DNA
ggcgcgccagtcctcacgtcagcccgcctgccggcctgcctgccacagccggactccgccactccggtaggattccccgcctgtcattccctagcccagctcttgggaaactgcagagacaggggtgtccactgcagttctgaacctgcacactccagtctaggatctccgagcaagagcgtagcctccgactcggaccgatg

SEQ ID NO: 11751 - DNA, 203 bp, Homo sapiens
  source 1..203: mol_type = other DNA
ggcgcgccagtcctggcccttacccgcctgccggcctgcctgccacagccggactccgccactccggtaggattccccgcctgtcattccctagcccagctcttgggaaactgcagaggggtccagaggattccggtccagcctggtgcacactccagtctaggatctccgagcaagagcgtagcctccgactcggaccgatg

SEQ ID NO: 11752 - DNA, 203 bp, Homo sapiens
  source 1..203: mol_type = other DNA
ggcgcgccagtcctcggtcgagcccgcctgccggcctgcctgccacagccggactccgccactccggtaggattccccgcctgtcattccctagcccagctcttgggaaactgcagaggggtccagaggatttgcagttctgaacctgcacactccagtcatattcgctttgtgaagagcgtagcctccgactcggaccgatg

SEQ ID NO: 11753 - DNA, 203 bp, Homo sapiens
  source 1..203: mol_type = other DNA
ggcgcgccagtcctattccttccccgcctgccggcctgcctgccacagccggactccgccactccggtaggattccgacgagcagccgttctagcccagctcttgggaaactgcagaggggtccagaggatttgcagttctgaacctgcacactccagtctaggatctccgagcaagagcgtagcctccgactcggaccgatg

SEQ ID NO: 11754 - DNA, 203 bp, Homo sapiens
  source 1..203: mol_type = other DNA
ggcgcgccagtcctgttgcctccccgcctgccggcctgcctgccacagtattctcattgatgtccggtaggattccccgcctgtcattccctagcccagctcttgggaaactgcagaggggtccagaggatttgcagttctgaacctgcacactccagtctaggatctccgagcaagagcgtagcctccgactcggaccgatg

SEQ ID NO: 11755 - DNA, 203 bp, Homo sapiens
  source 1..203: mol_type = other DNA
ggcgcgccagtcctgttctaggcccggaaatctgacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagcgactcggaccgatg

SEQ ID NO: 11756 - DNA, 203 bp, Homo sapiens
  source 1..203: mol_type = other DNA
ggcgcgccagtcctacatctgccccggctcggggtccgggctggggaggggaacctgggcgcctgggacccgccgatgccccctgccccgcccggaggtgaaagcgggtgtgaggagcgcggcgcggcaggtcatattgaacattccagatacctatcatcctgacgacacacagataacagcaagatcgactcggaccgatg

SEQ ID NO: 11757 - DNA, 203 bp, Homo sapiens
  source 1..203: mol_type = other DNA
ggcgcgccagtcctggatcaagcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttacgcctttttgacacgactcggaccgatg

SEQ ID NO: 11758 - DNA, 203 bp, Homo sapiens
  source 1..203: mol_type = other DNA
ggcgcgccagtcctaagaatgccccggctcggggtccgggctggggaggggaacctgggcgcctgggacccgccgatgccccctgccccgtggacccagatgtacgggtgtgaggagcgcggcgcggcaggtcatattgaacattccagatacctatcattactcgatgctgttgataacagcaagatcgactcggaccgatg

SEQ ID NO: 11759 - DNA, 203 bp, Homo sapiens
  source 1..203: mol_type = other DNA
ggcgcgccagtcctgtgttcgtcccggctcggggtccgggctggggaggggaacctgggcgcggttcgtataggcttgccccctgccccgcccggaggtgaaagcgggtgtgaggagcgcggcgcggcaggtcatattgaacattccagatacctatcattactcgatgctgttgataacagcaagatcgactcggaccgatg

SEQ ID NO: 11760 - DNA, 203 bp, Homo sapiens
  source 1..203: mol_type = other DNA
ggcgcgccagtcctgctgttaacccggggccaacatacgccgtggagcgcagcaagggctagggcttcctgaacctctccgggagaggtcctagcaaccctcgcggcccgccctaggagcattgtcttcccggggaagacaaacaattgggggctcgtccgggatttgaattcctccattctcacattcgactcggaccgatg

SEQ ID NO: 11761 - DNA, 203 bp, Homo sapiens
  source 1..203: mol_type = other DNA
ggcgcgccagtccttgggacagcccggggccaacatacgccgtggagcgcagcaagggctagggcttcctgaacctctccgggagaggtctattgctataggcaggcccgccctaggacagcacaaggggttgggaagacaaacaattgggggctcgtccgggatttgaattcctccattctcacattcgactcggaccgatg

SEQ ID NO: 11762 - DNA, 203 bp, Homo sapiens
  source 1..203: mol_type = other DNA
ggcgcgccagtccttcatagtgcccggggccaacatacgccgtggagcgcagcaagggctagggcttcctgaacctctccgggagaggtctattgctataggcaggcccgccctaggagcattgtcttcccggggaagacaaacaacgctaactagcaatgggatttgaattcctccattctcacattcgactcggaccgatg

SEQ ID NO: 11763 - DNA, 203 bp, Homo sapiens
  source 1..203: mol_type = other DNA
ggcgcgccagtcctcgtacgatcccggggccaacatacgccgtggagcgcagcaagggctagggcttcctgaacctctccgggagaggtctattgctataggcaggcccgccctaggagcattgtcttcccggggaagacaaacaattgggggctcgtccgggatttgaattcctccattctcacattcgactcggaccgatg

SEQ ID NO: 11764 - DNA, 203 bp, Homo sapiens
  source 1..203: mol_type = other DNA
ggcgcgccagtcctgcgggtggcccggggccaacatacgccgtggagcgcagcaagggctagggcttcctgaacctctccgggagaggtctattgctataggcaggcccgccctaggagcattgtcttcccgttcggctaggcaggttgggggctcgtccgggatttgaattcctccattctcacattcgactcggaccgatg

SEQ ID NO: 11765 - DNA, 203 bp, Homo sapiens
  source 1..203: mol_type = other DNA
ggcgcgccagtcctgaactgctccctaaccaacccagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 11766 - DNA, 203 bp, Homo sapiens
  source 1..203: mol_type = other DNA
ggcgcgccagtcctcaccaaggccctaactaggtacttgatcattatattaagaaaaacttaggatccaagaccataaatctaggatcctttacaatctcagaccctggtgcaaggttatatatagagcccaattctcctaattaaacagtgtctcaggttgacaaatggacaagttggatctagtcacgactcggaccgatg

SEQ ID NO: 11767 - DNA, 203 bp, Homo sapiens
  source 1..203: mol_type = other DNA
ggcgcgccagtccttcctttgcccctaccccatccccttattcagcacatgaaataaacaaggggcatccaaatcttgcggcaacgcccccgggacatgcatcgcatagatcggatgatcaaaccccttatccctctggacagaatgcaggtccaaccacgctggtataccctcaaacccctcagacacgactcggaccgatg

SEQ ID NO: 11768 - DNA, 203 bp, Homo sapiens
  source 1..203: mol_type = other DNA
ggcgcgccagtcctaattacggccctaccccatccccttattcagcacatgaaataaacaaggggcatccaaatcttgcggcaacgcccccgggacatgcatcgtcccctggactctcatgcggaagccgaacctctggacagaatgcaggtccaaccacgctggtataccctcaaacccctcagacacgactcggaccgatg

SEQ ID NO: 11769 - DNA, 203 bp, Homo sapiens
  source 1..203: mol_type = other DNA
ggcgcgccagtcctggttccctccctaccccatccccttattcagcacatgaaataaacaaggggcatccaaatcttgcggcaacgcccccgggacatgcatcgtcccctggactctctcaaaccccttatccctctggacagaatgcaggtccaaccaccgcaactctagtcgaaacccctcagacacgactcggaccgatg

SEQ ID NO: 11770 - DNA, 203 bp, Homo sapiens
  source 1..203: mol_type = other DNA
ggcgcgccagtccttgctatctccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcgtttgtaatgctgtcgactcggaccgatg

SEQ ID NO: 11771 - DNA, 203 bp, Homo sapiens
  source 1..203: mol_type = other DNA
ggcgcgccagtccttgctgctaccctaccccatccccttattcagcacatgaaataaacaaggggcatccaaatcttgcggcaacgcccccgggacatgcatcgtcccctggactctctcaaaccccttatccctctggacagaatgcaggtccaaccactgctccgacatggtaaacccctcagacacgactcggaccgatg

SEQ ID NO: 11772 - DNA, 203 bp, Homo sapiens
  source 1..203: mol_type = other DNA
ggcgcgccagtcctattagcggccctaccccatccccttattcagcacatgaaataaacaagttaggcaacgcgagtgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 11773 - DNA, 203 bp, Homo sapiens
  source 1..203: mol_type = other DNA
ggcgcgccagtcctaagggcgtccctaccccatccccttattcagcaccgcgtgatccatcagggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 11774 - DNA, 203 bp, Homo sapiens
  source 1..203: mol_type = other DNA
ggcgcgccagtcctttcagcctccctaccccatcgttcacgcacagttatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 11775 - DNA, 203 bp, Homo sapiens
  source 1..203: mol_type = other DNA
ggcgcgccagtcctctccatagccctagagccatgcactaacaaatgcgtacccttcacggccagtttccattgccagctgtgtttctcgaaaaaggggctcggaatatcatatgagcgaaagggcagacgaagaaggactccaaggaaaactaagactccttcgccttctgcaccagacaagtgagtcgactcggaccgatg

SEQ ID NO: 11776 - DNA, 203 bp, Homo sapiens
  source 1..203: mol_type = other DNA
ggcgcgccagtcctttgctaacccctagagccatgcactaacaaatgctattgtaagcgatgcagtttccattgccagctgtgtttctcgaaaaaggggctcggaatatcatatgagcatctcttagatgatagaaggactccaaggaaaactaagactccttcgccttctgcaccagacaagtgagtcgactcggaccgatg

SEQ ID NO: 11777 - DNA, 203 bp, Homo sapiens
  source 1..203: mol_type = other DNA
ggcgcgccagtcctggctatacccctagagccatgcactaacaaatgctattgtaagcgatgcagtttccattgccagctgtgtttctcgaaaaaggggctcggctagcaggggtttggaaagggcagacgaagaaggactccaaggaaaactaagactccttcgccttctgcaccagacaagtgagtcgactcggaccgatg

SEQ ID NO: 11778 - DNA, 203 bp, Homo sapiens
  source 1..203: mol_type = other DNA
ggcgcgccagtcctggtcggaaccctagagccatgcactaacaaatgctattgtaagcgatgtgccacgggcgaaaagctgtgtttctcgaaaaaggggctcggaatatcatatgagcgaaagggcagacgaagaaggactccaaggaaaactaagactccttcgccttctgcaccagacaagtgagtcgactcggaccgatg

SEQ ID NO: 11779 - DNA, 203 bp, Homo sapiens
  source 1..203: mol_type = other DNA
ggcgcgccagtcctgcaccagtccctatcccgtgaccctgttcctccgcttcttcgttgggcgcatctcctggaactgggccgcgtccccgccgcctttccgtcatttcttcagatagctccccagctgtggaaaatgagcatcctcaagagaccccagagaatccatcggatttgtatacttccttccgactcggaccgatg

SEQ ID NO: 11780 - DNA, 203 bp, Homo sapiens
  source 1..203: mol_type = other DNA
ggcgcgccagtcctgtttctggccctatcccgtgaccctgttcctccgcttcttcgttgggcgcatctcctggaactgggccgcgtccccgccgcctttccgtccagcggcgttcctcctccccagctgtggaaaatgagcatcctcaagagaccccagaatccaacaatagcgtgtatacttccttccgactcggaccgatg

SEQ ID NO: 11781 - DNA, 203 bp, Homo sapiens
  source 1..203: mol_type = other DNA
ggcgcgccagtccttttctgcaccctatcccgtgaccctgttcctccgcttcttcgttgggcgcatctcctggaactgggccgcgtcccctagagtccatttatatttcttcagatagctccccagctgtggaaaatgagcatcctcaagagaccccagaatccaacaatagcgtgtatacttccttccgactcggaccgatg

SEQ ID NO: 11782 - DNA, 203 bp, Homo sapiens
  source 1..203: mol_type = other DNA
ggcgcgccagtcctttctggaaccctatcccgtgctatgtgcgtgtaccttcttcgttgggcgcatctcctggaactgggccgcgtccccgccgcctttccgtcatttcttcagatagctccccagctgtggaaaatgagcatcctcaagagaccccagaatccaacaatagcgtgtatacttccttccgactcggaccgatg

SEQ ID NO: 11783 - DNA, 203 bp, Homo sapiens
  source 1..203: mol_type = other DNA
ggcgcgccagtcctctgaggctccctgggccaggacgcctccctcattaagcgggaggacacgaccccagggcattgtgggaacactggccaggctggactttgccttcctcctcgtcctttagccgggagcctgtctttgcttgcctttgcctttgaggctctgtggctgtggggctgagtggcatccgactcggaccgatg

SEQ ID NO: 11784 - DNA, 203 bp, Homo sapiens
  source 1..203: mol_type = other DNA
ggcgcgccagtcctattagaaaccctgggccaggcttggcagagagggaagcgggaggacacgaccccagggcattgtgggaacactggccaggctggactttgccttcctcctcgtcaaggcatttacttgctgtctttgcttgcctttgcctttgaggctctgtggctgtggggctgagtggcatccgactcggaccgatg

SEQ ID NO: 11785 - DNA, 203 bp, Homo sapiens
  source 1..203: mol_type = other DNA
ggcgcgccagtcctagaattgcccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggactgcccatttgaacgactcggaccgatg

SEQ ID NO: 11786 - DNA, 203 bp, Homo sapiens
  source 1..203: mol_type = other DNA
ggcgcgccagtcctccctcaagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatccgactcggaccgatg

SEQ ID NO: 11787 - DNA, 203 bp, Homo sapiens
  source 1..203: mol_type = other DNA
ggcgcgccagtccttacttcttccctgggccaggcttggcagagagggaagcgggaggacacgaccccagggcattgtgggaacactggccaggctggactttgccttcctcctcgtcctttagccgggagcctgtctttgcttgcctttgcctttgagggcagagacggcccaggctgagtggcatccgactcggaccgatg

SEQ ID NO: 11788 - DNA, 203 bp, Homo sapiens
  source 1..203: mol_type = other DNA
ggcgcgccagtcctgtccctatccctgggccaggcttggcagagagggaagcgggaggacacgaccccagggcattgtgggaacactggccaggctggactttgccttcctcctcgtcctttagccgggagctctcgggattggagctttgcctttgaggctctgtggctgtggggctgagtggcatccgactcggaccgatg

SEQ ID NO: 11789 - DNA, 203 bp, Homo sapiens
  source 1..203: mol_type = other DNA
ggcgcgccagtccttctgcattccctgggccaggcttggcagagagggaagcgggaggacacgaccccagggcattgtgggaacactggcgtcagccactagcaccttcctcctcgtcctttagccgggagcctgtctttgcttgcctttgcctttgaggctctgtggctgtggggctgagtggcatccgactcggaccgatg

SEQ ID NO: 11790 - DNA, 203 bp, Homo sapiens
  source 1..203: mol_type = other DNA
ggcgcgccagtcctaatccgagccctgggtccatcacagtataaaatctgcaagtagtgctattgttggaatcaccgtacctatttaggtttacgctccaagatcggtggatagcagccctatcaatatctaggagaactgtgctatgtttagaagattaggtagtctctaaacagaacaatttacctcgactcggaccgatg

SEQ ID NO: 11791 - DNA, 203 bp, Homo sapiens
  source 1..203: mol_type = other DNA
ggcgcgccagtcctgtacgtaacccttgcgcaattagggaacaaatccctctcagcgaaggccgaaaagaggctagccatgcccttagtaggactagcataatgaggggggtagcaacagtggtgagttcgttggatggcttaagccctgagtacagggtagtcgtcagtggttcgacgccttggaatcgactcggaccgatg

SEQ ID NO: 11792 - DNA, 203 bp, Homo sapiens
  source 1..203: mol_type = other DNA
ggcgcgccagtcctcaaccaccccgacaatcccacagtcgtgctcatctttgtggtgagtatgttgctattatgttgttgttctactggttgctgtggcttctttagttgttttgcatcttctattagaggttgttgtgaatcaactaaacttccttattacgacgttgaaaagatccacatacagtacgactcggaccgatg

SEQ ID NO: 11793 - DNA, 203 bp, Homo sapiens
  source 1..203: mol_type = other DNA
ggcgcgccagtcctgggactatccgagcagccggtcctccagtggctcatagatgttcagcatgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 11794 - DNA, 203 bp, Homo sapiens
  source 1..203: mol_type = other DNA
ggcgcgccagtccttcgtatgtccgagcagccggtcctccagtggctccgctccccgttctctgtgggctcaaaatgacagaggctcacaggacacctgcatgcccaaggcactccaccgtatgtgatcaacctggatccagcagtacatgaagttccctgggtcaatctcggaggtgatgaaatttacgactcggaccgatg

SEQ ID NO: 11795 - DNA, 203 bp, Homo sapiens
  source 1..203: mol_type = other DNA
ggcgcgccagtccttgtcaagcccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 11796 - DNA, 203 bp, Homo sapiens
  source 1..203: mol_type = other DNA
ggcgcgccagtcctagaaagacccgagcagccggtcctccagtggctccgctccccgttctctgtgggctcaaaatgacagaggctcacaggacacctgcatgcccaaggcactccaccgtatgtgatcaacctggatccagcagtctggttgccgggacttcctgccaatattggtgatgaaatttacgactcggaccgatg

SEQ ID NO: 11797 - DNA, 203 bp, Homo sapiens
  source 1..203: mol_type = other DNA
ggcgcgccagtcctgacccaacccgattatccatcgccatttcccctggtagacctggcagatgaggctagaaataccccactggcgacagtgttctagcctgcgtggctgcctgcacaccctatgggtgtgaagccaaacaatggacaaggtgtgaagagccccgtgtgctcgctttgagtcctccgcgactcggaccgatg

SEQ ID NO: 11798 - DNA, 203 bp, Homo sapiens
  source 1..203: mol_type = other DNA
ggcgcgccagtcctatgacaacccgcccaagcgttttactttgcaaaagtttctgataggcggagcatctagtttcaacttccttttgcagcaagttctttcctgcactaatcacaattcttggaagaggagaactggacgttgtgaacagagttagctggtaaatgtcctcttaaaagatccaaaaacgactcggaccgatg

SEQ ID NO: 11799 - DNA, 203 bp, Homo sapiens
  source 1..203: mol_type = other DNA
ggcgcgccagtcctacgatatgccgcccgagtggatgagcgagcgagcatagccacttttcagccgcggcccggtcaccaaccaggaccgggatcacgtggctcccagggctgggtgaagaagccgccgggaccgagcgcgccggagaggaggggcgcctggggacagaaggcgacgtcccctgaaatcgactcggaccgatg

SEQ ID NO: 11800 - DNA, 203 bp, Homo sapiens
  source 1..203: mol_type = other DNA
ggcgcgccagtcctaataggccccgcccgagtggatgagcgagcgagcgacttgtgaaacacgccgcggcccggtcaccaaccaggaccgaagagtaactctcgccagggctgggtgaagaagccgccgggaccgagcgcgccggagaggaggggcgcctggggacagaaggcgacgtcccctgaaatcgactcggaccgatg

SEQ ID NO: 11801 - DNA, 203 bp, Homo sapiens
  source 1..203: mol_type = other DNA
ggcgcgccagtccttcatcatcccgcccgagtggatgagcgagcgagcgacttgtgaaacacgccgcggcccggtcaccaaccaggaccgggatcacgtggctcccagggctgggtgaagaagccgccgggaccgagcgcgccggagaggaggggcgcctctaccgtattcttaacgtcccctgaaatcgactcggaccgatg

SEQ ID NO: 11802 - DNA, 203 bp, Homo sapiens
  source 1..203: mol_type = other DNA
ggcgcgccagtcctccttagagccgcccgagtggatgagcgagcgagcgacttgtgaaacacgccgcggcccggtcaccaaccaggaccgggatcacgtggctcccagggctgggtgaagaagccgccgggaccgagcgcgccggagaggaggggcgcctggggacagaaggcgacgtcccctgaaatcgactcggaccgatg

SEQ ID NO: 11803 - DNA, 203 bp, Homo sapiens
  source 1..203: mol_type = other DNA
ggcgcgccagtcctcgctcgccccgcccgagtggatgagcgagcgagcgacttgtgaaacacgccgcggcccggtcaccaaccaggaccgggatcacgtggctcccagggctgggtgaagaagccgccgggaccgagcgcgccggatgcacatccatggaggggacagaaggcgacgtcccctgaaatcgactcggaccgatg

SEQ ID NO: 11804 - DNA, 203 bp, Homo sapiens
  source 1..203: mol_type = other DNA
ggcgcgccagtcctcactttccccgcccgagtggatgagcgagcgagcgacttgtgaaacacgccgcggcccggtcaccaaccaggaccgggatcacgtggctcccagggctgggtgacagttggaatgctcccgagcgcgccggagaggaggggcgcctggggacagaaggcgacgtcccctgaaatcgactcggaccgatg

SEQ ID NO: 11805 - DNA, 203 bp, Homo sapiens
  source 1..203: mol_type = other DNA
ggcgcgccagtcctgagtgacgccgcccgagtggatgagcgagcgagcgacttgtgaaacacgccgcggcccggtcaccaaccaggaccgggatcacgtggctcgtccattccacatgagaagccgccgggaccgagcgcgccggagaggaggggcgcctggggacagaaggcgacgtcccctgaaatcgactcggaccgatg

SEQ ID NO: 11806 - DNA, 203 bp, Homo sapiens
  source 1..203: mol_type = other DNA
ggcgcgccagtccttggccctaccgcccgagtggatgagcgagcgagcgacttgtgaaacacgccgcggcccggtcgattgaagtttttcggatcacgtggctcccagggctgggtgaagaagccgccgggaccgagcgcgccggagaggaggggcgcctggggacagaaggcgacgtcccctgaaatcgactcggaccgatg

SEQ ID NO: 11807 - DNA, 203 bp, Homo sapiens
  source 1..203: mol_type = other DNA
ggcgcgccagtcctcgttacccccgccggggcagcctcgtctagcgcgcgccgcgcagacgcccccggagtcgccagctaccgcagccctcgccgcccagtgcccttcggcctcggggttaaaaaggattcaggtctccgcgaagcgggaaagcgcggcggccgccgggattcgggcgccgcggcagccgactcggaccgatg

SEQ ID NO: 11808 - DNA, 203 bp, Homo sapiens
  source 1..203: mol_type = other DNA
ggcgcgccagtcctggagatcgccgccttctccggtcccctcctcggagtcattttttcctgttccccctctgccgccctttcctcacgcaaatttaagcaactttctcttggaagcgaaggtgtcggctatgagccggagcctccttccttgaatttctccgtggaggacccgccgcgccccccggccgactcggaccgatg

SEQ ID NO: 11809 - DNA, 203 bp, Homo sapiens
  source 1..203: mol_type = other DNA
ggcgcgccagtcctcgaaaggaccgccttctccggtcccctcctcggagtcattttttcctgttccccctctgccgccctttcctcacgccccgggtgaggcaaaggctcccctcataaaggtgtcggctatgagccggagcctccttccttgaatttctccgtggaggacccgccgcgccccccggccgactcggaccgatg

SEQ ID NO: 11810 - DNA, 203 bp, Homo sapiens
  source 1..203: mol_type = other DNA
ggcgcgccagtcctagaggtccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgataatatgagttatcgactcggaccgatg

SEQ ID NO: 11811 - DNA, 203 bp, Homo sapiens
  source 1..203: mol_type = other DNA
ggcgcgccagtccttcggcccaccgccttctccggtcccctcctcggataagaacgcgaagattccccctctgccgccctttcctcacgccccgggtgaggcaattctcttggaagcgaaggtgtcggctatgagccggagcctccttccttgaatttctccgtggaggacccgccgcgccccccggccgactcggaccgatg

SEQ ID NO: 11812 - DNA, 203 bp, Homo sapiens
  source 1..203: mol_type = other DNA
ggcgcgccagtcctccgtccgcccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcactatgtcgtaagcaccgactcggaccgatg

SEQ ID NO: 11813 - DNA, 203 bp, Homo sapiens
  source 1..203: mol_type = other DNA
ggcgcgccagtccttggtggttccgcgcgcgcgccccaggccccggcccgggcctcggttccagaagggagaggagcccgccaaggcgcgcaagagagcgggctgcctcgcagtccgagccggagagggagcagcctatttttttcccccggacgggcctccgaaaccatgaactttctgctctcttgcgactcggaccgatg

SEQ ID NO: 11814 - DNA, 203 bp, Homo sapiens
  source 1..203: mol_type = other DNA
ggcgcgccagtcctgctagtatccgcgcgcgcgccccaggccccggcccgggcctcggttccagaagggagaggagcccgccaaggcgcgcaagagagcgggctgcctcgcagtccgagccggagagggagcgcgagccgcgccggccccggacgggccttgcccttgtccctttttctgctctcttgcgactcggaccgatg

SEQ ID NO: 11815 - DNA, 203 bp, Homo sapiens
  source 1..203: mol_type = other DNA
ggcgcgccagtcctataccggcccgcgcgcgcgccccaggccccggcccgggcctcggttccagaagggagaggagcccgccaaggcgcgcaagagagcgggctgcctcgcagtccgagccggagagggagcgcgagccgcgccgggtgttagacctggaccgaaaccatgaactttctgctctcttgcgactcggaccgatg

SEQ ID NO: 11816 - DNA, 203 bp, Homo sapiens
  source 1..203: mol_type = other DNA
ggcgcgccagtcctgattgtagccgcgcgcgcgccccaggccccggcccgggcctcggttcctccctcttagttcacccgccaaggcgcgcaagagagcgggctgcctcgcagtccgagccggagagggagcgcgagccgcgccggccccggacgggcctccgaaaccatgaactttctgctctcttgcgactcggaccgatg

SEQ ID NO: 11817 - DNA, 203 bp, Homo sapiens
  source 1..203: mol_type = other DNA
ggcgcgccagtcctgagacgaaccgcgcgcgcgccccaggccccggccgtccaagtaaagttagaagggagaggagcccgccaaggcgcgcaagagagcgggctgcctcgcagtccgagccggagagggagcgcgagccgcgccggccccggacgggcctccgaaaccatgaactttctgctctcttgcgactcggaccgatg

SEQ ID NO: 11818 - DNA, 203 bp, Homo sapiens
  source 1..203: mol_type = other DNA
ggcgcgccagtcctcccttgcaccgcggccgcctcccgccagctcgccaatacatgtttttggcgcgtgagctcaggcgtccccgccccagcttttctcggaaccatgaaccccaactgcgcccggtgcggcaagatcgtgtatcccacggagaaggtgaactgtctggataagttctggcataaagccgactcggaccgatg

SEQ ID NO: 11819 - DNA, 203 bp, Homo sapiens
  source 1..203: mol_type = other DNA
ggcgcgccagtcctttcttactccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagccgactcggaccgatg

SEQ ID NO: 11820 - DNA, 203 bp, Homo sapiens
  source 1..203: mol_type = other DNA
ggcgcgccagtcctaccatcaaccgcggccgcctcccgccagctcgcctcggggaacaggacgcgcgtgagctcaggcgtccccgccccagcttttctcggaacggactctgagccaagcgcccggtgcggcaagatcgtgtatcccacggagaaggtgaactgtctggataagttctggcataaagccgactcggaccgatg

SEQ ID NO: 11821 - DNA, 203 bp, Homo sapiens
  source 1..203: mol_type = other DNA
ggcgcgccagtcctcctaaaggccgcggtcggcggcagcgctctcctaagctctcgcggctgcgcttcggtcccggtatgaattgtttgccggggtagtgggtgctcctcggccccggacattgcaagccccagaaggcaagactaactcggtgttgctcctcccggcgctgacttcgaggcccggctcgactcggaccgatg

SEQ ID NO: 11822 - DNA, 203 bp, Homo sapiens
  source 1..203: mol_type = other DNA
ggcgcgccagtcctagcccagaccgcggtcggcggcagcgctctcctaagctctcgcggctgtaaagtatagagtcacccgggccacccacggggtagtgggtgctcctcggccccggacattgcaagccccagaaggcaagactaactcggtgttgctcctcccggcgctgacttcgaggcccggctcgactcggaccgatg

SEQ ID NO: 11823 - DNA, 203 bp, Homo sapiens
  source 1..203: mol_type = other DNA
ggcgcgccagtcctctgtgaagccgcggtcggcgtagttttcgctgctagctctcgcggctgcgcttcggtcccggacccgggccacccacggggtagtgggtgctcctcggccccggacattgcaagccccagaaggcaagactaactcggtgttgctcctcccggcgctgacttcgaggcccggctcgactcggaccgatg

SEQ ID NO: 11824 - DNA, 203 bp, Homo sapiens
  source 1..203: mol_type = other DNA
ggcgcgccagtcctaacttgtcccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatggttttactaggtaacgactcggaccgatg

SEQ ID NO: 11825 - DNA, 203 bp, Homo sapiens
  source 1..203: mol_type = other DNA
ggcgcgccagtcctcttccactccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattcgactcggaccgatg

SEQ ID NO: 11826 - DNA, 203 bp, Homo sapiens
  source 1..203: mol_type = other DNA
ggcgcgccagtcctgtcctacaccgctgaagacctcggcctgttgttgtgaatcgccagacctttgtaacacccggaagtctgaagcatgtgtttgatgatctcgtgtcgattcaccgcttgtcctgggttggagatagcactggggtcattctagtcttgactaccttccatgtaccactggtaattcgactcggaccgatg

SEQ ID NO: 11827 - DNA, 203 bp, Homo sapiens
  source 1..203: mol_type = other DNA
ggcgcgccagtcctaagtgctcccgctgcaggtgtgcggcccagtccgagacagcagatgaggagactgtccttcctgtttcgcagatgaggaaactgaggcttagagaagtttggcaaattggctaagttcaggggcggtgactagggattagtgatatgcttttctaaagagtagaaaagtcgaagcgactcggaccgatg

SEQ ID NO: 11828 - DNA, 203 bp, Homo sapiens
  source 1..203: mol_type = other DNA
ggcgcgccagtcctacatggagccgctgcaggtgtgcggcccagtccgagacagcagatgaggagactgtccttcctgtttcgcagatgaggaaactgaggcttagagaagtttggcaaattggctaagttcctacagctaattgtactgccccatgcccgcttttctaaagagtagaaaagtcgaagcgactcggaccgatg

SEQ ID NO: 11829 - DNA, 203 bp, Homo sapiens
  source 1..203: mol_type = other DNA
ggcgcgccagtccttcacatccccgctgcaggtgtgcggcccagtccgagacagcagatgaggagactgtccttcctgtttcgcagatgaggaaactgaggcttagagaagtttggcaccccttactcaacactacagctaattgtgggattagtgatatgcttttctaaagagtagaaaagtcgaagcgactcggaccgatg

SEQ ID NO: 11830 - DNA, 203 bp, Homo sapiens
  source 1..203: mol_type = other DNA
ggcgcgccagtcctgacagaagccgcttccagctctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcgggccgaacgactcggaccgatg

SEQ ID NO: 11831 - DNA, 203 bp, Homo sapiens
  source 1..203: mol_type = other DNA
ggcgcgccagtcctcgatgcgcccggcacccagatcgcgcgagacagcggaaggagcaagagtgggaggcgcgcgcggaggccgcgacggacgcaagatggcgattaactggcgtaaactcgtcaatggccagcaaggaggggggtccgagccggcggcggcggcggcagtggtggcagcgggagacacgactcggaccgatg

SEQ ID NO: 11832 - DNA, 203 bp, Homo sapiens
  source 1..203: mol_type = other DNA
ggcgcgccagtcctggctcctgccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgatacctttcaactacgactcggaccgatg

SEQ ID NO: 11833 - DNA, 203 bp, Homo sapiens
  source 1..203: mol_type = other DNA
ggcgcgccagtcctatccgcgtccggcccccaagtcccgcgcgggccgcgagaatagatcaagtcgggccagctgagctatcccgtcagaccgcgccagtttgaatgaaagctctacaagatggcggcggtcggggccgaggcgcgaggagcttggtgtgtgccttgcctagtttcacttgatactctcgactcggaccgatg

SEQ ID NO: 11834 - DNA, 203 bp, Homo sapiens
  source 1..203: mol_type = other DNA
ggcgcgccagtcctccgaacttccggcccccaagtcccgcgcgggccggccaggggcggggcgtcgggccagctgagctatcccgtcagaccgcgccagtttgaatgaaagctctacaagatggcggcggtcggggccgaggcgcgaggagcttggtgtgcttgcctaggttggtcacttgatactctcgactcggaccgatg

SEQ ID NO: 11835 - DNA, 203 bp, Homo sapiens
  source 1..203: mol_type = other DNA
ggcgcgccagtcctaatgagaaccggcccccaagtcccgcgcgggccggccaggggcggggcgtcgggccagctgagctatcccgtcagaccgcgccagtttgaatgaaagctctacaagatggcggcggtcggggccgaggcgcggcactgactaacgctgccttgcctagtttcacttgatactctcgactcggaccgatg

SEQ ID NO: 11836 - DNA, 203 bp, Homo sapiens
  source 1..203: mol_type = other DNA
ggcgcgccagtcctgttcaattccggcccccaagtcccgcgcgggccggccaggggcggggcgtcgggccagctgagctatcccgtcagaccgcgccagtttgaatgaaagctctacaagatggcggcggtcttaattcttttcataggagcttggtgtgtgccttgcctagtttcacttgatactctcgactcggaccgatg

SEQ ID NO: 11837 - DNA, 203 bp, Homo sapiens
  source 1..203: mol_type = other DNA
ggcgcgccagtcctgatgaatcccggcccccaagtcccgcgcgggccggccaggggcggggcgtcgggccagctgagctatcccgtcagatgctttggcaaacgatgaaagctctacaagatggcggcggtcggggccgaggcgcgaggagcttggtgtgtgccttgcctagtttcacttgatactctcgactcggaccgatg

SEQ ID NO: 11838 - DNA, 203 bp, Homo sapiens
  source 1..203: mol_type = other DNA
ggcgcgccagtcctcatcccacccggccccgcagccccagcgccttccctgcgccctggtggggacagcagccaggaggacccggccctgccaagcgcctccgaccccgatcatgtttgggccccgaaccccgcgtggcgcccagcctggaagacccggcgggtaccccggccgtgggcgcgctcacccgactcggaccgatg

SEQ ID NO: 11839 - DNA, 203 bp, Homo sapiens
  source 1..203: mol_type = other DNA
ggcgcgccagtcctgtattcacccggccccgcagccccagcgccttccctgcgccctggtggggacagcagccaggaggacccggccctgccaagcgcctccgattggaggagcccgcgggccccgaaccccgcgtggcgcccagcaacacctggatcttgggtaccccggccgtgggcgcgctcacccgactcggaccgatg

SEQ ID NO: 11840 - DNA, 203 bp, Homo sapiens
  source 1..203: mol_type = other DNA
ggcgcgccagtcctagttaagaccggccccgcagccccagcgccttccctgcgccctggtggggacagcagccaggaggacccggccctgccaagcgcctccgattggaggagcccgcgggccccgaaccccgcgtggcgcccagcctggaagacgtatgcatgacagttcagtagggcgcgctcacccgactcggaccgatg

SEQ ID NO: 11841 - DNA, 203 bp, Homo sapiens
  source 1..203: mol_type = other DNA
ggcgcgccagtcctcctctggaccgggaggcaggacagagcggggaaagtgcgcatgcgctgactgagaagaaatatggcttcacagaagcagatggaggtagtgaccaaaggaactgggttccggcgccgccccaagaccatcactggtcttgcggggacctgcgagctgctcagaggaggagatgccgactcggaccgatg

SEQ ID NO: 11842 - DNA, 203 bp, Homo sapiens
  source 1..203: mol_type = other DNA
ggcgcgccagtccttcggcgtcccgggaggcaggacagagcggggaaagtgcgcatgcgctgactgagtcctcccatggcttcacagaagcagatggaggtagtatttccgttgttatggttccggcgccgccccaagaccatcacttacaccccggggacctgcgagctgctcagaggaggagatgccgactcggaccgatg

SEQ ID NO: 11843 - DNA, 203 bp, Homo sapiens
  source 1..203: mol_type = other DNA
ggcgcgccagtcctgcttgaggccgggcgagcagagctgcgctgcgggcgtcctgggaagggagatccggagcgaatagggggcttcgcctctggcccagccctcccgctgatcccccagccaggggtccgcaacccttgccgcatccacgaaactttgcccatagcagcgggcgggcactttgcactcgactcggaccgatg

SEQ ID NO: 11844 - DNA, 203 bp, Homo sapiens
  source 1..203: mol_type = other DNA
ggcgcgccagtcctgttcgcgaccgggcgagcagagctgcgctgcgggcgtcctgggaagggagatccggagcgaatagggggcttcgcctctggcccagccctcccgctgatccccccaggtcttacgtttaacccttgccgcatccacgaaactttgcccatagcagcgggcgggcactttgcactcgactcggaccgatg

SEQ ID NO: 11845 - DNA, 203 bp, Homo sapiens
  source 1..203: mol_type = other DNA
ggcgcgccagtccttgctcaaaccgggcgagcaggctataaggcgatacgtcctgggaagggagatccggagcgaatagggggcttcgcctctggcccagccctcccgctgatcccccagccaggggtccgcaacccttgccgcatccacgaaactttgcccatagcagcgggcgggcactttgcactcgactcggaccgatg

SEQ ID NO: 11846 - DNA, 203 bp, Homo sapiens
  source 1..203: mol_type = other DNA
ggcgcgccagtccttcaactggccggggcttagggaaggccgagccagaggcacggcgcctcgtcaaaggggctgcctggaggaggcagcctgtcagctggtgcatcagaggctgtggccaggccagctgggctcggggagcgccagcctgagaggagcgcgtgagcgtcgcgggagcctcgggcacccgactcggaccgatg

SEQ ID NO: 11847 - DNA, 203 bp, Homo sapiens
  source 1..203: mol_type = other DNA
ggcgcgccagtcctaggccaagccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgtcacccaaggaaccgagcctcgggcacccgactcggaccgatg

SEQ ID NO: 11848 - DNA, 203 bp, Homo sapiens
  source 1..203: mol_type = other DNA
ggcgcgccagtcctgcgttctgccggggcttagggaaggccgagccagcctgggtcaaagaatgtgtctcaagatactggaggaggcagcctgtcagctggtgcatcagaggctgtggccaggccagctgggctcggggagcgccagcctgagaggagcgcgtgagcgtcgcgggagcctcgggcacccgactcggaccgatg

SEQ ID NO: 11849 - DNA, 203 bp, Homo sapiens
  source 1..203: mol_type = other DNA
ggcgcgccagtcctctgtcagtccgggtcatgggagaaaccctgcgacaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggcgactcggaccgatg

SEQ ID NO: 11850 - DNA, 203 bp, Homo sapiens
  source 1..203: mol_type = other DNA
ggcgcgccagtcctgtcgatccccggtcccttttcgacaaggacagttccaaatcggaagcttgcttaacacagttctaacagtttgtttgaatagagagcagatctctggaaaaatgaaccaacgaaaaaaggtggttagaccacctttcaatatgctgaaacgcgagagaaaccgcgtatcaaccccgactcggaccgatg

SEQ ID NO: 11851 - DNA, 203 bp, Homo sapiens
  source 1..203: mol_type = other DNA
ggcgcgccagtcctgtctacttccggttcggtcagctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggcgactcggaccgatg

SEQ ID NO: 11852 - DNA, 203 bp, Homo sapiens
  source 1..203: mol_type = other DNA
ggcgcgccagtcctacactctaccgtaccttggctccgaggacgtggtgaaggagctgaagaaggctctgtgcaataagggggccgtcaatgataggctgcgctaccggaatgtcatccagcgagtgattagatctggctctcctggccatcaatacgctgtgcaaagactgctcagaccccaatccacgactcggaccgatg

SEQ ID NO: 11853 - DNA, 203 bp, Homo sapiens
  source 1..203: mol_type = other DNA
ggcgcgccagtcctgagtacctccgtaccttggctccgaggacgtggtgaaggagctgaagaaggctctgtgcaatcctcacattcaagctgataggctgcgctaccggaatgtcatcatctagtgcccggtatctggctctcctggccatcaatacgctgtgcaaagactgctcagaccccaatccacgactcggaccgatg

SEQ ID NO: 11854 - DNA, 203 bp, Homo sapiens
  source 1..203: mol_type = other DNA
ggcgcgccagtccttccaaggcccgtaccttggctccgaggacgtggtgaaggagctgaagaaggctctgtgcaatcctcacattcaagctgataggctgcgctaccggaatgtcatccagcgagtgattagatctggctctcctggccatcaatacgctgtgcaaagactgctggccaatgcgcagccgactcggaccgatg

SEQ ID NO: 11855 - DNA, 203 bp, Homo sapiens
  source 1..203: mol_type = other DNA
ggcgcgccagtcctgttatccaccgtaccttggctccgaggacgtggtgaaggagctgaagaaggctctgtgcaatcctcacattcaagctgataggctgcgctaccggaatgtcatccagcgagtgattagatctggctctcctggccatcaatacgcttcttttgccgctagcagaccccaatccacgactcggaccgatg

SEQ ID NO: 11856 - DNA, 203 bp, Homo sapiens
  source 1..203: mol_type = other DNA
ggcgcgccagtcctttcgctttccgtaccttggctccgaggacgtggtgaaggagctgaagaaggctctgtgcaatcctcacattcaagctgataggctgcgctaccggaatgtcatccagcgagtgattagccggtctgtcgaacgccatcaatacgctgtgcaaagactgctcagaccccaatccacgactcggaccgatg

SEQ ID NO: 11857 - DNA, 203 bp, Homo sapiens
  source 1..203: mol_type = other DNA
ggcgcgccagtcctgctgggcgccgtcacgtactcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactaccgactcggaccgatg

SEQ ID NO: 11858 - DNA, 203 bp, Homo sapiens
  source 1..203: mol_type = other DNA
ggcgcgccagtccttagcctttccgtcctttcaggtgtgtcgtaacgggcaactctgcagcggaaccgactactttgggtgtccgtgtttcattttattcctatactggctgcttatggtgacaattgagagattgttaccatatagctattggattggccatccggtgaccaatagagctattatatcgactcggaccgatg

SEQ ID NO: 11859 - DNA, 203 bp, Homo sapiens
  source 1..203: mol_type = other DNA
ggcgcgccagtcctcacatacgccgtggatccacgtgctttttcttgtccaatgggagccggctcccgggcgcgaaggggcggggaggaaaggaacgactgtgcgtgacgaaatattcgggcgggacctgcaacgtccgacagaacgaggggacgtaacggaggcaggttggagccgctgccgtcgcccgactcggaccgatg

SEQ ID NO: 11860 - DNA, 203 bp, Homo sapiens
  source 1..203: mol_type = other DNA
ggcgcgccagtcctctgatattccgtggatccacgtgctttttcttgtccaatgggagccggctcccgggcgcgaaggggcggggaggaaaggaacgactgtgctacgttgccagaaggggcgggacctgcaacgtccgacagaactcactagaagtttagaggcaggttggagccgctgccgtcgcccgactcggaccgatg

SEQ ID NO: 11861 - DNA, 203 bp, Homo sapiens
  source 1..203: mol_type = other DNA
ggcgcgccagtcctttacaatgccgtggatccacgtgctttttcttgtccaatgggagccgggcggaattgagactggggcggggaggaaaggaacgactgtgctacgttgccagaaggggcgggacctgcaacgtccgacagaacgaggggacgtaacggaggcaggttggagccgctgccgtcgcccgactcggaccgatg

SEQ ID NO: 11862 - DNA, 203 bp, Homo sapiens
  source 1..203: mol_type = other DNA
ggcgcgccagtcctacaactctccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgagggataggccttctcacgactcggaccgatg

SEQ ID NO: 11863 - DNA, 203 bp, Homo sapiens
  source 1..203: mol_type = other DNA
ggcgcgccagtcctatgcggcgccgtggtaaaggtggaaaaggtttgggtaagggaggagctaagcgtcatcgcaaggttttgcgcgataacatccagggcatcactaagccagctatgttttattacatcggtcgcggcggtgtcaagcgaatttctggccttatctatgaggagactcgtggtgttcgactcggaccgatg

SEQ ID NO: 11864 - DNA, 203 bp, Homo sapiens
  source 1..203: mol_type = other DNA
ggcgcgccagtccttagtgaatccgtggtaaaggtggaaaaggtttgggtaagggaggagctgttatcgggactctggttttgcgcgataacatccagggcatcactaagccagctatccggcgccttgctcgtcgcggcggtgtcaagcgaatttctggccttatctatgaggagactcgtggtgttcgactcggaccgatg

SEQ ID NO: 11865 - DNA, 203 bp, Homo sapiens
  source 1..203: mol_type = other DNA
ggcgcgccagtcctgctattggcctaaatgaggtagatgctacgtggacgagggcatgccaagacacaccttaaccctagcgggggtcgctagggtgaaatcacaccacgtgatgggagtacgacctgatagggcgctgcagaggcccactattaggctagtataaaaatctctgctgtacatggcaccgactcggaccgatg

SEQ ID NO: 11866 - DNA, 203 bp, Homo sapiens
  source 1..203: mol_type = other DNA
ggcgcgccagtcctctgccgggcctactttcagaactcacatcctttattcaggcctcggtgggagagcagggggaggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11867 - DNA, 203 bp, Homo sapiens
  source 1..203: mol_type = other DNA
ggcgcgccagtcctctaaatgtcctactttcagacactgtccagcaccagggcaaaggccgtggagagcagggggaggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11868 - DNA, 203 bp, Homo sapiens
  source 1..203: mol_type = other DNA
ggcgcgccagtcctctgctcctcctactttcagacactgtccagcaccttcaggcctcggtgcccataacattaagggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11869 - DNA, 203 bp, Homo sapiens
  source 1..203: mol_type = other DNA
ggcgcgccagtccttatccatgcctactttcagacactgtccagcaccttcaggcctcggtgggagagcagggggaggggagcaccatcttgcaacacatcagcacccttgagagcatatatcagagggaccccctgaagctggtgagacaggatcacgcaatacttcaaggagagaaaaaagctgttcgactcggaccgatg

SEQ ID NO: 11870 - DNA, 203 bp, Homo sapiens
  source 1..203: mol_type = other DNA
ggcgcgccagtcctcttatacccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttcgactcggaccgatg

SEQ ID NO: 11871 - DNA, 203 bp, Homo sapiens
  source 1..203: mol_type = other DNA
ggcgcgccagtcctaagccggtcctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagttgggtttatgccgcgactcggaccgatg

SEQ ID NO: 11872 - DNA, 203 bp, Homo sapiens
  source 1..203: mol_type = other DNA
ggcgcgccagtcctccgcaggtcctagcacgcggctatgggtgtgaagccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggatgggacgactcggaccgatg

SEQ ID NO: 11873 - DNA, 203 bp, Homo sapiens
  source 1..203: mol_type = other DNA
ggcgcgccagtcctggaacgcccctatttatgctgacagctataggctaacgcccataaagagcagctggggtattccttaggggctgagtctcctggtatccctaagactgggcttggcttaggcactgagattccttctggaaccccaacgccttcgagacggattccgacctgccggctggatggcgactcggaccgatg

SEQ ID NO: 11874 - DNA, 203 bp, Homo sapiens
  source 1..203: mol_type = other DNA
ggcgcgccagtcctatatctaacctatttatgctgacagctataggctctgcagggccccagctgcgccatcgtaaccttaggggctgagtctcctggtatccctaagactgggcttggcttaggcactgagattccttctggaaccccaacgccttcgagacggattccgacctgccggctggatggcgactcggaccgatg

SEQ ID NO: 11875 - DNA, 203 bp, Homo sapiens
  source 1..203: mol_type = other DNA
ggcgcgccagtccttacaggcacctatttatgctgacagctataggctctgcagggccccaggcagctggggtattccttaggggctgagcgcgtgacccggagtaagactgggcttggcttaggcactgagattccttctggaaccccaacgccttcgagacggattccgacctgccggctggatggcgactcggaccgatg

SEQ ID NO: 11876 - DNA, 203 bp, Homo sapiens
  source 1..203: mol_type = other DNA
ggcgcgccagtcctatttatgtcctatttatgctgacagctataggctctgcagggccccaggcagctggggtattccttaggggctgagtctcctggtatccccgtactgatcgcctgcttaggcactgagattccttctggaaccccaacgccttcgagacggattccgacctgccggctggatggcgactcggaccgatg

SEQ ID NO: 11877 - DNA, 203 bp, Homo sapiens
  source 1..203: mol_type = other DNA
ggcgcgccagtccttggttcaacctatttatgctgacagctataggctctgcagggccccaggcagctggggtattccttaggggctgagtctcctggtatccctaagactgggcttgctaactaagacccaattccttctggaaccccaacgccttcgagacggattccgacctgccggctggatggcgactcggaccgatg

SEQ ID NO: 11878 - DNA, 203 bp, Homo sapiens
  source 1..203: mol_type = other DNA
ggcgcgccagtcctcacgcctccctatttatgctgacagctataggctctgcagggccccaggcagctggggtattccttaggggctgagtctcctggtatccctaagactgggcttggcttaggcactgagattccttctggaaccccaacgccttcgacttaaccgggagtgtgccggctggatggcgactcggaccgatg

SEQ ID NO: 11879 - DNA, 203 bp, Homo sapiens
  source 1..203: mol_type = other DNA
ggcgcgccagtccttagatttccctatttatgctgacagctataggctctgcagggccccaggcagctggggtattccttaggggctgagtctcctggtatccctaagactgggcttggcttaggcactgagattccttctggaaccccaacgccttcgagacggattccgaccctattctcattgaacgactcggaccgatg

SEQ ID NO: 11880 - DNA, 203 bp, Homo sapiens
  source 1..203: mol_type = other DNA
ggcgcgccagtcctgggtccgacctcagcggcttccgtcctgcagcaagtccggaagaaggtccgggggctggagtcctgggacctagctcgggaccggcctggagatggagttcgactgcgagggcctgagacggctgcttggcaagtacaagttcagggacctaactgtggagtcctactaatgatcgactcggaccgatg

SEQ ID NO: 11881 - DNA, 203 bp, Homo sapiens
  source 1..203: mol_type = other DNA
ggcgcgccagtcctggcgggcacctcagcggcttccgtcctgcagcaagtccggaagaaggtccgggggctggagtcctgggacctagctcgggaccggcctggagatggagttcgactgcgagggcctgagcatttgaaggatggagtacaagttcagggacctaactgtggaagaactaaggaatgcgactcggaccgatg

SEQ ID NO: 11882 - DNA, 203 bp, Homo sapiens
  source 1..203: mol_type = other DNA
ggcgcgccagtcctgcttaacacctcagcggctttatgaagtgcagctgtccggaagaaggtccgggggctggagtcctgggacctagctcgggaccggcctggagatggagttcgactgcgagggcctgagacggctgcttggcaagtacaagttcagggacctaactgtggaagaactaaggaatgcgactcggaccgatg

SEQ ID NO: 11883 - DNA, 203 bp, Homo sapiens
  source 1..203: mol_type = other DNA
ggcgcgccagtcctggttgacccctctgagctattccagaagtagtgaggaggcttttttggaggcctaggcttttgcaaaaagctttgcaaagatggataaagcccctggtcagttcgaatctttgcagctaatggaccttctaggtcttgaaaggagtgcctgggggaatattcctctgatgagaacgactcggaccgatg

SEQ ID NO: 11884 - DNA, 203 bp, Homo sapiens
  source 1..203: mol_type = other DNA
ggcgcgccagtccttctagttgcctctgagctattccagaagtagtgaggaggcttttttggaggcctaggcttttgcaaaaagctttgcaaagatggataaagttttaaacagagaggaatctttgcagctaatggaccttctagactggtccccttacgcctgggggaatattcctctgatgagaacgactcggaccgatg

SEQ ID NO: 11885 - DNA, 203 bp, Homo sapiens
  source 1..203: mol_type = other DNA
ggcgcgccagtcctccacaccacctctgtagggaagccaagaatgtccaggaggtaccccttcctctcggaagggatctgacctggagacacatcacacgtgctaattctagagatgggtgtttaaaaattgttacagcttccccgaaccaagtggtcttggttttcactttttatcacactgtcaatcgactcggaccgatg

SEQ ID NO: 11886 - DNA, 203 bp, Homo sapiens
  source 1..203: mol_type = other DNA
ggcgcgccagtcctgatggtgacctctgtagggaagccaagaatgtccaggaggtaccccttcctctcggaagggatctgacctggagacacatcacacgtgctttacacctgtgctttgtaggtgtttcgcttacagcttccccgaaccaagtggtcttggttttcactttttatcacactgtcaatcgactcggaccgatg

SEQ ID NO: 11887 - DNA, 203 bp, Homo sapiens
  source 1..203: mol_type = other DNA
ggcgcgccagtcctgatcttatcctctgtagggaagccaagaatgtccaggaggtaccccttgtatatcatgaacctctgacctggagacacatcacacgtgctttacacctgtgcttgtgtttaaaaattgttacagcttccccgaaccaagtggtcttggttttcactttttatcacactgtcaatcgactcggaccgatg

SEQ ID NO: 11888 - DNA, 203 bp, Homo sapiens
  source 1..203: mol_type = other DNA
ggcgcgccagtcctgactaatacctctgtagggactttgtactgactgaggaggtaccccttcctctcggaagggatctgacctggagacacatcacacgtgctttacacctgtgcttgtgtttaaaaattgttacagcttccccgaaccaagtggtcttggttttcactttttatcacactgtcaatcgactcggaccgatg

SEQ ID NO: 11889 - DNA, 203 bp, Homo sapiens
  source 1..203: mol_type = other DNA
ggcgcgccagtcctcgcgctaacctgaagcggccgggccaggccctgcctcgatcctcagctcgtcctccccgccccgcaccggccttcactctggagcggccccggcagccgcagcaggggcggcggcggcggatcgaggagctccgtgtagaaggggcggagaggctgctgcagtcccgggacaggcgactcggaccgatg

SEQ ID NO: 11890 - DNA, 203 bp, Homo sapiens
  source 1..203: mol_type = other DNA
ggcgcgccagtccttagtttctcctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgctccagaactctgctcgactcggaccgatg

SEQ ID NO: 11891 - DNA, 203 bp, Homo sapiens
  source 1..203: mol_type = other DNA
ggcgcgccagtcctggccaaatcctgaagcggccgggccaggccctgcctcgatcctcagctcgtcctccccgccccgcaccggccttcactctggagcggccccggcagccgcagcatacaaacattgcatggatcgaggagctctccaggtcgtcccgggagaggctgctgcagtcccgggacaggcgactcggaccgatg

SEQ ID NO: 11892 - DNA, 203 bp, Homo sapiens
  source 1..203: mol_type = other DNA
ggcgcgccagtcctttctgttgcctgaagcggccgggccaggccctgcctcgatcctcagcttagatcttgtagatcgcaccggccttcactctggagcggccccggcagccgcagcaggggcggcggcggcggatcgaggagctctccaggtcgtcccgggagaggctgctgcagtcccgggacaggcgactcggaccgatg

SEQ ID NO: 11893 - DNA, 203 bp, Homo sapiens
  source 1..203: mol_type = other DNA
ggcgcgccagtccttgaagagtcctgaatgcggctaaccttaaccctagagccttatgccacgatccagtggttgtaaggtcgtaatgagcaattccgggacgggaccgactactttgggtgtccgtgtttccgcacaacaacgtgattgtcttatggtcacagcatatatatacatatactgtgatccgactcggaccgatg

SEQ ID NO: 11894 - DNA, 203 bp, Homo sapiens
  source 1..203: mol_type = other DNA
ggcgcgccagtcctcttgacagcctgaatgcggctaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 11895 - DNA, 203 bp, Homo sapiens
  source 1..203: mol_type = other DNA
ggcgcgccagtcctgtcaaatgcctgaatgcggctaaccttaaccctagagccttatgccacgatccagtggttgtaaggtcgtaatgagcaattccgggacgggaccgactactttgggtgtccgtgtttctcatttttcttcatattgtcttatggtctgcctcgcatgtctcatatactgtgatccgactcggaccgatg

SEQ ID NO: 11896 - DNA, 203 bp, Homo sapiens
  source 1..203: mol_type = other DNA
ggcgcgccagtccttacgccctcctgaatgcggctaaccttaaccctagagccttatgccacgatccagtggttgtaaggtcgtaatgagcaattccgggacgggaccgactactttgggtgtccgtgtttctcatttttcttcatgacagtaatcctagacagcatatatatacatatactgtgatccgactcggaccgatg

SEQ ID NO: 11897 - DNA, 203 bp, Homo sapiens
  source 1..203: mol_type = other DNA
ggcgcgccagtcctgacctgaacctgaatgcggctaaccttaaccctagagccttatgccacgatccagtggttgtaaggtcgtaatgaggtggatacacctatgaccgactactttgggtgtccgtgtttctcatttttcttcatattgtcttatggtcacagcatatatatacatatactgtgatccgactcggaccgatg

SEQ ID NO: 11898 - DNA, 203 bp, Homo sapiens
  source 1..203: mol_type = other DNA
ggcgcgccagtcctagcacttgcctgaatgcggctaaccttaaccctatgaagagcaatgcagatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 11899 - DNA, 203 bp, Homo sapiens
  source 1..203: mol_type = other DNA
ggcgcgccagtcctgcgcaacgcctgatgtcttcatcattctcaaattcttaggacggtcggattagtttgcctcagctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 11900 - DNA, 203 bp, Homo sapiens
  source 1..203: mol_type = other DNA
ggcgcgccagtcctccgtctatcctgatgtcttcatcattctcaaattcttaggacggtcgggccctggaaggaacgctctcggaattggccgcggaaaccgatgacagatggagagatgtgaaacagagaaagataggcggccatggtccaaccttgaaggaggcagcccaatatggcaagaaggtgcgactcggaccgatg

SEQ ID NO: 11901 - DNA, 203 bp, Homo sapiens
  source 1..203: mol_type = other DNA
ggcgcgccagtccttacggagtcctgatgtcttcatcattctcaaattcttaggacggtcgggccctggaaggaacgctctcggaattggggagacgcgatatgctgcccgttgtgtttgtgaaacagagaaagataggcggccatggtccaaccttgaaggaggcagcccaatatggcaagaaggtgcgactcggaccgatg

SEQ ID NO: 11902 - DNA, 203 bp, Homo sapiens
  source 1..203: mol_type = other DNA
ggcgcgccagtcctgtgcagagcctgatgtcttcatcattctcaaatttgctcagtttgaatgccctggaaggaacgctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 11903 - DNA, 203 bp, Homo sapiens
  source 1..203: mol_type = other DNA
ggcgcgccagtcctgtttgtctcctgatgtcttcgaagagggacgcaacttaggacggtcgggccctggaaggaacgctctcggaattggccgcggaaaccgatctgcccgttgtgtttgtgaaacagagaaagataggcggccatggtccaaccttgaaggaggcagcccaatatggcaagaaggtgcgactcggaccgatg

SEQ ID NO: 11904 - DNA, 203 bp, Homo sapiens
  source 1..203: mol_type = other DNA
ggcgcgccagtcctctaaggtacctgccctccggcccctctgcagctagatttgtacgacgatctcggcaaacatactccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11905 - DNA, 203 bp, Homo sapiens
  source 1..203: mol_type = other DNA
ggcgcgccagtcctaacactaccctgccctccggcccctctgcagctatgaggtcctccgtcgagatcggcgtgcgctccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11906 - DNA, 203 bp, Homo sapiens
  source 1..203: mol_type = other DNA
ggcgcgccagtccttcgtgcggcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11907 - DNA, 203 bp, Homo sapiens
  source 1..203: mol_type = other DNA
ggcgcgccagtccttattgtgccctgccctccggcccctctgcagctatgaggtcctccgtctctcggcaaacatactccacaaaaggggttgggctagtggtttctgccagcggagggagtgggtcccaggcccgcaccagcttcagctcagtgacggtgtctcggagcagtggcagtggtggcgggcgactcggaccgatg

SEQ ID NO: 11908 - DNA, 203 bp, Homo sapiens
  source 1..203: mol_type = other DNA
ggcgcgccagtcctcgcaaagccctgccctccggcccctctgcagctatgaggtcctccgtctctcggcaaacatagctatgtgttatccgcttcagctccaactctgccagcggagggagtgggtcccaggcccgcaccagcttcagctcagtgacggtgtctcggagcagtggcagtggtggcgggcgactcggaccgatg

SEQ ID NO: 11909 - DNA, 203 bp, Homo sapiens
  source 1..203: mol_type = other DNA
ggcgcgccagtccttccttcagcctgccctccggcccctctgcagctatgaggtcctccgttgggactaccgcaccacttccaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11910 - DNA, 203 bp, Homo sapiens
  source 1..203: mol_type = other DNA
ggcgcgccagtcctcctcaaaccctgccctccggggtggactgtttggtgaggtcctccgtctctcggcaaacatactccacaaaagggggcttcagctccaactctgccagcggagggagtgggtcccaggcccgcaccagcttcagctcagtgacggtgtctcggagcagtggcagtggtggcgggcgactcggaccgatg

SEQ ID NO: 11911 - DNA, 203 bp, Homo sapiens
  source 1..203: mol_type = other DNA
ggcgcgccagtcctatcacgctcctggacatcaagattgccaagggaggagccgacaaacagataggttggagcatgctgcggaaggagatgatggcgatttggcccaatctgtcccagaagacgctagacctgctggtcacacctcacaagtccacggacctcaccgtggggaagatctacgcagcccgactcggaccgatg

SEQ ID NO: 11912 - DNA, 203 bp, Homo sapiens
  source 1..203: mol_type = other DNA
ggcgcgccagtccttccaatttcctggacatcaagattgccaagggaggagccgacaaacagcagatggacgctgactgcttaggctcattgatggcgatttggcccaatctgtcccagaagacgctagacctgctggtcacacctcacaagtccacggacctcaccgtggggaagatctacgcagcccgactcggaccgatg

SEQ ID NO: 11913 - DNA, 203 bp, Homo sapiens
  source 1..203: mol_type = other DNA
ggcgcgccagtcctcattgactcctggacatcaagattgccaagggaggagccgacaaacagcagatggacgctgagctgcggaaggagatgatggcgatttggcccaatctgtcccaatctgttaaccgtatgctggtcacacctcacaagtccacggacctcaccgtggggaagatctacgcagcccgactcggaccgatg

SEQ ID NO: 11914 - DNA, 203 bp, Homo sapiens
  source 1..203: mol_type = other DNA
ggcgcgccagtcctagcgacctcctggacatcaagattgccaagggaggagccgacaaacagcagatggacgctgagctgcggaaggagatgatggcgatttggcccaatctgtcccagaagacgctagacctgctggtcacacctttggctatattatccctcaccgtggggaagatctacgcagcccgactcggaccgatg

SEQ ID NO: 11915 - DNA, 203 bp, Homo sapiens
  source 1..203: mol_type = other DNA
ggcgcgccagtcctagttagcgcctggagatttgggcgtgcccccgcaagactgctagccgagtagtgttgggtcgcgaaaggccttgtggtactgcctgatagggtgcttgcgagtgagggtccttactcggtagaccgtgcaccatgagcacgaatcctaaacctcaaagaaaaaccaaacgtaaccgactcggaccgatg

SEQ ID NO: 11916 - DNA, 203 bp, Homo sapiens
  source 1..203: mol_type = other DNA
ggcgcgccagtccttcgccaatcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 11917 - DNA, 203 bp, Homo sapiens
  source 1..203: mol_type = other DNA
ggcgcgccagtccttcacccgccctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaattcattgggaagtacgactcggaccgatg

SEQ ID NO: 11918 - DNA, 203 bp, Homo sapiens
  source 1..203: mol_type = other DNA
ggcgcgccagtcctcataaatacctggagatttgggcgtgcccccgcaagactgctagccgagtagtgttgggtcgcgaaaggccttgtggtactgcctgatagggtgcttgcgagtgccccgggaggtctcgtagaccgtgcaccgattaacacccgaataaacctcaaagaaaaaccaaacgtaaccgactcggaccgatg

SEQ ID NO: 11919 - DNA, 203 bp, Homo sapiens
  source 1..203: mol_type = other DNA
ggcgcgccagtcctacattattcctggagatttgggcgtgcccccgcaagactgctagccgagtagtgttgggtcggtttctcagcaaaagtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 11920 - DNA, 203 bp, Homo sapiens
  source 1..203: mol_type = other DNA
ggcgcgccagtcctagaagccgcctggagatttgtcatccgtaggcgcagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 11921 - DNA, 203 bp, Homo sapiens
  source 1..203: mol_type = other DNA
ggcgcgccagtcctagtccgcccctggtggcaatcccttcccttaggagcatgagtgtggtccgacacgatgggtcggcttggctgtggttgctggtttgcttccccctcgcggggggggtgctcttcaactcgcggcaccagtgcttcaatggggaccattatgtgctttccaattgttgttcccgacgactcggaccgatg

SEQ ID NO: 11922 - DNA, 203 bp, Homo sapiens
  source 1..203: mol_type = other DNA
ggcgcgccagtcctgaacctggcctggtggcaatcccttcccttaggagcatgagtgtggtcgacacattcaccatacgcctcagagaaatgctggtttgcttccccctcgcggggggggtgctcttcaactcgcggcaccagtgcttcaatggggaccattatgtgctttccaattgttgttcccgacgactcggaccgatg

SEQ ID NO: 11923 - DNA, 203 bp, Homo sapiens
  source 1..203: mol_type = other DNA
ggcgcgccagtcctagagtttacctggtggcaatcccttcccttaggagcatgagtgtggtcgacacattcaccatggcttggctgtggtactgcaccgagaagcccctcgcggggggggtgctcttcaactcgcggcaccagtgcttcaatggggaccattatgtgctttccaattgttgttcccgacgactcggaccgatg

SEQ ID NO: 11924 - DNA, 203 bp, Homo sapiens
  source 1..203: mol_type = other DNA
ggcgcgccagtccttgaaaccacctggtggcaatcccttcccttaggagcatgagtgtggtcgacacattcaccatggcttggctgtggttgctggtttgcttccccctcgcggggggaagaacgcgttttacgcggcaccagtgcttcaatggggaccattatgtgctttccaattgttgttcccgacgactcggaccgatg

SEQ ID NO: 11925 - DNA, 203 bp, Homo sapiens
  source 1..203: mol_type = other DNA
ggcgcgccagtcctgcagcctgcctggtggcaatcccttcccttaggagcatgagtgtggtcgacacattcaccatggcttggctgtggttgctggtttgcttccccctcgcggggggggtgctcttcaactatatttcagccgatttcaatggggaccattatgtgctttccaattgttgttcccgacgactcggaccgatg

SEQ ID NO: 11926 - DNA, 203 bp, Homo sapiens
  source 1..203: mol_type = other DNA
ggcgcgccagtccttgttatggcctggtggcaatcccttcccttaggagcatgagtgtggtcgacacattcaccatggcttggctgtggttgctggtttgcttccccctcgcggggggggtgctcttcaactcgcggcaccagtgccattcgaattctgcttatgtgctttccaattgttgttcccgacgactcggaccgatg

SEQ ID NO: 11927 - DNA, 203 bp, Homo sapiens
  source 1..203: mol_type = other DNA
ggcgcgccagtcctgcccgtgacctggtggcaatcccttcccttaggagcatgagtgtggtcgacacattcaccatggcttggctgtggttgctggtttgcttccccctcgcggggggggtgctcttcaactcgcggcaccagtgcttcaatggggaccattatgtgctttccaattgttgttcccgacgactcggaccgatg

SEQ ID NO: 11928 - DNA, 203 bp, Homo sapiens
  source 1..203: mol_type = other DNA
ggcgcgccagtccttgacgggccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaaccccgactcggaccgatg

SEQ ID NO: 11929 - DNA, 203 bp, Homo sapiens
  source 1..203: mol_type = other DNA
ggcgcgccagtcctgcgtgtaacctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggcgtcagaacaatgatcttggataaaccccgactcggaccgatg

SEQ ID NO: 11930 - DNA, 203 bp, Homo sapiens
  source 1..203: mol_type = other DNA
ggcgcgccagtcctctcgttgtcctgtgaggaactactgtcttcacgcagaaagcgtctagccatggcgttagtatgagtgtcgtgcagcctccaggaccccccctcccgggagagcctcgacaagacagtaaaccggtgagtacaccggaattgccaggacgaccgggtcctttcttggataaaccccgactcggaccgatg

SEQ ID NO: 11931 - DNA, 203 bp, Homo sapiens
  source 1..203: mol_type = other DNA
ggcgcgccagtccttcagaagacctgtgaggaactactgtcttcacgcagaaagcgtctagccatggcgttagtatgagtgtcgtgcagcctccaggaccccccgaggtccatcctgtatagtggtctgcggaaccggtgagtacaccggaattgccaggacgaccgggtcctttcttggataaaccccgactcggaccgatg

SEQ ID NO: 11932 - DNA, 203 bp, Homo sapiens
  source 1..203: mol_type = other DNA
ggcgcgccagtccttggactgacctgtgaggaactactgtcttcacgcgacggtgtcgggtgcatggcgttagtatgagtgtcgtgcagcctccaggaccccccctcccgggagagccatagtggtctgcggaaccggtgagtacaccggaattgccaggacgaccgggtcctttcttggataaaccccgactcggaccgatg

SEQ ID NO: 11933 - DNA, 203 bp, Homo sapiens
  source 1..203: mol_type = other DNA
ggcgcgccagtccttctaacgaccttaagtcataatgaatcaattatctgaattacttggatttgatcttaatccataaattataataaatatcaactagcaaatcaatgtcactaacaccattagttaatataaaacttgacagaagataaaaatggggcaaataaatcaattcagccgacccaacccgactcggaccgatg

SEQ ID NO: 11934 - DNA, 203 bp, Homo sapiens
  source 1..203: mol_type = other DNA
ggcgcgccagtcctgtttggacccttctgatggtaccaccttttagagttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 11935 - DNA, 203 bp, Homo sapiens
  source 1..203: mol_type = other DNA
ggcgcgccagtcctgcagattcccttctgatggtgaatgggaactccccatgggtctggctcgcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 11936 - DNA, 203 bp, Homo sapiens
  source 1..203: mol_type = other DNA
ggcgcgccagtcctggctttcaccttctgatggtgaatgggaactcccttcctcctgcagcagcctgcctgcagctactagttctttctcgtgtggacattgcagaagctgtcactgccccagaaagaaagcaccccagagccaaggcaaagagtcttgaaagcgccacaagcagcagctgctgagcccgactcggaccgatg

SEQ ID NO: 11937 - DNA, 203 bp, Homo sapiens
  source 1..203: mol_type = other DNA
ggcgcgccagtcctacagatagccttctgatggtgaatgggaactcccttcctcctgcagcagcctgcctgcagctgtcctggtagaacaagacaacatcattcgaagctgtcactgccccagaaagaaagcaccccagagccaaggcaaagagtcttgaaagcgccacaagcagcagctgctgagcccgactcggaccgatg

SEQ ID NO: 11938 - DNA, 203 bp, Homo sapiens
  source 1..203: mol_type = other DNA
ggcgcgccagtccttgcgtatcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcatagctcctcacctgcgactcggaccgatg

SEQ ID NO: 11939 - DNA, 203 bp, Homo sapiens
  source 1..203: mol_type = other DNA
ggcgcgccagtccttactaccaccttctgatggtgaatgggaactcccttcctcctgcagcagcctgcctgcagctgtcctggtagaacagtgtggacattgcagaagctgtcactgccccagaaagaaagcaccccagagccaagtgtcctgcctaccgaagcgccacaagcagcagctgctgagcccgactcggaccgatg

SEQ ID NO: 11940 - DNA, 203 bp, Homo sapiens
  source 1..203: mol_type = other DNA
ggcgcgccagtcctgattagatccttctgatggtgaatgggaactcccttcctcctgcagcagcctgcctgcagctgtcctggtagaacagtgtggacattgcagaagctgtcactgccccagaaagaaagcttatatacttttgagcaaagagtcttgaaagcgccacaagcagcagctgctgagcccgactcggaccgatg

SEQ ID NO: 11941 - DNA, 203 bp, Homo sapiens
  source 1..203: mol_type = other DNA
ggcgcgccagtcctatagcaggcctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgtacatgtcatagggtcgactcggaccgatg

SEQ ID NO: 11942 - DNA, 203 bp, Homo sapiens
  source 1..203: mol_type = other DNA
ggcgcgccagtcctgcgttacccctttcccctcccttccctatccccgacgaccggatcctgaggaggcagctgcggtggcagctgctgagttctcggtgaaggtatttcatttctcctgtcccctcccctcgagcattataagcgtaatattattcttttgaagattcttcgttgtcaagccgccaacgactcggaccgatg

SEQ ID NO: 11943 - DNA, 203 bp, Homo sapiens
  source 1..203: mol_type = other DNA
ggcgcgccagtcctaactatcgcctttcccctcccttccctatccccgacgaccggatcctgttctaaatatcctcgtggcagctgctgagttctcggtgaaggtatttcatttctcctgtcccctcccctccccaccccatctattaatattattcttttgaagattcttcgttgtcaagccgccaacgactcggaccgatg

SEQ ID NO: 11944 - DNA, 203 bp, Homo sapiens
  source 1..203: mol_type = other DNA
ggcgcgccagtcctctcagagacgaacccactcagagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagcgactcggaccgatg

SEQ ID NO: 11945 - DNA, 203 bp, Homo sapiens
  source 1..203: mol_type = other DNA
ggcgcgccagtcctataaagttcgaatttagcgtttaaccctgcagctagagcacgtaacccaatgtgtatctagtcgtaatgagcaattgcgggatgggaccaactactttgggtgtccgtgtttcactttttcctttatatttgcttatggtgacaatatatacaatatatatattggcaccatggcgactcggaccgatg

SEQ ID NO: 11946 - DNA, 203 bp, Homo sapiens
  source 1..203: mol_type = other DNA
ggcgcgccagtcctaaggagcgcgacacacatgttccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccacttcgactcggaccgatg

SEQ ID NO: 11947 - DNA, 203 bp, Homo sapiens
  source 1..203: mol_type = other DNA
ggcgcgccagtcctgaccactccgaccccagtcgatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 11948 - DNA, 203 bp, Homo sapiens
  source 1..203: mol_type = other DNA
ggcgcgccagtcctgtcattctcgaccgcattgcaatccccagcagagacccagtgcatgtggcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11949 - DNA, 203 bp, Homo sapiens
  source 1..203: mol_type = other DNA
ggcgcgccagtcctctgcaatacgaccgcattgcggcttggttttctcacccagtgcatgtgaggaataattctccatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11950 - DNA, 203 bp, Homo sapiens
  source 1..203: mol_type = other DNA
ggcgcgccagtcctacttcgaacgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11951 - DNA, 203 bp, Homo sapiens
  source 1..203: mol_type = other DNA
ggcgcgccagtcctctctgatccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgtgaataaaagagagcgactcggaccgatg

SEQ ID NO: 11952 - DNA, 203 bp, Homo sapiens
  source 1..203: mol_type = other DNA
ggcgcgccagtccttgcaggaccgaccgcattgcggcttggttttctcacccagtgcatgtggcaggagcggtgagatcactgcctcacggcgatcctggactgacggtcacgactgcctaccctctaaccctgttctgagctgccgtaaaatacagggtcccaaacctgtgtgcaggatccgcctcccgactcggaccgatg

SEQ ID NO: 11953 - DNA, 203 bp, Homo sapiens
  source 1..203: mol_type = other DNA
ggcgcgccagtcctatccttcccgaccgcattgcggcttggttttctcacccagtgcatgtggcaggagcggtgagatcactgcctcacggcgatcctggactggaataattccaatactaccctctaaccctgttctgagctgccccttgcccacacaccccaaacctgtgtgcaggatccgcctcccgactcggaccgatg

SEQ ID NO: 11954 - DNA, 203 bp, Homo sapiens
  source 1..203: mol_type = other DNA
ggcgcgccagtcctgattcgcccgaccgcattgcggcttggttttctcacccagtgcatgtggcaggagcggtgagcctctccagagtacgcgatcctggactgacggtcacgactgcctaccctctaaccctgttctgagctgccccttgcccacacaccccaaacctgtgtgcaggatccgcctcccgactcggaccgatg

SEQ ID NO: 11955 - DNA, 203 bp, Homo sapiens
  source 1..203: mol_type = other DNA
ggcgcgccagtcctggatgggacgaccgcattgcggcttggttttctcggttcaaaatacacgcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 11956 - DNA, 203 bp, Homo sapiens
  source 1..203: mol_type = other DNA
ggcgcgccagtcctaccaactgcgactcgccctcggccttccgcgccagccgcagccacagcattcctagactgtacagccacagccacagccacagccccaggcatagccttcggcacagccccggctccggctcctgcggcagctcctctgggcaccgtccctgcgccgacatcctggaggttgggcgactcggaccgatg

SEQ ID NO: 11957 - DNA, 203 bp, Homo sapiens
  source 1..203: mol_type = other DNA
ggcgcgccagtcctggaatcaacgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacaatagacgtcaccctcgactcggaccgatg

SEQ ID NO: 11958 - DNA, 203 bp, Homo sapiens
  source 1..203: mol_type = other DNA
ggcgcgccagtcctgcattgtacgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggcgactcggaccgatg

SEQ ID NO: 11959 - DNA, 203 bp, Homo sapiens
  source 1..203: mol_type = other DNA
ggcgcgccagtcctaactgattcgagatgccacgtggacgagggcatgcccaaagcacatcttaacctgagcgggggtcgcccaggtaaaagcagttttaaccgactgttacgaatacagcctgatagggtgggttttcattgggatgtattgctactaaaaatctctgctgtacatggcacatggagcgactcggaccgatg

SEQ ID NO: 11960 - DNA, 203 bp, Homo sapiens
  source 1..203: mol_type = other DNA
ggcgcgccagtcctggcacacgcgatctcttgtcagatctcattaaataagcgtgcccatgtcaagattccctgttatccatgcttgtgagtgtggtttaatcataatcttgtattttactttccacacttttcatctctctgccagtgacgtgttggttgtcctcagcgtccctcccataggtcgcacgactcggaccgatg

SEQ ID NO: 11961 - DNA, 203 bp, Homo sapiens
  source 1..203: mol_type = other DNA
ggcgcgccagtccttcgatcgtcgatctcttgtcagatctcattaaatctaaactttttaaacaagattccctgttatccatgcttgtgacctgacaaccgctttaatcttgtattttactttccacacttttcatctctctgccagtgacgtgttggttgtcctcagcgtccctcccataggtcgcacgactcggaccgatg

SEQ ID NO: 11962 - DNA, 203 bp, Homo sapiens
  source 1..203: mol_type = other DNA
ggcgcgccagtcctgatccagacgatctcttgtcagatctcattaaatctaaactttttaaacaagattccctgttatccatgcttgtgagtgtggtttaatcacgcatggccggccgactttccacacttttcatctctctgccagtgacgtgttggttgtcctcagcgtccctcccataggtcgcacgactcggaccgatg

SEQ ID NO: 11963 - DNA, 203 bp, Homo sapiens
  source 1..203: mol_type = other DNA
ggcgcgccagtccttggagtagcgatctcttgtccttagaatggttcgctaaactttttaaacaagattccctgttatccatgcttgtgagtgtggtttaatcataatcttgtattttactttccacacttttcatctctctgccagtgacgtgttggttgtcctcagcgtccctcccataggtcgcacgactcggaccgatg

SEQ ID NO: 11964 - DNA, 203 bp, Homo sapiens
  source 1..203: mol_type = other DNA
ggcgcgccagtcctacttgtcacgattgtgttaggccgttctcagcgctgcccgaccccgctcgcgcgccctcccgccgccagtcccggcagcgccctcagttgtcctccgactcgccctcggccttccgcgccagccgcagccacagccgcaacgccacccgcagccacagccacagccacagcccccgactcggaccgatg

SEQ ID NO: 11965 - DNA, 203 bp, Homo sapiens
  source 1..203: mol_type = other DNA
ggcgcgccagtccttttacgaccgatttaaactagccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagcgactcggaccgatg

SEQ ID NO: 11966 - DNA, 203 bp, Homo sapiens
  source 1..203: mol_type = other DNA
ggcgcgccagtcctgtcgtcaacgcaaagccggtggcgcccggaggctaagtctcagatcccgcccgcgtcagagcctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11967 - DNA, 203 bp, Homo sapiens
  source 1..203: mol_type = other DNA
ggcgcgccagtccttttgtccccgcaaagccggtggcgcccggaggctctggtacccttctcgcccgcgtcagagcctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11968 - DNA, 203 bp, Homo sapiens
  source 1..203: mol_type = other DNA
ggcgcgccagtcctcagacccacgcaaagccggtggcgcccggaggctgcacggagagcggtaagatttctgccctctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11969 - DNA, 203 bp, Homo sapiens
  source 1..203: mol_type = other DNA
ggcgcgccagtcctcgcactgtcgcaaagccggtggcgcccggaggctgcacggagagcggtaatgaatatccgttctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 11970 - DNA, 203 bp, Homo sapiens
  source 1..203: mol_type = other DNA
ggcgcgccagtcctctactgcgcgcaaagccggtggcgcccggaggctgcacggagagcggtgcccgcgtcagagcaggaagtgacgcataggctggagtacagtggcgcgatctcggctcactgcaacttccacctgctgggttcaagcaattcttctgacctcagtgaccgaaggaagagaccaagcgactcggaccgatg

SEQ ID NO: 11971 - DNA, 203 bp, Homo sapiens
  source 1..203: mol_type = other DNA
ggcgcgccagtcctatacgtctcgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctggtaatgacatggctaggaagagaccaagcgactcggaccgatg

SEQ ID NO: 11972 - DNA, 203 bp, Homo sapiens
  source 1..203: mol_type = other DNA
ggcgcgccagtcctatggctcccgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctggtgaaccgataacgaggaagagaccaagcgactcggaccgatg

SEQ ID NO: 11973 - DNA, 203 bp, Homo sapiens
  source 1..203: mol_type = other DNA
ggcgcgccagtcctggtgatatcgcaaagccggtggcgcccggaggctgcacggagagcggtgcccgcgtcagagcctcgccctgtcaccaggctggagtacagtggcgcgatctcggctcactgcaacttccacctgctgggttctttactgctgcagcacctcagtgaccgaaggaagagaccaagcgactcggaccgatg

SEQ ID NO: 11974 - DNA, 203 bp, Homo sapiens
  source 1..203: mol_type = other DNA
ggcgcgccagtcctctccgtgccgcaaagccggtggcgcccggaggctgcacggagagcggtgcccgcgtcagagcctcgccctgtcaccaggctggagtacagtggcgcgatctcggctcactgcaacttctggtattcataactaagcaattcttctgacctcagtgaccgaaggaagagaccaagcgactcggaccgatg

SEQ ID NO: 11975 - DNA, 203 bp, Homo sapiens
  source 1..203: mol_type = other DNA
ggcgcgccagtcctcatatcttcgcactgcttgacggcagcggtgtccgccccacggccggcgttgccggggtaacggcgagcgcgtggggccaagaaagaatacctcctctgaaaaagaaggagtagcagattccatgccccaaagaggaaaagaagagtgtatgagacttacgagtctccattgcccgactcggaccgatg

SEQ ID NO: 11976 - DNA, 203 bp, Homo sapiens
  source 1..203: mol_type = other DNA
ggcgcgccagtcctcaccacaacgcactgcttgacggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttactctcgaaggcatagcgactcggaccgatg

SEQ ID NO: 11977 - DNA, 203 bp, Homo sapiens
  source 1..203: mol_type = other DNA
ggcgcgccagtcctcgtttgttcgcactgcttgacggcagcggtgtccgccccacggccggcgttgccggggtaacttaatcgagaacccgccaagaaagaatacctcctctgaaaaatggcagaagcagttttccatgccccaaagaggaaaagaagagtgtatgagacttacgagtctccattgcccgactcggaccgatg

SEQ ID NO: 11978 - DNA, 203 bp, Homo sapiens
  source 1..203: mol_type = other DNA
ggcgcgccagtcctaaatggcacgcactgcttgacggcagcggtgtcctttaggaccaaatggttgccggggtaacggcgagcgcgtggggccaagaaagaatacctcctctgaaaaatggcagaagcagttttccatgccccaaagaggaaaagaagagtgtatgagacttacgagtctccattgcccgactcggaccgatg

SEQ ID NO: 11979 - DNA, 203 bp, Homo sapiens
  source 1..203: mol_type = other DNA
ggcgcgccagtcctatggtagtcgcagtccagagggctgcgctgctcggggtaagtatccaaagaagggggtgacgctgggcagcggcgaggagcgcgccgctgcctctggcgggctttcggcttgaggggcaaggtgaagagcgcaccggccgtggggtttaccgagctggatttgtatgttgcacccgactcggaccgatg

SEQ ID NO: 11980 - DNA, 203 bp, Homo sapiens
  source 1..203: mol_type = other DNA
ggcgcgccagtcctactctgttcgcagtccagagggctgcgctgctcgtcccctcggctggcagaagggggtgacgctgggcagcggcgacacatcgaggttcccctctggcgggctttcggcttgaggggcaaggtgaagagcgcaccggccgtggggtttaccgagctggatttgtatgttgcacccgactcggaccgatg

SEQ ID NO: 11981 - DNA, 203 bp, Homo sapiens
  source 1..203: mol_type = other DNA
ggcgcgccagtccttttgaaatcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatcccccataaatgttcgactcggaccgatg

SEQ ID NO: 11982 - DNA, 203 bp, Homo sapiens
  source 1..203: mol_type = other DNA
ggcgcgccagtcctccggctgacgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcacccgactcggaccgatg

SEQ ID NO: 11983 - DNA, 203 bp, Homo sapiens
  source 1..203: mol_type = other DNA
ggcgcgccagtcctccacttggcgcagtccagagggctgcgctgctcgtcccctcggctggcagaagggggtgacgggcttagctcatagggagcgcgccgctgcctctggcgggctttcggcttgaggggcaaggtgaagagcgcaccggccgtggggtttaccgagctggatttgtatgttgcacccgactcggaccgatg

SEQ ID NO: 11984 - DNA, 203 bp, Homo sapiens
  source 1..203: mol_type = other DNA
ggcgcgccagtccttactctatcgccaacaaggcaatgtcaatcacttcttgtttactccgaaccccagaatccattaagaaaaacttaggagacaggtataatattctcatacctgtccattcaccttggacttaaagagagacaatcattcagccccgtccaagacacacctgagtggccagaacccgactcggaccgatg

SEQ ID NO: 11985 - DNA, 203 bp, Homo sapiens
  source 1..203: mol_type = other DNA
ggcgcgccagtcctggcacggacgccaacaaggcaatgtcaatcacttgaatgcaggggtagaccccagaatccatgcgtctgggacatagagacaggtataatattctcatacctgtccattcaccttggacttaaagagagacaatcattcagccccgtccaagacacacctgagtggccagaacccgactcggaccgatg

SEQ ID NO: 11986 - DNA, 203 bp, Homo sapiens
  source 1..203: mol_type = other DNA
ggcgcgccagtcctactggtttcgccaacaaggcaatgtcaatcacttgaatgcaggggtagaccccagaatccattaagaaaaacttagcttgggtcggattgattctcatacctgtccattcaccttggacttaaagagagacaatcattcagccccgtccaagacacacctgagtggccagaacccgactcggaccgatg

SEQ ID NO: 11987 - DNA, 203 bp, Homo sapiens
  source 1..203: mol_type = other DNA
ggcgcgccagtccttgtaagagcgccaacaaggcaatgtcaatcacttgaatgcaggggtagaccccagaatccattaagaaaaacttaggagacaggtataatattctcatacctgtccattcaccttggacttaaagagagacaatcattcagccccgtccaagacacacctcgtccttagcccggcgactcggaccgatg

SEQ ID NO: 11988 - DNA, 203 bp, Homo sapiens
  source 1..203: mol_type = other DNA
ggcgcgccagtcctagcgaaaccgccaacaaggcaatgtcaatcacttgaatgcaggggtagaccccagaatccattaagaaaaacttaggagacaggtataatattctcatacctgtccattcaccttggacttaaagagagacacaggacagtatggctccaagacacacctgagtggccagaacccgactcggaccgatg

SEQ ID NO: 11989 - DNA, 203 bp, Homo sapiens
  source 1..203: mol_type = other DNA
ggcgcgccagtcctcctagtgacgccaacaaggcaatgtcaatcacttgaatgcaggggtagaccccagaatccattaagaaaaacttaggagacaggtataatccaacgggcttatcccattcaccttggacttaaagagagacaatcattcagccccgtccaagacacacctgagtggccagaacccgactcggaccgatg

SEQ ID NO: 11990 - DNA, 203 bp, Homo sapiens
  source 1..203: mol_type = other DNA
ggcgcgccagtccttaataggccgccaacaaggctcgacgttatgggagaatgcaggggtagaccccagaatccattaagaaaaacttaggagacaggtataatattctcatacctgtccattcaccttggacttaaagagagacaatcattcagccccgtccaagacacacctgagtggccagaacccgactcggaccgatg

SEQ ID NO: 11991 - DNA, 203 bp, Homo sapiens
  source 1..203: mol_type = other DNA
ggcgcgccagtccttatgacaccgccagtcggagcccccggcccagcgtggtccgcctccctctgggcgtccacctgcccggagtactgccagcgggcatgacctcattctgtacatagccgccgccggcgctcgcaggccgcggatgaagaagaaaacccggcgccgctcgacccggagcgaggagtcgactcggaccgatg

SEQ ID NO: 11992 - DNA, 203 bp, Homo sapiens
  source 1..203: mol_type = other DNA
ggcgcgccagtccttatgtactcgccccgacccgcttactccgagtaaccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcgactcggaccgatg

SEQ ID NO: 11993 - DNA, 203 bp, Homo sapiens
  source 1..203: mol_type = other DNA
ggcgcgccagtcctcctataatcgccccgacccgtgcgagggccaggtaatgcttaaatttcccaggcgaagcgaggcgacccgcgtgcggccatggcttcgctgctgggagcctacccttggcccgagggtctcgagtgcccggccctggacgccgagctgtcggatggacaatcgccgccggccgtcgactcggaccgatg

SEQ ID NO: 11994 - DNA, 203 bp, Homo sapiens
  source 1..203: mol_type = other DNA
ggcgcgccagtccttacaatgacgccccgacccgtgcgagggccaggtccgcgcctgccccgccaggcgaagcgagattgattaacccttgccatggcttcgctgctgggagcctacccttggcccgagggtctcgagtgcccggccctggacgccgagctgtcggatggacaatcgccgccggccgtcgactcggaccgatg

SEQ ID NO: 11995 - DNA, 203 bp, Homo sapiens
  source 1..203: mol_type = other DNA
ggcgcgccagtccttccaaacgcgccctgcccccagccccgccactcccaggctcctcgggactcggcgggtcctcactcactcgaacccggggaccggctgtgcagagaacttcagccaaagcatctgagacgggaagcagaaaaaggagggacagtttggagaagaaaaacgcagctgtgtacgcccgactcggaccgatg

SEQ ID NO: 11996 - DNA, 203 bp, Homo sapiens
  source 1..203: mol_type = other DNA
ggcgcgccagtcctagtagttccgccctgcccccagccccgccactcccaggctcctcgggactcggcgggtcctcctgggagtctcggaggggaccggctgtgcagagaacttcagccaaagcatctgagacgggaagcagaaaaaggagggacagtttcctattctctggtacagctgtgtacgcccgactcggaccgatg

SEQ ID NO: 11997 - DNA, 203 bp, Homo sapiens
  source 1..203: mol_type = other DNA
ggcgcgccagtcctgttacaatcgccctgcccccagccccgccactcccaggctcctcgggactcggcgggtcctcctgggagtctcggaggggaccggctgtgcagagaacttcagccaaagcatctgagacgggaagcagaaaaaggagggacagtttggagaagaaaaacgcagctgtgtacgcccgactcggaccgatg

SEQ ID NO: 11998 - DNA, 203 bp, Homo sapiens
  source 1..203: mol_type = other DNA
ggcgcgccagtcctgcgacagccgccctgcccccagccccgccactccggaaaagtgttcatctcggcgggtcctcctgggagtctcggaggggaccggctgtgcagagaacttcagccaaagcatctgagacgggaagcagaaaaaggagggacagtttggagaagaaaaacgcagctgtgtacgcccgactcggaccgatg

SEQ ID NO: 11999 - DNA, 203 bp, Homo sapiens
  source 1..203: mol_type = other DNA
ggcgcgccagtcctcacggatgcgccgccatgctcttcttttttctataggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtcgactcggaccgatg

SEQ ID NO: 12000 - DNA, 203 bp, Homo sapiens
  source 1..203: mol_type = other DNA
ggcgcgccagtcctttgacgcacgccgccatgctgcagaagcgggagaaggtgctgctgctgaggaccttccagggccgcacgctgcggagatcatcttccatttacctgcggccctgcgtgccctgccacagcccgctctgcccgcagcccgccgcctgcagccacgatgggaaactcttgtctagtcgactcggaccgatg

SEQ ID NO: 12001 - DNA, 203 bp, Homo sapiens
  source 1..203: mol_type = other DNA
ggcgcgccagtcctcgacatttcgccgccatgctgcagaagcgggagaaggtgctgctgctgaggaccttccagggccgcacgctgcggatcgtgcgcgagcactacctgcggccctgcgtgccctgccacagcccgctctgcccgcagcccgccgcctgcagccacgatgggagctcgcgtcgagtgcgactcggaccgatg

SEQ ID NO: 12002 - DNA, 203 bp, Homo sapiens
  source 1..203: mol_type = other DNA
ggcgcgccagtcctggttagtccgccgccatgctgcagaagcgggagaaggtgctgctgctgaggaccttccagggccgcacgctgcggatcgtgcgcgagcactacctgcggccctgcgtgccctgccacagcccgctctgcccgggaataattatggtcagccacgatgggaaactcttgtctagtcgactcggaccgatg

SEQ ID NO: 12003 - DNA, 203 bp, Homo sapiens
  source 1..203: mol_type = other DNA
ggcgcgccagtcctgcgcccagcgccgccatgctgcagaagcgggagaaggtgctgctgctgaggaccttccagggccgcacgctgcggatcgtgcgcgagcactacctgcggccctgcgtgccctgccacatttactagaaaggtcagcccgccgcctgcagccacgatgggaaactcttgtctagtcgactcggaccgatg

SEQ ID NO: 12004 - DNA, 203 bp, Homo sapiens
  source 1..203: mol_type = other DNA
ggcgcgccagtccttcaccgctcgccgccatgctgcagaagcgggagaaggtgctgctgctgaggaccttccagggccgcacgctgcggatcgtgcgcgagcactacctgcggccctggcattagctaattcgcccgctctgcccgcagcccgccgcctgcagccacgatgggaaactcttgtctagtcgactcggaccgatg

SEQ ID NO: 12005 - DNA, 203 bp, Homo sapiens
  source 1..203: mol_type = other DNA
ggcgcgccagtcctacttataccgccgccgcagcaattactttgaggccccccgccgggtgcctaagcaggcccggcgcggccccaggacttgggaccctggaggactgacgctgctggcctgggcgtccccttccgctgagccatggcgactcccgacgtgagtgtgcacatggaggaggtggtggtcgactcggaccgatg

SEQ ID NO: 12006 - DNA, 203 bp, Homo sapiens
  source 1..203: mol_type = other DNA
ggcgcgccagtcctggattatccgccgccgcagctcccgacgccgccgcccccgccgggtgcctaagcaggcccggcgcggccccaggacttgggaccctggaggactgacgctgctggcctgggcgtccccttccgctgagccatcctcctgtttctgctgagtgtgcacatggaggaggtggtggtcgactcggaccgatg

SEQ ID NO: 12007 - DNA, 203 bp, Homo sapiens
  source 1..203: mol_type = other DNA
ggcgcgccagtcctagattaaacgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggtcgactcggaccgatg

SEQ ID NO: 12008 - DNA, 203 bp, Homo sapiens
  source 1..203: mol_type = other DNA
ggcgcgccagtcctcactcgaacgccgccgcagctcccgacgccgccgcccgtcggcaccgcctaagcaggcccggcgcggccccaggacttgggaccctggaggactgacgctgctggcctgggcgtccccttccgctgagccatggcattgatggacgtgagtgtgcacatggaggaggtggtggtcgactcggaccgatg

SEQ ID NO: 12009 - DNA, 203 bp, Homo sapiens
  source 1..203: mol_type = other DNA
ggcgcgccagtcctttctcggccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccggaatcgtttacgttccggcgcctccagccgactcggaccgatg

SEQ ID NO: 12010 - DNA, 203 bp, Homo sapiens
  source 1..203: mol_type = other DNA
ggcgcgccagtcctgtgcgaatcgccgggcgcacacactcgcacccgcgcacgcaccgccagcaggcagcggccaccgccgcgatgctcgcccgcgggttggggaagtttcccgccggtaggccgaatactaacccgtgctcccaggtgtagcgcccccgcgcggcgcgggcggccggcgcctccagccgactcggaccgatg

SEQ ID NO: 12011 - DNA, 203 bp, Homo sapiens
  source 1..203: mol_type = other DNA
ggcgcgccagtccttccctgtacgcctcggaattctccaaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaaccgactcggaccgatg

SEQ ID NO: 12012 - DNA, 203 bp, Homo sapiens
  source 1..203: mol_type = other DNA
ggcgcgccagtccttatactgtcgcgaagacgcaaataaaaaatattgcatacgttgacgaaacaaattttcgttgcatacccaataaaagattattatattgcataccttttcttgccataccatttagccgatcaattgtgctcggcaacagtatatttgtggtgtgccaaccaacaaccaatgagcgactcggaccgatg

SEQ ID NO: 12013 - DNA, 203 bp, Homo sapiens
  source 1..203: mol_type = other DNA
ggcgcgccagtcctaagagacacgcgccgggcgcagggagctgagtggacggctcgagacggcggcgcgtgcagcacacgggtgcgtttccgagttggcagagcagggctgcatttccagcaggagctgcgagcacagtgctggctcacaacaagatgctcaaggtgtcagccgtactgtgtgtgtgtcgactcggaccgatg

SEQ ID NO: 12014 - DNA, 203 bp, Homo sapiens
  source 1..203: mol_type = other DNA
ggcgcgccagtcctggacaacccgcgccgggcgcagggagctgagtggacggctcgagacggcggcgcgtgcagcagctccagaaagcagcgagttggcagagcagggctgcatttccagcaggagctgcgagcacagtgctggctcacaacaagatgcttggcacacggcgtttactgtgtgtgtgtcgactcggaccgatg

SEQ ID NO: 12015 - DNA, 203 bp, Homo sapiens
  source 1..203: mol_type = other DNA
ggcgcgccagtcctaattcgttcgcgccgggcgcagggagctgagtggacggctcgagacggcggcgcgtgcagcagctccagaaagcagcgagttggcagagcagggctgcatttccagcaggagctgcgagcacagtgctggctggtgctttcgaatgcaaggtgtcagccgtactgtgtgtgtgtcgactcggaccgatg

SEQ ID NO: 12016 - DNA, 203 bp, Homo sapiens
  source 1..203: mol_type = other DNA
ggcgcgccagtcctccgctgcccgcgccgggcgcagggagctgagtggacggctcgagacggcggcgcgtgcagcagctccagaaagcagcgagttggcagagcagggctgcatttccttgccacatgataggcacagtgctggctcacaacaagatgctcaaggtgtcagccgtactgtgtgtgtgtcgactcggaccgatg

SEQ ID NO: 12017 - DNA, 203 bp, Homo sapiens
  source 1..203: mol_type = other DNA
ggcgcgccagtcctagtattaacgcgccgggcgcagggagctgagtggctactcgttttgatcggcgcgtgcagcagctccagaaagcagcgagttggcagagcagggctgcatttccagcaggagctgcgagcacagtgctggctcacaacaagatgctcaaggtgtcagccgtactgtgtgtgtgtcgactcggaccgatg

SEQ ID NO: 12018 - DNA, 203 bp, Homo sapiens
  source 1..203: mol_type = other DNA
ggcgcgccagtcctactgcgtgcgcgccgggcgccaaaccggatccaaacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtcgactcggaccgatg

SEQ ID NO: 12019 - DNA, 203 bp, Homo sapiens
  source 1..203: mol_type = other DNA
ggcgcgccagtccttaagattgcgcgcgcgagagaagagagtattctcgcgagaagtccaggggtggccgtgatggcggcggcaggagcaggacctggccaggaagcgggtgccgggcctggcccaggagcgccaattcggagttaaggggcagaagagggggagatgaagccggtggcagcgggagccgactcggaccgatg

SEQ ID NO: 12020 - DNA, 203 bp, Homo sapiens
  source 1..203: mol_type = other DNA
ggcgcgccagtcctgcacctcacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagaggccacttaacttaaagtggcagcgggagccgactcggaccgatg

SEQ ID NO: 12021 - DNA, 203 bp, Homo sapiens
  source 1..203: mol_type = other DNA
ggcgcgccagtcctgggagccacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagccgactcggaccgatg

SEQ ID NO: 12022 - DNA, 203 bp, Homo sapiens
  source 1..203: mol_type = other DNA
ggcgcgccagtccttgtcgtttcgcgctcacgtccgcgtccccaagggctgcgctccctcaagcgcagtgcccagaactcggagccagcccggcccgggggaccctgctggccaaggaggtcgtcagtccgggaaaccaccattatcccggaggaccgaagcttccggacgacgaggaaccgcccaaccgactcggaccgatg

SEQ ID NO: 12023 - DNA, 203 bp, Homo sapiens
  source 1..203: mol_type = other DNA
ggcgcgccagtcctgcggatctcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaaccgactcggaccgatg

SEQ ID NO: 12024 - DNA, 203 bp, Homo sapiens
  source 1..203: mol_type = other DNA
ggcgcgccagtcctattgtcttcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgtacttatagggtctcgactcggaccgatg

SEQ ID NO: 12025 - DNA, 203 bp, Homo sapiens
  source 1..203: mol_type = other DNA
ggcgcgccagtcctcacctggtcgcgctcacgtccgcgtccccaagggctgcgctccctcaagcgcagtgcccagaactcggagccagcccggcccgggggaccctgctggccaaggaggtcgtcagtccggtcttgtcttccagatgtcagtatttttggcttccggacgacgaggaaccgcccaaccgactcggaccgatg

SEQ ID NO: 12026 - DNA, 203 bp, Homo sapiens
  source 1..203: mol_type = other DNA
ggcgcgccagtcctgttgtaaccgcgggcagcggagcgggcgccaggcacagaaccgtcccagcgctaccgggcgtcggccctgggcagtgacggggttcgggtgaccatggagagtgcgctcaccgcccgtgaccgggtgggggtgcaggatttcgtgctgctggagaacttcaccagcgaggccgccgactcggaccgatg

SEQ ID NO: 12027 - DNA, 203 bp, Homo sapiens
  source 1..203: mol_type = other DNA
ggcgcgccagtcctgcgcatgccgcgggcagcggagcgggcgccaggccggccgggcaggatgcgctaccgggcgtcggccctgggcagtcgaatctaaactcggaccatggagagtgcgctcaccgcccgtgaccgggtgggggtgcaggatttcgtgctgctggagaacttcaccagcgaggccgccgactcggaccgatg

SEQ ID NO: 12028 - DNA, 203 bp, Homo sapiens
  source 1..203: mol_type = other DNA
ggcgcgccagtcctgtgtttagcgcgggcagcggagcgggcgccaggccggccgggcaggatgcgctaccgggcgtttcgatgcccatacgacggggttcgggtgaccatggagagtgcgctcaccgcccgtgaccgggtgggggtgcaggatttcgtgctgctggagaacttcaccagcgaggccgccgactcggaccgatg

SEQ ID NO: 12029 - DNA, 203 bp, Homo sapiens
  source 1..203: mol_type = other DNA
ggcgcgccagtcctgggtaaggcgcgggcagcggtctaattttgcaaacggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccgactcggaccgatg

SEQ ID NO: 12030 - DNA, 203 bp, Homo sapiens
  source 1..203: mol_type = other DNA
ggcgcgccagtcctcgtgtcatcgcggggaggggagggcgttagccagcgtggcgctggctcccggaatatggagccctgggcgcgggggcggcgtgtcaggtggttgcggagctggtaagaatcatattctaagaactcagccacgttaccgctttgattggtgctgggtcctgaacagaagatgtccgactcggaccgatg

SEQ ID NO: 12031 - DNA, 203 bp, Homo sapiens
  source 1..203: mol_type = other DNA
ggcgcgccagtccttgcttgtgcgcggggaggggagggcgttagccagcgtggcgctggctcccggaatatggagccctgggcgcgggggcggcgtgtcaggtggttgcggagctggtaagaatcatattctaagaactcagccactcaggtatccaccatggtgctgggtccttgcggagttccaaacgactcggaccgatg

SEQ ID NO: 12032 - DNA, 203 bp, Homo sapiens
  source 1..203: mol_type = other DNA
ggcgcgccagtcctggaggcagcgcggggaggggagggcgttagccagttattgttgtcaagccggaatatggagccctgggcgcgggggcggcgtgtcaggtggttgcggagctggtaagaatcatattctaagaactcagccactcaggtatccaccatggtgctgggtcctgaacagaagatgtccgactcggaccgatg

SEQ ID NO: 12033 - DNA, 203 bp, Homo sapiens
  source 1..203: mol_type = other DNA
ggcgcgccagtcctcgcaatcgcgcggggaggggttaaataggtgagacgtggcgctggctcccggaatatggagccctgggcgcgggggcggcgtgtcaggtggttgcggagctggtaagaatcatattctaagaactcagccactcaggtatccaccatggtgctgggtcctgaacagaagatgtccgactcggaccgatg

SEQ ID NO: 12034 - DNA, 203 bp, Homo sapiens
  source 1..203: mol_type = other DNA
ggcgcgccagtcctccgtggtgcgcggtaagcgcgacgaatgttcaggagctaaccgcacccggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12035 - DNA, 203 bp, Homo sapiens
  source 1..203: mol_type = other DNA
ggcgcgccagtcctcttcagatcgcggtaagcgctgacgcatgcgcatagctaaccgcacccggttcagctcgcctgcacctcggtcaggcgccggttggactcacgggcggggcatgatggtggtgggtacgggcacctcgctggcgctcgttctattcctgtccctgctgctctttgctgggatgccgactcggaccgatg

SEQ ID NO: 12036 - DNA, 203 bp, Homo sapiens
  source 1..203: mol_type = other DNA
ggcgcgccagtcctcggcctcccgcggtaagcgctgacgcatgcgcatagctaaccgcacccggttcagctcgcctgcacctcggtcaggcgccggttggactcacgggcggggcatgatggtggtgggtacgggcacctcgctggcgctctcctccctcctgtccctgctgctctttgctgggatgccgactcggaccgatg

SEQ ID NO: 12037 - DNA, 203 bp, Homo sapiens
  source 1..203: mol_type = other DNA
ggcgcgccagtcctgcgtaattcgcggtaagcgctgacgcatgcgcatagctaaccgcacccggttcagctcgcctttcttggccagaggcgccggttggactcacgggcggggcatgatggtggtgggtacataattaatttcaacgctctcctccctcctgtccctgctgctctttgctgggatgccgactcggaccgatg

SEQ ID NO: 12038 - DNA, 203 bp, Homo sapiens
  source 1..203: mol_type = other DNA
ggcgcgccagtccttcaacctacgcggtaagcgctgacgcatgcgcatagctaaccgcacccggttcagctcgcctttcttggccagaggcgccggttggactcacgggcggggcatgatggtggtgggtacgggcacctcgctggcgctcgttctattcctgtccctgctgctctttgctgggatgccgactcggaccgatg

SEQ ID NO: 12039 - DNA, 203 bp, Homo sapiens
  source 1..203: mol_type = other DNA
ggcgcgccagtcctaggcgtaccgcggtaagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctggagttcccctgctcgactcggaccgatg

SEQ ID NO: 12040 - DNA, 203 bp, Homo sapiens
  source 1..203: mol_type = other DNA
ggcgcgccagtcctaaccgacgcgcggtaagcgctgacgcatgcgcatagctaaccgcacccggttcagctcgcctttcttggccagaggcgccggttggactcacgggcggggcatgatggtggtgggtacgggcacctcgctgggagcgatacgagctctgtccctgctgctctttgctgggatgccgactcggaccgatg

SEQ ID NO: 12041 - DNA, 203 bp, Homo sapiens
  source 1..203: mol_type = other DNA
ggcgcgccagtcctgtgatacgcgcggtaagcgctgacgcatgcgcatagctaaccgcacccggttcagctcgcctttcttggccagaggtcagttgactgaaaacgggcggggcatgatggtggtgggtacgggcacctcgctggcgctctcctccctcctgtccctgctgctctttgctgggatgccgactcggaccgatg

SEQ ID NO: 12042 - DNA, 203 bp, Homo sapiens
  source 1..203: mol_type = other DNA
ggcgcgccagtcctttcgtctgcgcggtaagcgctgacgcatgcgcatagctaaccgcacccttacgtatctctgattcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12043 - DNA, 203 bp, Homo sapiens
  source 1..203: mol_type = other DNA
ggcgcgccagtcctttcatgttcgcggtaagcgctgacgcatgcgcatgtgcgttgatgtttggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12044 - DNA, 203 bp, Homo sapiens
  source 1..203: mol_type = other DNA
ggcgcgccagtcctgacggcggcgctatactgaagacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatatcgactcggaccgatg

SEQ ID NO: 12045 - DNA, 203 bp, Homo sapiens
  source 1..203: mol_type = other DNA
ggcgcgccagtcctcaggaaatcgctcagcagggacgtatgacactccagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12046 - DNA, 203 bp, Homo sapiens
  source 1..203: mol_type = other DNA
ggcgcgccagtccttccgacggcgctcagcaggggacgccctggtctgagctctgtggtatcaaggaagctgctcgccgtctctaagacggtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12047 - DNA, 203 bp, Homo sapiens
  source 1..203: mol_type = other DNA
ggcgcgccagtccttcatgtaccgctcagcaggggacgccctggtctgagctctgtggtatctgattgttgttgaaccgtctctaagacgaacgacgacggttacgtggtttgtgtgtttgtttgttaccttgtgtttgttcgtcacttgtcgacagcgccctgcgaattggtgtacccacaccgcgccgactcggaccgatg

SEQ ID NO: 12048 - DNA, 203 bp, Homo sapiens
  source 1..203: mol_type = other DNA
ggcgcgccagtccttatgcttccgctcagcaggggacgccctggtctgagctctgtggtatctgattgttgttgaaccgtctctaagacggtgatactataagtcgtggtttgtgtgtttgtttgttaccttgtgtttgttcgtcacttgtcgacagcgcaagatcggggtacttacccacaccgcgccgactcggaccgatg

SEQ ID NO: 12049 - DNA, 203 bp, Homo sapiens
  source 1..203: mol_type = other DNA
ggcgcgccagtccttgaatgtacgctcagcaggggacgccctggtctgagctctgtggtatctgattgttgttgaatgcggggagcacacgtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12050 - DNA, 203 bp, Homo sapiens
  source 1..203: mol_type = other DNA
ggcgcgccagtcctatgacctacgctcattctaaggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 12051 - DNA, 203 bp, Homo sapiens
  source 1..203: mol_type = other DNA
ggcgcgccagtcctgtctgagtcgctccggcaaccttgttgtggaacgtgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 12052 - DNA, 203 bp, Homo sapiens
  source 1..203: mol_type = other DNA
ggcgcgccagtccttgtcccagcgctccggcaacgccaaccgctccgcgagttatcttacaagctgcaggctctcggctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 12053 - DNA, 203 bp, Homo sapiens
  source 1..203: mol_type = other DNA
ggcgcgccagtcctgcatgtcgcgctccggcaacgccaaccgctccgctgcgcgcaggctgggctgcaggctctcgaaactgtgaggacctgtcttcaggcctatggagagcagcttgcgtgggctgggcctgcagtacctggtttgcatagatgattggcaggtggatctaggatccggcttccaaccgactcggaccgatg

SEQ ID NO: 12054 - DNA, 203 bp, Homo sapiens
  source 1..203: mol_type = other DNA
ggcgcgccagtcctgcccttagcgctccggcaacgccaaccgctccgctgcgcgcaggctgggctgcaggctctcggctgcagcgctgggtgtcttcaggcctatggagagcagcttgcgtgggctgggcctgcagtacctggtttagcagctaatgactcaggtggatctaggatccggcttccaaccgactcggaccgatg

SEQ ID NO: 12055 - DNA, 203 bp, Homo sapiens
  source 1..203: mol_type = other DNA
ggcgcgccagtccttctatatccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggttaccaagaaccttatccggcttccaaccgactcggaccgatg

SEQ ID NO: 12056 - DNA, 203 bp, Homo sapiens
  source 1..203: mol_type = other DNA
ggcgcgccagtccttattaagtcgctccggcaacgccaaccgctccgctgcgcgcaggctgggctgcaggctctcggctgcagcgctgggtgtcttcaggcctatggagagcagcttgtcctcatattctaagcagtacctggtttgcatagatgattggcaggtggatctaggatccggcttccaaccgactcggaccgatg

SEQ ID NO: 12057 - DNA, 203 bp, Homo sapiens
  source 1..203: mol_type = other DNA
ggcgcgccagtcctaggctcttcgctccggcaacgccaaccgctccgctgcgcgcaggctggtgactttatgaaatgctgcagcgctgggtgtcttcaggcctatggagagcagcttgcgtgggctgggcctgcagtacctggtttgcatagatgattggcaggtggatctaggatccggcttccaaccgactcggaccgatg

SEQ ID NO: 12058 - DNA, 203 bp, Homo sapiens
  source 1..203: mol_type = other DNA
ggcgcgccagtcctcgataacgcgctcctagagctcgggccgtggctccaactttggccaaccttttggctccgagggcagtcgctgggcttccgagaggggttcgggctgcgtaggggcgctttgttttgttcggttttgtttttttgagagtgcgagagaggcggtcgtgcagacccgggagaaagcgactcggaccgatg

SEQ ID NO: 12059 - DNA, 203 bp, Homo sapiens
  source 1..203: mol_type = other DNA
ggcgcgccagtcctattggacccgctcctagagctcgggccgtggctcgtcggggtctgtgtcttttggctccgagggcagtcgctgggcttccgagaggggttcgggctgcgtaggggcgctttgttttgttcggttttgtttttaaattgacttataggaggcggtcgtgcagacccgggagaaagcgactcggaccgatg

SEQ ID NO: 12060 - DNA, 203 bp, Homo sapiens
  source 1..203: mol_type = other DNA
ggcgcgccagtcctccaacggccgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagacgcctctagaccgtgacccgggagaaagcgactcggaccgatg

SEQ ID NO: 12061 - DNA, 203 bp, Homo sapiens
  source 1..203: mol_type = other DNA
ggcgcgccagtcctggtttcggcgctcctagagctcgggccgtggctcgtcggggtctgtgtcttttggctccgagggcagtcgctgggcttccgagaggggttcgggctgcgtagggtgataggtagccactcggttttgtttttttgagagtgcgagagaggcggtcgtgcagacccgggagaaagcgactcggaccgatg

SEQ ID NO: 12062 - DNA, 203 bp, Homo sapiens
  source 1..203: mol_type = other DNA
ggcgcgccagtccttcgagagacgctgggtaaccgaggaagccttaaaggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12063 - DNA, 203 bp, Homo sapiens
  source 1..203: mol_type = other DNA
ggcgcgccagtcctgctacggtcgctgggtaacctctatccgagccgcggccgcgaggaggacaacggctttcgaaaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12064 - DNA, 203 bp, Homo sapiens
  source 1..203: mol_type = other DNA
ggcgcgccagtcctaatcgaaccgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12065 - DNA, 203 bp, Homo sapiens
  source 1..203: mol_type = other DNA
ggcgcgccagtcctctggataacgctgggtaacctctatccgagccgctcatagccccgtatgggaaaaggcgagcaaaaaggaagagtgggaggaggaggggaagcggcgaaggaggaagaggaggaggaggaagaggggagcacaaaggatccaggtctcccgacgggaggttaataccaagaacccgactcggaccgatg

SEQ ID NO: 12066 - DNA, 203 bp, Homo sapiens
  source 1..203: mol_type = other DNA
ggcgcgccagtcctcgaagatgcggcatgcactgacctggctttaatttcagggaagagtcgcgcccccggggagggagcagcactggcccattctgcagatggggacatcgagtcacgggctggctacgaactcctcgggggcgaaggtggcggagagggatgggttccaggacgtcctggcgcccgcgactcggaccgatg

SEQ ID NO: 12067 - DNA, 203 bp, Homo sapiens
  source 1..203: mol_type = other DNA
ggcgcgccagtcctggcatgtccggcatgcactgcgggccgccgggcctcagggaagagtcgcgcccccggggagggagcagcactggcccattctgcagatggggacatcgagtcacgggctggctacgaactcctcgggggcgaaggtggcggagagggatgggttccaggatccaagattatgaacgactcggaccgatg

SEQ ID NO: 12068 - DNA, 203 bp, Homo sapiens
  source 1..203: mol_type = other DNA
ggcgcgccagtcctttctaaaccggcatgcactgcgggccgccgggcctcagggaagagtcgcgcccccggggagggagcagcactggcccattctgcagatggggacatcgagtcacgggctggctacgaactcctcgggggcgagttgcaaatgtcctgatgggttccaggacgtcctggcgcccgcgactcggaccgatg

SEQ ID NO: 12069 - DNA, 203 bp, Homo sapiens
  source 1..203: mol_type = other DNA
ggcgcgccagtcctcacgtcagcggccccgcccccgccgttcgcgctccactgttagattccagccagcccccgaccccgggccacctgggcccccgggttccgccggcactctcgccaccaccgcgtgggtctgacaagatgtaccaggtcccactaccactggatcgggatgggaccctggtacggcgactcggaccgatg

SEQ ID NO: 12070 - DNA, 203 bp, Homo sapiens
  source 1..203: mol_type = other DNA
ggcgcgccagtcctgctaagtacggccccgcccccgccgttcgcgctctgaccagcccgcagagccagcccccgaccccgggccacctgggcccccgggttccgagctgtggtattggaccaccgcgtgggtctgacaagatgtaccaggtcccactaccactggatcgggatgggaccctggtacggcgactcggaccgatg

SEQ ID NO: 12071 - DNA, 203 bp, Homo sapiens
  source 1..203: mol_type = other DNA
ggcgcgccagtcctaaccagatcggccccgcccccgccgttcgcgctctgaccagcccgcagagccagcccccgaccccgggccacctgggcccccgggttccgccggcactctcgccaccaccgcgtgggtctgacaagatgtaccaggtcccactacccactccagccttaaggaccctggtacggcgactcggaccgatg

SEQ ID NO: 12072 - DNA, 203 bp, Homo sapiens
  source 1..203: mol_type = other DNA
ggcgcgccagtccttctctagtcggccccgcccccgccgttcgcgctctgaccagcccgcagcatgtcaattaaggcccgggccacctgggcccccgggttccgccggcactctcgccaccaccgcgtgggtctgacaagatgtaccaggtcccactaccactggatcgggatgggaccctggtacggcgactcggaccgatg

SEQ ID NO: 12073 - DNA, 203 bp, Homo sapiens
  source 1..203: mol_type = other DNA
ggcgcgccagtcctgtgttcgtcggcccgttaaatggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 12074 - DNA, 203 bp, Homo sapiens
  source 1..203: mol_type = other DNA
ggcgcgccagtcctcgcagaatcggcgcggcaaattgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctacgactcggaccgatg

SEQ ID NO: 12075 - DNA, 203 bp, Homo sapiens
  source 1..203: mol_type = other DNA
ggcgcgccagtccttcatagtgcggcggcggtagattagggccgcgggtcggagcactcaccgccgctgggggaccctgtcggaagcaactgccgccgccgcctctttcatctcttctggggcaggggccagccgtgctgcgccgccatccataagtagacctttttggagcctcaccagccaattcacgactcggaccgatg

SEQ ID NO: 12076 - DNA, 203 bp, Homo sapiens
  source 1..203: mol_type = other DNA
ggcgcgccagtcctgaggcacccggcggcggtagattagggccgcgggtcggagcactcaccgccgctgggggacctgtaacatgagggatgccgccgccgcctctttcatctcttctggggcaggggccagggccaggttttacacatccataagtagacctttttggagcctcaccagccaattcacgactcggaccgatg

SEQ ID NO: 12077 - DNA, 203 bp, Homo sapiens
  source 1..203: mol_type = other DNA
ggcgcgccagtcctttaggttccggctcccagggttttaaaaaatgtggggagccctggaggcgcagccccaccccggccggcgcggctcgctcccacgcccccgccgcggcctcgctggagcggacggactgagtcagagggggcgccagcgctgcaggagctgacatggacccaaatcctcgggcccgactcggaccgatg

SEQ ID NO: 12078 - DNA, 203 bp, Homo sapiens
  source 1..203: mol_type = other DNA
ggcgcgccagtcctaacctcctcggctctccgcgccttcttttctccgcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggacccgactcggaccgatg

SEQ ID NO: 12079 - DNA, 203 bp, Homo sapiens
  source 1..203: mol_type = other DNA
ggcgcgccagtcctggttccctcggctctccgcgccttcttttctccgcgcgcccggcgcgaagcctgcgattcgtgagccgagcgcagagcgcagagccgagtggcgcacgctgggcagtggcctgggcaaccccaaacgcagccagagccctcacccgagtccgctggcccgcggggaagaggacccgactcggaccgatg

SEQ ID NO: 12080 - DNA, 203 bp, Homo sapiens
  source 1..203: mol_type = other DNA
ggcgcgccagtccttataacctcggctctccgcgctcctccctctccgcgcgcccggcgcgaagcctgcgattcgtatcgtagcaatctcgcgcagagccgagtggcgcacgctgggcagtggcctgggcaaccccaaacgcagccagagccctcacccgagtccgctggcccgcgcactcccggacccgactcggaccgatg

SEQ ID NO: 12081 - DNA, 203 bp, Homo sapiens
  source 1..203: mol_type = other DNA
ggcgcgccagtcctaagggcgtcggctctccgcgctcctccctctccgcgcgcccggcgcgaagcctgcgattcgtgagccgagcgcagagcgcagagccgagttcaatcgtgatattagtggcctgggcaaccccaaacgcagccagagccctcacccgagtccgctggcccgcgcactcccggacccgactcggaccgatg

SEQ ID NO: 12082 - DNA, 203 bp, Homo sapiens
  source 1..203: mol_type = other DNA
ggcgcgccagtcctagatatcacggctctccgcgctcctccctctccgcgcgcccggcgcgaagcctgcgattcgtgagccgagcgcagattcggacctatgcgggcgcacgctgggcagtggcctgggcaaccccaaacgcagccagagccctcacccgagtccgctggcccgcgcactcccggacccgactcggaccgatg

SEQ ID NO: 12083 - DNA, 203 bp, Homo sapiens
  source 1..203: mol_type = other DNA
ggcgcgccagtcctttgctaaccggctctgggtggccgaggcggcagctgcgcggcggcaccggggcggctgcggcgcgctcggagccccattttgctagcagacgggcagctcggtgtgcgcccccgcgagagccggggccccaggcccgccggacaccatgaaccacctgaacgtgctggccaaagcgactcggaccgatg

SEQ ID NO: 12084 - DNA, 203 bp, Homo sapiens
  source 1..203: mol_type = other DNA
ggcgcgccagtcctctatcttccggctgcctggtccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtcgactcggaccgatg

SEQ ID NO: 12085 - DNA, 203 bp, Homo sapiens
  source 1..203: mol_type = other DNA
ggcgcgccagtcctgcgcactacgggaaaagaccaacagaaagacttgaccctcttaggtgtcatacctaagatcagtgtgttttttgtgtccaattcttttatcaccaaaaaagagaagaaatattgcagtgaatgaagattcctctgcattttagcactgctttttcaactgtagttggcttttgacgactcggaccgatg

SEQ ID NO: 12086 - DNA, 203 bp, Homo sapiens
  source 1..203: mol_type = other DNA
ggcgcgccagtccttacctgcgcgggactcctgctcctcacttgtgtccccaatggggctagctcgggtccacaacagctgccgatcaatggggtctttgtctttgtttcatgggtgtccagattttatcaattaaagcctgtgggaactgccagctcggcaagaggtaggcttggtctgcgccgatacgactcggaccgatg

SEQ ID NO: 12087 - DNA, 203 bp, Homo sapiens
  source 1..203: mol_type = other DNA
ggcgcgccagtcctgcaccagtcgggagctttccggagctgctggtactcccgattggagacgtagaaccgttactctagtgcacggggcgcggccgccgtgaccctctcggggatcccacgatgttcttctacctgagcaagaaaatttccattcccaataacgtgaagctgcagtgtgtatcctggcgactcggaccgatg

SEQ ID NO: 12088 - DNA, 203 bp, Homo sapiens
  source 1..203: mol_type = other DNA
ggcgcgccagtcctgtttctggcgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggcgactcggaccgatg

SEQ ID NO: 12089 - DNA, 203 bp, Homo sapiens
  source 1..203: mol_type = other DNA
ggcgcgccagtccttttctgcacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcttccatccgaagaccgactcggaccgatg

SEQ ID NO: 12090 - DNA, 203 bp, Homo sapiens
  source 1..203: mol_type = other DNA
ggcgcgccagtcctcctctccgcgggagctttccggagctgctggtactcccgattggagacgtagaaccgttacttgtcgagggccttagcggccgccgtgaccctctcggggatcccacgatgttcttctacctgagcaagaaatgactagcaattggtaacgtgaagctgcagtgtgtatcctggcgactcggaccgatg

SEQ ID NO: 12091 - DNA, 203 bp, Homo sapiens
  source 1..203: mol_type = other DNA
ggcgcgccagtcctttctggaacgggagctttccggagctgctggtactcccgattggagacgtagaaccgttacttgtcgagggccttagcggccgccgtgaccctctcggggatcccacgatgttcttctcaagttcgcctcctatttccattcccaataacgtgaagctgcagtgtgtatcctggcgactcggaccgatg

SEQ ID NO: 12092 - DNA, 203 bp, Homo sapiens
  source 1..203: mol_type = other DNA
ggcgcgccagtcctattagaaacgggagggggaaggacccccaccgctgcccttcccggggaggcgggaaatgcatatccaggtatgttcccgcggcggcctacagccggggtagcccaagaaccttcgggtgagggcgggtggcattttcttttcctataccgatcatggcagtccttctgctcctacgactcggaccgatg

SEQ ID NO: 12093 - DNA, 203 bp, Homo sapiens
  source 1..203: mol_type = other DNA
ggcgcgccagtccttacttcttcgggagggggaaggacccccaccgctgcccttcccggggaggcgggaaatgcatggggccacccagctccgcggcggcctacagccggggtagcccaagaaccttcgggtgagggcgggtggcattttcttttcctataccgatcatggcagtccttctgctcctacgactcggaccgatg

SEQ ID NO: 12094 - DNA, 203 bp, Homo sapiens
  source 1..203: mol_type = other DNA
ggcgcgccagtccttggcgccgcgggagggggaaggacccccaccgctgcccttcccggggaggcgggaaatgcatggggccacccagctgtcacagccttcgaagccggggtagcccaagaaccttcgggtgagggcgggtggcattttcttttcctataccgatcatggcagtccttctgctcctacgactcggaccgatg

SEQ ID NO: 12095 - DNA, 203 bp, Homo sapiens
  source 1..203: mol_type = other DNA
ggcgcgccagtcctaatccgagcgggagggggaattgtgtgtcagatggcccttcccggggaggcgggaaatgcatggggccacccagctccgcggcggcctacagccggggtagcccaagaaccttcgggtgagggcgggtggcattttcttttcctataccgatcatggcagtccttctgctcctacgactcggaccgatg

SEQ ID NO: 12096 - DNA, 203 bp, Homo sapiens
  source 1..203: mol_type = other DNA
ggcgcgccagtcctcggcagcgcgggatgctgccttcccatatgaagcaatccttcaacaccgacttaggttcaattttctcatcatttactgttgtaattcaatcttactaaagttattccgatatttaagaaaaaataacctttatataatgtaacaatactattaagattatgatataggccagacgactcggaccgatg

SEQ ID NO: 12097 - DNA, 203 bp, Homo sapiens
  source 1..203: mol_type = other DNA
ggcgcgccagtcctgtacgtaacgggcgcgcttccgcctgtgtggaggaaaccccacccaacggctgccacggcatggagaatggctccgcttctgttgcagctggcggtgctcggcgcggcgctggcggccgcagccctcgtactgatttccatcgttgcatttacaactgctacaaaaatgccagccgactcggaccgatg

SEQ ID NO: 12098 - DNA, 203 bp, Homo sapiens
  source 1..203: mol_type = other DNA
ggcgcgccagtcctgttcataccgggcgcgcttccgcctgtgtggaggtgcgggattgggcgcaactagtgtaagaggagaatggctccgcttctgttgcagctggcggtgctcggcgcggcgctggcggccgcagccctcgtactgatttccatcgttgcatttacaactgctacaaaaatgccagccgactcggaccgatg

SEQ ID NO: 12099 - DNA, 203 bp, Homo sapiens
  source 1..203: mol_type = other DNA
ggcgcgccagtcctcaaccacccgggcgcgcttccgcctgtgtggaggtgcgggattgggcgggctgccacggcataacagggaaaggttcttctgttgcagctggcggtgctcggcgcggcgctggcggccgcagccctcgtactgatttccatcgttgcatttacaactgctacaaaaatgccagccgactcggaccgatg

SEQ ID NO: 12100 - DNA, 203 bp, Homo sapiens
  source 1..203: mol_type = other DNA
ggcgcgccagtccttcataaatcgggcgcgcttccgcctgtgtggaggtgcgggattgggcgggctgccacggcatggagaatggctccgcttctgttgcagctggcggtgctcggcggctgctgtttacaggcagccctcgtactgatttccatcgttgcatttacaactgctacaaaaatgccagccgactcggaccgatg

SEQ ID NO: 12101 - DNA, 203 bp, Homo sapiens
  source 1..203: mol_type = other DNA
ggcgcgccagtcctcgctcgcccgggctgagtaaatgcaggatgaaataccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgcccgactcggaccgatg

SEQ ID NO: 12102 - DNA, 203 bp, Homo sapiens
  source 1..203: mol_type = other DNA
ggcgcgccagtcctgagtgacgcgggctgagtaataaattccccccgcaccgaaacgcggtctttctctagacgcgtcttgctgggagaggacttcgactaattcgtccgtgtcgcggccctgcggttggcggcctcctcgtggagcggagcaaggccaggcggcccctgctcgagtcccgcgtcgcccgactcggaccgatg

SEQ ID NO: 12103 - DNA, 203 bp, Homo sapiens
  source 1..203: mol_type = other DNA
ggcgcgccagtcctactgtaagcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccagttttagaactactaagtcccgcgtcgcccgactcggaccgatg

SEQ ID NO: 12104 - DNA, 203 bp, Homo sapiens
  source 1..203: mol_type = other DNA
ggcgcgccagtcctctggaaggcgggctgagtaataaattccccccgcaccgaaacgcggtctttctctagacgcgtcttgctgggagagtgtccgttgcttcccgtccgtgtcgcggccctgcggttggcggcctcctcgtggagttccaattataatagcggcccctgctcgagtcccgcgtcgcccgactcggaccgatg

SEQ ID NO: 12105 - DNA, 203 bp, Homo sapiens
  source 1..203: mol_type = other DNA
ggcgcgccagtccttcgggcttcgggctgagtaataaattccccccgccatttgctaatcattttctctagacgcgtcttgctgggagagtgtccgttgcttcccgtccgtgtcgcggccctgcggttggcggcctcctcgtggagcggagcaaggccaggcggcccctgctcgagtcccgcgtcgcccgactcggaccgatg

SEQ ID NO: 12106 - DNA, 203 bp, Homo sapiens
  source 1..203: mol_type = other DNA
ggcgcgccagtcctgacgataacggggagctttctggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagcgactcggaccgatg

SEQ ID NO: 12107 - DNA, 203 bp, Homo sapiens
  source 1..203: mol_type = other DNA
ggcgcgccagtccttgtattcccggtgcctaaggccgcgctgccgggctcgagcggaggcggcgcaggcgctgaggctggcgcggagcggctagaactagcgtagtgcggaaagcgctaggtccagccctgctgggagttttctgccacacagatttgcggaagaacctgaccgtggacgagggcacccgactcggaccgatg

SEQ ID NO: 12108 - DNA, 203 bp, Homo sapiens
  source 1..203: mol_type = other DNA
ggcgcgccagtccttcggcccacggtggaaaggtccattgcaatccctccaggaagcggccgcatgctgacattagtccatagacggctccccccggtggatcccgtggcgattcctgaaaaaagctgcatgcccaagaccagacgccagcgaactcgccgagcacgccgcaacagaccaccaacacccgactcggaccgatg

SEQ ID NO: 12109 - DNA, 203 bp, Homo sapiens
  source 1..203: mol_type = other DNA
ggcgcgccagtcctccctgccgcggtggaaaggtccattgcaatccctccaggaagcggccggggcagccttgctcctggcgcgtcaactcccccggtggatcccgtggcgattcctgaaaaaagctgcatgcccaagaccagacgccagcgaactcgccgagcacgccgcaacagaccaccaacacccgactcggaccgatg

SEQ ID NO: 12110 - DNA, 203 bp, Homo sapiens
  source 1..203: mol_type = other DNA
ggcgcgccagtcctgacagggtcggtggaaaggtccattgcaatccctccaggaagcggccggggcagccttgctctccatagacggctccccccggtggatcccgtggcgattcctgaaaaaagctgcatgcccaagaccagacgagtctcggagttatgagcacgccgcaacagaccaccaacacccgactcggaccgatg

SEQ ID NO: 12111 - DNA, 203 bp, Homo sapiens
  source 1..203: mol_type = other DNA
ggcgcgccagtcctgaattaatcggtggaaaggtccattgcaatccctccaggaagcggccggggcagccttgctctccatagacggctccccccggtggatcccgtggcgattcctgaaaaaagctgcatgcccaagaccagacgccagcgaactcgccgagcacgccgcaacagaccaccaacacccgactcggaccgatg

SEQ ID NO: 12112 - DNA, 203 bp, Homo sapiens
  source 1..203: mol_type = other DNA
ggcgcgccagtcctccgtccgccggtggaaaggtccattgcaatccctccaggaagcggccggggcagccttgctctccatagacggctccccccggtggatcccgtggcgattcctgttgtccttgcacatcccaagaccagacgccagcgaactcgccgagcacgccgcaacagaccaccaacacccgactcggaccgatg

SEQ ID NO: 12113 - DNA, 203 bp, Homo sapiens
  source 1..203: mol_type = other DNA
ggcgcgccagtcctcgacggcacggtggaaaggtccattgcaatccctccaggaagcggccggggcagccttgctctccatagacggctcggattctgtctatacgtggcgattcctgaaaaaagctgcatgcccaagaccagacgccagcgaactcgccgagcacgccgcaacagaccaccaacacccgactcggaccgatg

SEQ ID NO: 12114 - DNA, 203 bp, Homo sapiens
  source 1..203: mol_type = other DNA
ggcgcgccagtcctgggttgcgcggtggagtccatccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 12115 - DNA, 203 bp, Homo sapiens
  source 1..203: mol_type = other DNA
ggcgcgccagtcctttcattaacggtgttcctggcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgactcggaccgatg

SEQ ID NO: 12116 - DNA, 203 bp, Homo sapiens
  source 1..203: mol_type = other DNA
ggcgcgccagtcctcaaatcggcggttgcgggactattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggcgactcggaccgatg

SEQ ID NO: 12117 - DNA, 203 bp, Homo sapiens
  source 1..203: mol_type = other DNA
ggcgcgccagtccttattccgacgtagagggggttacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 12118 - DNA, 203 bp, Homo sapiens
  source 1..203: mol_type = other DNA
ggcgcgccagtccttggtggttcgtatattgtcgagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgcgactcggaccgatg

SEQ ID NO: 12119 - DNA, 203 bp, Homo sapiens
  source 1..203: mol_type = other DNA
ggcgcgccagtcctataccggccgtattcaacaaggggctgaaggatgcccagaaggtaccccattgtatgggatctgatctggggcctcggtgcacatgctttacatgtgtttagtcgaggttaaaaaacgatagtagtagtgctaccacggggacgtggttttcctttgaaaaacacgatgataatcgactcggaccgatg

SEQ ID NO: 12120 - DNA, 203 bp, Homo sapiens
  source 1..203: mol_type = other DNA
ggcgcgccagtcctggcgaagacgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatcgactcggaccgatg

SEQ ID NO: 12121 - DNA, 203 bp, Homo sapiens
  source 1..203: mol_type = other DNA
ggcgcgccagtcctcgtagggccgtattcaacaatcatggcccacgaccccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatcgactcggaccgatg

SEQ ID NO: 12122 - DNA, 203 bp, Homo sapiens
  source 1..203: mol_type = other DNA
ggcgcgccagtccttctggagccgtctatctaaggaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgcgactcggaccgatg

SEQ ID NO: 12123 - DNA, 203 bp, Homo sapiens
  source 1..203: mol_type = other DNA
ggcgcgccagtcctagtgaattcgtgctgttcccgccaattcctgtggcttgagcctagcgagcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 12124 - DNA, 203 bp, Homo sapiens
  source 1..203: mol_type = other DNA
ggcgcgccagtcctacacgacccgtgctgttcccgccaattcctgtggtaatccttaccgtggcgagttccgcgctcaatggagacgtttatgggagaatctgagcccgagctgcttaaactttattaccggaggctctttccctactctcagtactatcgctggctcaactacggtggagtgataaacgactcggaccgatg

SEQ ID NO: 12125 - DNA, 203 bp, Homo sapiens
  source 1..203: mol_type = other DNA
ggcgcgccagtccttagaactacgtgctgttcccgccaattcctgtggtaatccttaccgtggcgagttccgcgctcaatggagacgtttgaccccaccgagctgcccgagctgcttaaactttattaccgggacgcggccagtctctctcagtactatcgctggctcaactacggtggagtgataaacgactcggaccgatg

SEQ ID NO: 12126 - DNA, 203 bp, Homo sapiens
  source 1..203: mol_type = other DNA
ggcgcgccagtcctttcttactcgtggtatgacagggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgcgactcggaccgatg

SEQ ID NO: 12127 - DNA, 203 bp, Homo sapiens
  source 1..203: mol_type = other DNA
ggcgcgccagtcctaacgatttcgtggtttgtgtcacgcgagacccgattgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggcgactcggaccgatg

SEQ ID NO: 12128 - DNA, 203 bp, Homo sapiens
  source 1..203: mol_type = other DNA
ggcgcgccagtccttgagtgatcgtggtttgtgtgtttgtttgttaccggtatagcaaaaagcacttgtcgacagcgccctgcgaattggtgtacccacaccgcgcggcttgcgaataatactttggagagtcttttgcctccagtgtcttccgtttgtactcgtcctcctctccctctccggccgggcgactcggaccgatg

SEQ ID NO: 12129 - DNA, 203 bp, Homo sapiens
  source 1..203: mol_type = other DNA
ggcgcgccagtcctaccatcaacgtggtttgtgtgtttgtttgttaccttgtgtttgttcgtcacttgtcgacagcgccctgcgaattggcccggatgaggttggcggcttgcgaataatactttggagagtcttttgcctccagtgtcttccgtttgtactcgtcctcctctccctctccggccgggcgactcggaccgatg

SEQ ID NO: 12130 - DNA, 203 bp, Homo sapiens
  source 1..203: mol_type = other DNA
ggcgcgccagtcctagctgcggcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctcttcaatgcttaccacgactcggaccgatg

SEQ ID NO: 12131 - DNA, 203 bp, Homo sapiens
  source 1..203: mol_type = other DNA
ggcgcgccagtcctcttatgtgcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtatagaagagaaaagtcctctccggccgggcgactcggaccgatg

SEQ ID NO: 12132 - DNA, 203 bp, Homo sapiens
  source 1..203: mol_type = other DNA
ggcgcgccagtcctcctaaaggcgtgtgaggtctactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgcgactcggaccgatg

SEQ ID NO: 12133 - DNA, 203 bp, Homo sapiens
  source 1..203: mol_type = other DNA
ggcgcgccagtccttcgttatacgttccctccctccggcgagggccgcctttataacaactgctcagagtgcgagggcgggatagctgtccaaggtctcccccaaggaatgtccctaagcctgctgccctcttgcgcgcgggaagcagcaccaagttcacggccaacgccttggcactagggtccagacgactcggaccgatg

SEQ ID NO: 12134 - DNA, 203 bp, Homo sapiens
  source 1..203: mol_type = other DNA
ggcgcgccagtcctattcaccccgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagacgactcggaccgatg

SEQ ID NO: 12135 - DNA, 203 bp, Homo sapiens
  source 1..203: mol_type = other DNA
ggcgcgccagtcctaacttgtccgttccctccctccggcgagggccgcctttataacaactgctcagagtgcgagggcgggatagctgtccaaggtctcccccagcactgaggagctcgcctgctgccctcttgcgcgcgggaagccagcatgttaaacgggccaacgccttggcactagggtccagacgactcggaccgatg

SEQ ID NO: 12136 - DNA, 203 bp, Homo sapiens
  source 1..203: mol_type = other DNA
ggcgcgccagtcctaggtattgcgttccctccctccggcgagggccgcctttataacaactgtgggacaacatgaagcgggatagctgtccaaggtctcccccagcactgaggagctcgcctgctgccctcttgcgcgcgggaagcagcaccaagttcacggccaacgccttggcactagggtccagacgactcggaccgatg

SEQ ID NO: 12137 - DNA, 203 bp, Homo sapiens
  source 1..203: mol_type = other DNA
ggcgcgccagtcctttgcgctccgttcgccccacatttgcaatcttacgggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12138 - DNA, 203 bp, Homo sapiens
  source 1..203: mol_type = other DNA
ggcgcgccagtcctgtcctacacgttcgccccacctggtatagaaatcgggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12139 - DNA, 203 bp, Homo sapiens
  source 1..203: mol_type = other DNA
ggcgcgccagtcctaatttcatcgttcgccccagggaccggcaggcgggggaccgcggcccaggctgaagctcagggccctgtctgctctgtggactcaacagtacactaactccaccgctcagaactgagaagctgtcaccacagtagcttggagctcggcggcacaaccagcaccatctggtcgcgcgactcggaccgatg

SEQ ID NO: 12140 - DNA, 203 bp, Homo sapiens
  source 1..203: mol_type = other DNA
ggcgcgccagtcctgacgcgtacgttcgccccagggaccggcaggcgggggaccgcggcccaggctgaagctcagggccctgtctgctctgtggactcaacagtttgtggcaagacaagctcagaactgagaagctgtcaccacagtagcttggagctcgctaattgcttattgaccatctggtcgcgcgactcggaccgatg

SEQ ID NO: 12141 - DNA, 203 bp, Homo sapiens
  source 1..203: mol_type = other DNA
ggcgcgccagtcctacggattacgttcgccccagggaccggcaggcgggggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12142 - DNA, 203 bp, Homo sapiens
  source 1..203: mol_type = other DNA
ggcgcgccagtccttcatcggacgttcgccccagggaccggcaggcgggggaccgcggcccatctgtcgcggagttgccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12143 - DNA, 203 bp, Homo sapiens
  source 1..203: mol_type = other DNA
ggcgcgccagtcctaccggcagcgttcgccccagggaccggcaggcgggtaggtagtaagtgggctgaagctcagggccctgtctgctctgtggactcaacagtttgtggcaagacaagctcagaactgagaagctgtcaccacagtagcttggagctcggcggcacaaccagcaccatctggtcgcgcgactcggaccgatg

SEQ ID NO: 12144 - DNA, 203 bp, Homo sapiens
  source 1..203: mol_type = other DNA
ggcgcgccagtcctagatcacccgttgccaagggtgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttccgactcggaccgatg

SEQ ID NO: 12145 - DNA, 203 bp, Homo sapiens
  source 1..203: mol_type = other DNA
ggcgcgccagtcctcgatgcgcctaaaggtctcccctcccacctgcatgctggattcggtaatggcctcagcccttgccaactctgcctcttcccccgctgactgggcctctgcagagatgtgggcagctggtcaggatggccattcgggctcagcacagcaacgcagcccagactcagactggggaacgactcggaccgatg

SEQ ID NO: 12146 - DNA, 203 bp, Homo sapiens
  source 1..203: mol_type = other DNA
ggcgcgccagtcctacaagaatctaaaggtctcccctcccacctgcattgctctacaatctgtggcctcagcccttgccaactctgcctccgtgaagatcataagggcctctgcagagatgtgggcagctggtcaggatggccattcgggctcagcacagcaacgcagcccagactcagactggggaacgactcggaccgatg

SEQ ID NO: 12147 - DNA, 203 bp, Homo sapiens
  source 1..203: mol_type = other DNA
ggcgcgccagtcctgcttcttcctaaaggtctcccctcccacctgcattgctctacaatctgtggcctcagcccttgccaactctgcctcttcccccgctgactgggcctctgcagagatgtgggcagctggtcaggatggccattcgggctcagcacagtggaaagtagttttctcagactggggaacgactcggaccgatg

SEQ ID NO: 12148 - DNA, 203 bp, Homo sapiens
  source 1..203: mol_type = other DNA
ggcgcgccagtcctttgtatcgctaaagtaccgctcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 12149 - DNA, 203 bp, Homo sapiens
  source 1..203: mol_type = other DNA
ggcgcgccagtcctactatgacctaacatatgtcatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggacgactcggaccgatg

SEQ ID NO: 12150 - DNA, 203 bp, Homo sapiens
  source 1..203: mol_type = other DNA
ggcgcgccagtcctccttatctctaactttaggtccaggagtgcgatcgcctgcggatctgcagctgggcaccggccgcaacgcccgccccgcgacggcagggaataaaggctcagggaccggcagttctactctagagcccaccagcctctcagagcctccggtgactggcctgtgtctccccctggcgactcggaccgatg

SEQ ID NO: 12151 - DNA, 203 bp, Homo sapiens
  source 1..203: mol_type = other DNA
ggcgcgccagtcctcatcccacctacaggggagtaactcgaggaggcgaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacgactcggaccgatg

SEQ ID NO: 12152 - DNA, 203 bp, Homo sapiens
  source 1..203: mol_type = other DNA
ggcgcgccagtcctgtattcacctacaggggagttttgttgaagttgcaaagtcctggagcccgagagaacgaaatggcgcagtagcagcgagcagcagagtccgcacgctccggcgaggggcagaagagcgcgagggagcgcggggcagcagaagcgagagccgagcgcggacccagccaggacccacgactcggaccgatg

SEQ ID NO: 12153 - DNA, 203 bp, Homo sapiens
  source 1..203: mol_type = other DNA
ggcgcgccagtcctgcaattccctacaggggagttttgttgaagttgccctcaatccccaaatccagagggctgtcggcgcagtagcagcgagcagcagagtccgcacgctccggcgaggggcagaagagcgcgagggagcgcggggcagcagaagcgagagccgagcgcggacccagccaggacccacgactcggaccgatg

SEQ ID NO: 12154 - DNA, 203 bp, Homo sapiens
  source 1..203: mol_type = other DNA
ggcgcgccagtcctatatccttctacctattaaatattgccaaagggaaaaaggatagcccaaaggacaagaaaacacttctcactatgaattggtttggaagtaacttcttcaggtgtcctgaggatctttccttactcaacatatactcacctctgttgtcacacatgtcatctgaagatgaacatcgactcggaccgatg

SEQ ID NO: 12155 - DNA, 203 bp, Homo sapiens
  source 1..203: mol_type = other DNA
ggcgcgccagtcctcctctggactaccttggctggattttggttacgctataattgtaactgttttctgtttggacaacatcaaaaacatccattgcacaatggggcagttcattagcttcatgcaagaaataccaacctttttgcaggaggctctgaacattgctcttgttgcagtcagtctcattgcgactcggaccgatg

SEQ ID NO: 12156 - DNA, 203 bp, Homo sapiens
  source 1..203: mol_type = other DNA
ggcgcgccagtcctttgcgtgtctactagatgaaccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 12157 - DNA, 203 bp, Homo sapiens
  source 1..203: mol_type = other DNA
ggcgcgccagtcctaggatagactagactagcacgcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgcgactcggaccgatg

SEQ ID NO: 12158 - DNA, 203 bp, Homo sapiens
  source 1..203: mol_type = other DNA
ggcgcgccagtccttcggcgtcctagatccccgcaagctaggccagctcctcccactgcctcccttcctctttctcctcctcttactcctcagggaaatatgtgtggctgtctacaggatgggggacaccctgagccccggacatggcaaccacagagagagcagcccttttctttcccccttggaggcgactcggaccgatg

SEQ ID NO: 12159 - DNA, 203 bp, Homo sapiens
  source 1..203: mol_type = other DNA
ggcgcgccagtcctggatgcttctagatccccgcaagctaggccagctcctcccactgcctcccttcctctttctcctcctcttactcctttccagccagacctgaatatatctatccatgggggacaccctgagccccggacatggcaaccacagagagagcagcccttttctttcccccttggaggcgactcggaccgatg

SEQ ID NO: 12160 - DNA, 203 bp, Homo sapiens
  source 1..203: mol_type = other DNA
ggcgcgccagtcctatatgaacctagatccccgcaagctaggccagctcctcccactgcctcccttcctctttctcctcctcttactcctttccagccagaccttggctgtctacaggatgggggacaccctgagccccggacatgcacgagtggacctcagcagcccttttctttcccccttggaggcgactcggaccgatg

SEQ ID NO: 12161 - DNA, 203 bp, Homo sapiens
  source 1..203: mol_type = other DNA
ggcgcgccagtcctcgtgacgactagatccccgcaagctaggccagctcctcccactgcctcccttcctctttctcctcctcttactcctttccagccagaccttggctgtctacaggatgggggacaccctgagccccggacatggcaaccacagagagagcagcccttttctacgatagaacttttcgactcggaccgatg

SEQ ID NO: 12162 - DNA, 203 bp, Homo sapiens
  source 1..203: mol_type = other DNA
ggcgcgccagtcctatgttgttctagatccccgcaagctaggccagctcctcccactgcctcccttcctctttctctcttaaaactcaagttccagccagaccttggctgtctacaggatgggggacaccctgagccccggacatggcaaccacagagagagcagcccttttctttcccccttggaggcgactcggaccgatg

SEQ ID NO: 12163 - DNA, 203 bp, Homo sapiens
  source 1..203: mol_type = other DNA
ggcgcgccagtcctcgagcccgctagatccccgcaagctaggccagctcctcccactgcctctaagtgagcacgcgctcctcttactcctttccagccagaccttggctgtctacaggatgggggacaccctgagccccggacatggcaaccacagagagagcagcccttttctttcccccttggaggcgactcggaccgatg

SEQ ID NO: 12164 - DNA, 203 bp, Homo sapiens
  source 1..203: mol_type = other DNA
ggcgcgccagtcctcaagcgatctagatccccgcctagccccgaccggcctcccactgcctcccttcctctttctcctcctcttactcctttccagccagaccttggctgtctacaggatgggggacaccctgagccccggacatggcaaccacagagagagcagcccttttctttcccccttggaggcgactcggaccgatg

SEQ ID NO: 12165 - DNA, 203 bp, Homo sapiens
  source 1..203: mol_type = other DNA
ggcgcgccagtcctcagtacagctagattgtgtagggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcacccgactcggaccgatg

SEQ ID NO: 12166 - DNA, 203 bp, Homo sapiens
  source 1..203: mol_type = other DNA
ggcgcgccagtcctttggaatcctagtattgaaccgacactcactcgttacttggcatgtacacctgattagttagcccttgtggatacgccactgccgctcaggtacagtaggacataccccaaatattgggttccactcgtagagaagaaaattagtggcgaaacgtacggtttatgtcaaaggagcgactcggaccgatg

SEQ ID NO: 12167 - DNA, 203 bp, Homo sapiens
  source 1..203: mol_type = other DNA
ggcgcgccagtcctacggttatctagtattgaactttagtgatgagtgtacttggcatgtacacctgattagttagcccttgtggatacgccactgccgctcaggtacagtaggacataccccaaatattggagcttggagaagaggaagaaaattagtggcgaaacgtacggtttatgtcaaaggagcgactcggaccgatg

SEQ ID NO: 12168 - DNA, 203 bp, Homo sapiens
  source 1..203: mol_type = other DNA
ggcgcgccagtcctgcgatgcactagtattgaactttagtgatgagtgtacttggcatgtacacctgattagttagcccttgtggatacgccactgccgctcaggtacagtaggacatctgatggcggaaacgttccactcgtagagaagaaaattagtggcgaaacgtacggtttatgtcaaaggagcgactcggaccgatg

SEQ ID NO: 12169 - DNA, 203 bp, Homo sapiens
  source 1..203: mol_type = other DNA
ggcgcgccagtcctccaaccagctagtcatcaaaccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 12170 - DNA, 203 bp, Homo sapiens
  source 1..203: mol_type = other DNA
ggcgcgccagtcctaggccaagctagtcgaatacccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 12171 - DNA, 203 bp, Homo sapiens
  source 1..203: mol_type = other DNA
ggcgcgccagtcctcgttctacctataatcagtgcacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 12172 - DNA, 203 bp, Homo sapiens
  source 1..203: mol_type = other DNA
ggcgcgccagtcctctgtcagtctatcagcccgctttaattgcaaacacaaagcgactgttgttgtgcaattaaaggatagtgatattaatgaaatggtgcttagtcttgttaggagtggtaagttgcttgtaaggggtaatggcaagtgtttgagttttagtaatcatttagtctcaactaaataaacgactcggaccgatg

SEQ ID NO: 12173 - DNA, 203 bp, Homo sapiens
  source 1..203: mol_type = other DNA
ggcgcgccagtcctaagaggatctatgagaatgatgatgatgctacagactaaaatatatcgggaggaatttaacaggatacttggacaatagaagccagatcaaaagtaagaaaaacttagggtgaatgacaattcacagatcagctcaaccagacaccaccagcatacacgaaaccaaccttcacacgactcggaccgatg

SEQ ID NO: 12174 - DNA, 203 bp, Homo sapiens
  source 1..203: mol_type = other DNA
ggcgcgccagtcctgagtacctctatgagaatgatgatgatgctacagcggctgcagggataggaggaatttaacaggatacttggacaacttgctagttccgcaaagtaagaaaaacttagggtgaatgacaattcacagatcagctcaaccagacaccaccagcatacacgaaaccaaccttcacacgactcggaccgatg

SEQ ID NO: 12175 - DNA, 203 bp, Homo sapiens
  source 1..203: mol_type = other DNA
ggcgcgccagtcctcggccgttctatgagaatgatgatgatgctacagcggctgcagggataggaggaatttaacaggatacttggacaatagaagccagatcaaaagtaagaaaaacttagggtgaatgacaattcacagatcagctcaaccagacaccaccagcatacacgaaaccaaccttcacacgactcggaccgatg

SEQ ID NO: 12176 - DNA, 203 bp, Homo sapiens
  source 1..203: mol_type = other DNA
ggcgcgccagtcctgagcgcacctatgagaatgatgatgatgctacagcggctgcagggataggaggaatttaacaggatacttggacaatagaagccagatcaaaagtaagaaaaacttagggtgaatgactcgcttgtttctgtctcaaccagacaccaccagcatacacgaaaccaaccttcacacgactcggaccgatg

SEQ ID NO: 12177 - DNA, 203 bp, Homo sapiens
  source 1..203: mol_type = other DNA
ggcgcgccagtcctgctgggcgctcaacaaaaagccaccgacattaagagagagagtattgctgcttagttaactgcaggccctatttagaccccataattcttatctgcaacagcattcctgtatcatccagggcaccggtggacttggtgaggattgagttgacctcatcattagagaccagactccgactcggaccgatg

SEQ ID NO: 12178 - DNA, 203 bp, Homo sapiens
  source 1..203: mol_type = other DNA
ggcgcgccagtcctcacatacgctcaacaaaaagccaccgacattaagagagagagtattgctgcttagttaactgcaggccctatttagggttaccgcccaggatctgcaacagcattcctgtatcatccagggcaccggtggacttggtgaggattgacggtctaaatgtcgtagagaccagactccgactcggaccgatg

SEQ ID NO: 12179 - DNA, 203 bp, Homo sapiens
  source 1..203: mol_type = other DNA
ggcgcgccagtcctagcttcccctcaacaaaaagccaccgacattaagagagagagtattgctgcttagttaactgcaggccctatttagggttaccgcccaggatctgcaacagcattcctgtatcatccagggcaccggtggacttggtgaggattgagttgacctcatcatacacataattgaagcgactcggaccgatg

SEQ ID NO: 12180 - DNA, 203 bp, Homo sapiens
  source 1..203: mol_type = other DNA
ggcgcgccagtcctgagtaaacctcaacaaaaagccaccgacattaagagagagagtattgctgcttagttaactgtttaggaagaccctggttaccgcccaggatctgcaacagcattcctgtatcatccagggcaccggtggacttggtgaggattgagttgacctcatcattagagaccagactccgactcggaccgatg

SEQ ID NO: 12181 - DNA, 203 bp, Homo sapiens
  source 1..203: mol_type = other DNA
ggcgcgccagtcctgtaatggactcaccgaggcgagtcgctgtgtgttcctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12182 - DNA, 203 bp, Homo sapiens
  source 1..203: mol_type = other DNA
ggcgcgccagtcctgtagaggcctcaccgaggcgcacgcgcccagcaccctgcctccggcgatgccgccccagcccctctgatggccctcctctctgctgccactcattccagaacaggaggcatgagcccggaacgcgcttgcttgacacgtgattgttctttctgtgtggtacgctggattcaaggcgactcggaccgatg

SEQ ID NO: 12183 - DNA, 203 bp, Homo sapiens
  source 1..203: mol_type = other DNA
ggcgcgccagtcctaaagacgactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12184 - DNA, 203 bp, Homo sapiens
  source 1..203: mol_type = other DNA
ggcgcgccagtcctaaacagtgctcaccgaggcgcacgcgcccagcaccctgcctccggcgatgccgccccagcccctctgatggccctctggatgatctatcgtcattccagaacaggaggcatgagcccggaacgcgcttgcttttaggagacagccactttctgtgtggtacgctggattcaaggcgactcggaccgatg

SEQ ID NO: 12185 - DNA, 203 bp, Homo sapiens
  source 1..203: mol_type = other DNA
ggcgcgccagtcctctgccgggctcaccgaggcgcacgcgcccagcaccctgcctccggcgatgccgccccagcccgatacgccatttatctctctgctgccactcattccagaacaggaggcatgagcccggaacgcgcttgcttttaggagacagccactttctgtgtggtacgctggattcaaggcgactcggaccgatg

SEQ ID NO: 12186 - DNA, 203 bp, Homo sapiens
  source 1..203: mol_type = other DNA
ggcgcgccagtcctctaaatgtctcaccgaggcgcacgcgcccagcacgtcagaatgaatcctgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12187 - DNA, 203 bp, Homo sapiens
  source 1..203: mol_type = other DNA
ggcgcgccagtcctccagtggtctcagtgccagaggaggggattcccggcgccgggggacagagccccttttttctgggcatacgttcttctttctgctggggagcctcttgtgtccagcctaggcccgcgtgcagcgccgacggatgaccgtcttcttggcaagaaagtgaataaacttaattgagacgactcggaccgatg

SEQ ID NO: 12188 - DNA, 203 bp, Homo sapiens
  source 1..203: mol_type = other DNA
ggcgcgccagtcctaagccggtctcagtgccagaggaggggattcccggcgccgggggacagagccccttttttcttttgccgaaagaccctttctgctggggagcctcttgtgtccagcctaggcccgcgtgcagcgccgacggatgaccgtcttcttgcggtctggacaggaaaacttaattgagacgactcggaccgatg

SEQ ID NO: 12189 - DNA, 203 bp, Homo sapiens
  source 1..203: mol_type = other DNA
ggcgcgccagtcctggaacgccctcagtgccagaggaggggattcccggcgccgggggacagctttataggggagctttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 12190 - DNA, 203 bp, Homo sapiens
  source 1..203: mol_type = other DNA
ggcgcgccagtcctatatctaactcagtgccagatagtcaccaaggaagcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 12191 - DNA, 203 bp, Homo sapiens
  source 1..203: mol_type = other DNA
ggcgcgccagtcctatttatgtctccagttgggacaagtcccaatccaagtgaacgtgtagcgccgcatttaaatgatgccgttcaatcatgagacataaagaaaaaatcaagccagaacaagcttaggatcacaatacaacacagaaccccagctgctatcataactgttctctggccgctcgaaagcgactcggaccgatg

SEQ ID NO: 12192 - DNA, 203 bp, Homo sapiens
  source 1..203: mol_type = other DNA
ggcgcgccagtcctcacgcctcctccagttgggacaagtcccaatccatcattcgagaacaagccgcatttaaatgatgccgttcaatcatgagacataaagaaaaaatcaagccagaacaagcttaggatcacaatacaacacagaaccccagctgctacgcccgtgagctgttggccgctcgaaagcgactcggaccgatg

SEQ ID NO: 12193 - DNA, 203 bp, Homo sapiens
  source 1..203: mol_type = other DNA
ggcgcgccagtcctcataacgcctccagttgggacaagtcccaatccatcattcgagaacaagccgcatttaaatgatgccgttcaatcatgagacataaagaaaaaatcaagccagaacaagcttaggatcacaatacaacacagctttaggctctgactcataactgttctctggccgctcgaaagcgactcggaccgatg

SEQ ID NO: 12194 - DNA, 203 bp, Homo sapiens
  source 1..203: mol_type = other DNA
ggcgcgccagtcctgtcgcagcctccagttgggacaagtcccaatccatcattcgagaacaagccgcatttaaatgatgccgttcaatcatgagacataaagaagcgtgattagatcgacaagcttaggatcacaatacaacacagaaccccagctgctatcataactgttctctggccgctcgaaagcgactcggaccgatg

SEQ ID NO: 12195 - DNA, 203 bp, Homo sapiens
  source 1..203: mol_type = other DNA
ggcgcgccagtcctgcacaggactccagttgggacaagtcccaatccatcattcgagaacaagccgcatttaaatggaagtcccagtgattgagacataaagaaaaaatcaagccagaacaagcttaggatcacaatacaacacagaaccccagctgctatcataactgttctctggccgctcgaaagcgactcggaccgatg

SEQ ID NO: 12196 - DNA, 203 bp, Homo sapiens
  source 1..203: mol_type = other DNA
ggcgcgccagtcctttactgtcctcccctggtgcggcccgaggcaagcccaccgaggtgaccacccctcgacgccgcttggagatcccgggcatccaccctgcgccccgagcagctgatacccagggaggtgaattccgtatgagagggcgcggggtcgccggaagccaggcgggagccccggctgctcgactcggaccgatg

SEQ ID NO: 12197 - DNA, 203 bp, Homo sapiens
  source 1..203: mol_type = other DNA
ggcgcgccagtcctctcgtgacctcccctggtgcggcccgaggcaagcccaccgaggtgaccacccctcgacgccgcttggagatcccggtgcgttttagccgaccccgagcagctgatacccagggaggtgtcaggacctgcccggggcgcggggtcgccggaagccaggcgggagccccggctgctcgactcggaccgatg

SEQ ID NO: 12198 - DNA, 203 bp, Homo sapiens
  source 1..203: mol_type = other DNA
ggcgcgccagtcctcgggcgcactccctttctccctccatccttccacttcccctgctcggccccgccgtcaggcccacaggtgtcagattgccgtcatcaggttccccttctcccttcttggcactttcctttcgaaccatccttctggacaaactttgatggagaatttcacaccacgctggaaaacgactcggaccgatg

SEQ ID NO: 12199 - DNA, 203 bp, Homo sapiens
  source 1..203: mol_type = other DNA
ggcgcgccagtccttcgcttcgctccctttctccctccatccttccacttcccctgctcggccccgccgtcaggccgggtcccccttccctgccgtcatcaggtgttagaaagtgaggcttggcactttcctttcgaaccatccttctggacaaactttgatggagaatttcacaccacgctggaaaacgactcggaccgatg

SEQ ID NO: 12200 - DNA, 203 bp, Homo sapiens
  source 1..203: mol_type = other DNA
ggcgcgccagtcctcaactgacctccctttctccctccatccttccacttcccctgctcggccccgccgtcaggccgggtcccccttccctgccgtcatcaggttccccttctcccactgcaaggtcttcctttcgaaccatccacagaatgttgctttgatggagaatttcacaccacgctggaaaacgactcggaccgatg

SEQ ID NO: 12201 - DNA, 203 bp, Homo sapiens
  source 1..203: mol_type = other DNA
ggcgcgccagtcctggaaagtgctccctttctccctccatccttccacttcccctgctcggccccgccgtcaggccgggtcccccttccctgccgtcatcaggttccccttctcccactgcaaggtcttcctttcgaaccatccttctggacaaactttgatggagaatttcacaccacgctggaaaacgactcggaccgatg

SEQ ID NO: 12202 - DNA, 203 bp, Homo sapiens
  source 1..203: mol_type = other DNA
ggcgcgccagtcctgcctcactctccctttctccctccatccttccacttcccctgctcggccccgccgtcaggccgggtcccccttccctgccgtcatcaggttccccttctcccttagctatttaacttcttcgaaccatccttctggacaaactttgatggagaatttcacaccacgctggaaaacgactcggaccgatg

SEQ ID NO: 12203 - DNA, 203 bp, Homo sapiens
  source 1..203: mol_type = other DNA
ggcgcgccagtcctgatcgccgctccctttctccctccatccttccacttcccctgctcggccccgccgtcaggccgggtcccccttccctgccgtcatcaggttccccttctcccttcttggcactttcctgaaatcaagatgcactggacaaactttgatggagaatttcacaccacgctggaaaacgactcggaccgatg

SEQ ID NO: 12204 - DNA, 203 bp, Homo sapiens
  source 1..203: mol_type = other DNA
ggcgcgccagtccttgagcgtgctccctttctccctccatccttccacttcccctgctcggccccgccgtcaggccgggtcccccttccctgccgtcatcaggttccccttctcccttcttggcactttcctttcgaaccatccacagaatgttgctttgatggagaatttcacaccacgctggaaaacgactcggaccgatg

SEQ ID NO: 12205 - DNA, 203 bp, Homo sapiens
  source 1..203: mol_type = other DNA
ggcgcgccagtcctcaatcattctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaacgactcggaccgatg

SEQ ID NO: 12206 - DNA, 203 bp, Homo sapiens
  source 1..203: mol_type = other DNA
ggcgcgccagtcctccacaccactccctttctccctccatccttccacttcccctgctcggccccgccgtcaggccgggtcccccttccctgccgtcatcaggttccccttctcccttcttggcactttcctttcgaaccatccttctggacaaactttgatggagaatttcactaattcgattccctcgactcggaccgatg

SEQ ID NO: 12207 - DNA, 203 bp, Homo sapiens
  source 1..203: mol_type = other DNA
ggcgcgccagtcctactcgctcctccctttctccctccatccttccacttcccctgctcggccccgccgtcaggccgggtcccccttccctgccgtcatcaggttccccttctcccttcttggcactttcctttcgaaccatccttctggacaaactttggaatccgtcgagtgaccacgctggaaaacgactcggaccgatg

SEQ ID NO: 12208 - DNA, 203 bp, Homo sapiens
  source 1..203: mol_type = other DNA
ggcgcgccagtcctgggcgatactccctttctccctccatccttccacttcccctgctcggcgtgattaggttctggggtcccccttccctgccgtcatcaggttccccttctcccttcttggcactttcctttcgaaccatccttctggacaaactttgatggagaatttcacaccacgctggaaaacgactcggaccgatg

SEQ ID NO: 12209 - DNA, 203 bp, Homo sapiens
  source 1..203: mol_type = other DNA
ggcgcgccagtcctgggaagctctccgacgtgcttactgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaacgactcggaccgatg

SEQ ID NO: 12210 - DNA, 203 bp, Homo sapiens
  source 1..203: mol_type = other DNA
ggcgcgccagtcctggccaaatctcctcctcgagcctgggaccgccgcgctcccgccgccgctatccaggtagagtactcccggcccgtgccgcgccctcccgcgtccgcagccggctcggcttcctgcccacccagacgtcgcttctcccgggctcccggtgtcggctccgcgcggagggagaggaacgactcggaccgatg

SEQ ID NO: 12211 - DNA, 203 bp, Homo sapiens
  source 1..203: mol_type = other DNA
ggcgcgccagtccttgtgtgggctcctttcgaggccccatcaagaacacccaagtttgctcggtcatctgctgcgtcctcttcctgctcttcattctaggttacatcgtggtggggattgtggcctggttgtatggagacccccggcaagtcctctaccccaggaactctactggggcctactgtggccgactcggaccgatg

SEQ ID NO: 12212 - DNA, 203 bp, Homo sapiens
  source 1..203: mol_type = other DNA
ggcgcgccagtcctagttggtactcctttcgaggccccatcaagaacagaagctgcacagatgtcatctgctgcgtaggaagggccacagtcattctaggttacatcgtggtggggattgtggcctggttgtatggagacccccggcaagtcctctaccccaggaactctactggggcctactgtggccgactcggaccgatg

SEQ ID NO: 12213 - DNA, 203 bp, Homo sapiens
  source 1..203: mol_type = other DNA
ggcgcgccagtcctgaggagttctcctttcgaggccccatcaagaacagaagctgcacagatgtcatctgctgcgtcctcttcctgctcttcattctaggttacatcgtggtggggattgtggcctggttgtatggagacccccggcaagtcctctacccgttatgtatagtgagggcctactgtggccgactcggaccgatg

SEQ ID NO: 12214 - DNA, 203 bp, Homo sapiens
  source 1..203: mol_type = other DNA
ggcgcgccagtccttgaagagtctcctttcgaggccccatcaagaacagaagctgcacagatgtcatctgctgcgtcctcttcctgctcttcattctaggttacatcgtggtggggattgtggcctggttgtatggagacccccgggggcaaagggctgtcaggaactctactggggcctactgtggccgactcggaccgatg

SEQ ID NO: 12215 - DNA, 203 bp, Homo sapiens
  source 1..203: mol_type = other DNA
ggcgcgccagtcctcgagtaacctcctttcgaggccccatcaagaacagaagctgcacagatgtcatctgctgcgtcctcttcctgctcttcattctaggttacggtaataccaacggtgtggcctggttgtatggagacccccggcaagtcctctaccccaggaactctactggggcctactgtggccgactcggaccgatg

SEQ ID NO: 12216 - DNA, 203 bp, Homo sapiens
  source 1..203: mol_type = other DNA
ggcgcgccagtcctgtcaaatgctcctttcgagggttttcaggaccttgaagctgcacagatgtcatctgctgcgtcctcttcctgctcttcattctaggttacatcgtggtggggattgtggcctggttgtatggagacccccggcaagtcctctaccccaggaactctactggggcctactgtggccgactcggaccgatg

SEQ ID NO: 12217 - DNA, 203 bp, Homo sapiens
  source 1..203: mol_type = other DNA
ggcgcgccagtccttacgccctctcgaaggcaggagcgaccggcgcctcctcgaccctgactggagaaggaggaatcgcgccaggcggagcgtcaggtcccgttttcctctccggcgtctccaatacaaagattacggtgcagaaggaaattgcactcgtctcctccgcgcccccggtacccaacacacgactcggaccgatg

SEQ ID NO: 12218 - DNA, 203 bp, Homo sapiens
  source 1..203: mol_type = other DNA
ggcgcgccagtcctgacctgaactcgaaggcaggagcgaccggcgcctttggctgaggaggaaagagcacctcccccgcgccaggcggagcgtcaggtcccgttttcctctccggcgtctccaatacaaagattacggtgcagaaggaaattgcactcgtctcctccgcgcccccggtacccaacacacgactcggaccgatg

SEQ ID NO: 12219 - DNA, 203 bp, Homo sapiens
  source 1..203: mol_type = other DNA
ggcgcgccagtcctattacggactcgaaggcaggagcgaccggcgcctttggctgaggaggaggagaaggaggaatcgcgccaggcggagcgtcaggtcccgttttcctctccggcgttcatgggcacttagttacggtgcagaaggaaattgcactcgtctcctccgcgcccccggtacccaacacacgactcggaccgatg

SEQ ID NO: 12220 - DNA, 203 bp, Homo sapiens
  source 1..203: mol_type = other DNA
ggcgcgccagtcctcgattccactcgcctgagggatgctggatctgcaatgatagaattggcctgccacagacattggtatttaagttgaagagcagaattcacaatgattctgctgcagagagctttaatgcactccccgtatgcgggcacagttcaattgcttcagggggaacacacagcagggagcgactcggaccgatg

SEQ ID NO: 12221 - DNA, 203 bp, Homo sapiens
  source 1..203: mol_type = other DNA
ggcgcgccagtcctgtttgtctctcgcctgagggatgctggatctgcaatgatagaattggcctgccacagacattggtatttaagttgaagagcagaattcacaatgattctgctgcagagagctttaatggcaatgagactctggggcacagttcaatacagagtcaaatctcacacagcagggagcgactcggaccgatg

SEQ ID NO: 12222 - DNA, 203 bp, Homo sapiens
  source 1..203: mol_type = other DNA
ggcgcgccagtcctctaaggtactcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagcgactcggaccgatg

SEQ ID NO: 12223 - DNA, 203 bp, Homo sapiens
  source 1..203: mol_type = other DNA
ggcgcgccagtcctcggtcatcctcgcctgagggatgctggatctgcaatgatagaattggcctgccacagacattggtatttaagttgaagagcagaattcacccgccactaaaataagagagctttaatggcaatgagactctggggcacagttcaattgcttcagggggaacacacagcagggagcgactcggaccgatg

SEQ ID NO: 12224 - DNA, 203 bp, Homo sapiens
  source 1..203: mol_type = other DNA
ggcgcgccagtcctcaattgtgctcgcctgagggatgctggatctgcaatgatagaattggcctgccacagacattggtatttaagttgagttcgtactggtgtaatgattctgctgcagagagctttaatggcaatgagactctggggcacagttcaattgcttcagggggaacacacagcagggagcgactcggaccgatg

SEQ ID NO: 12225 - DNA, 203 bp, Homo sapiens
  source 1..203: mol_type = other DNA
ggcgcgccagtccttcgtgcggctcgcctgagggatgctggatctgcaatgatagaattggcgaaatgggctatccggtatttaagttgaagagcagaattcacaatgattctgctgcagagagctttaatggcaatgagactctggggcacagttcaattgcttcagggggaacacacagcagggagcgactcggaccgatg

SEQ ID NO: 12226 - DNA, 203 bp, Homo sapiens
  source 1..203: mol_type = other DNA
ggcgcgccagtcctcgtgcagtctcgcctgagggatgctggatctgcatacgcgacgacaagctgccacagacattggtatttaagttgaagagcagaattcacaatgattctgctgcagagagctttaatggcaatgagactctggggcacagttcaattgcttcagggggaacacacagcagggagcgactcggaccgatg

SEQ ID NO: 12227 - DNA, 203 bp, Homo sapiens
  source 1..203: mol_type = other DNA
ggcgcgccagtccttgcgttagctcgcctgaggggatagttccagtttatgatagaattggcctgccacagacattggtatttaagttgaagagcagaattcacaatgattctgctgcagagagctttaatggcaatgagactctggggcacagttcaattgcttcagggggaacacacagcagggagcgactcggaccgatg

SEQ ID NO: 12228 - DNA, 203 bp, Homo sapiens
  source 1..203: mol_type = other DNA
ggcgcgccagtcctcgaggtatctcgcggctataaggggcggaggctgggcggcgttgctctgcgctctgcggctgacggcgcttttgtccgtaacgagcctctcctttcagaaggagaaggcagctctgtttctctgcagaggagtagggtcctttcagccatgaagcatgtgttgaacctctacctcgactcggaccgatg

SEQ ID NO: 12229 - DNA, 203 bp, Homo sapiens
  source 1..203: mol_type = other DNA
ggcgcgccagtccttccttcagctcgcggctataaggggcggaggctgggcggcgttgctctgcgctctgcggctgacggcgcttttgtctccgggtccagaggcctttcagaaggagaaggcagctctgtttctctgcagaggagtagggtcctttcagagtccctagtcccattgaacctctacctcgactcggaccgatg

SEQ ID NO: 12230 - DNA, 203 bp, Homo sapiens
  source 1..203: mol_type = other DNA
ggcgcgccagtcctcctcaaacctcgcggctataaggggcggaggctgggcggcgttgctctgcgctctgcggctgacggcgcttttgtctccgggtccagaggcctttcagaaggagaaggcagctctgtttctctgcagaggagtagggtcctttcagccatgaagcatgtgttgaacctctacctcgactcggaccgatg

SEQ ID NO: 12231 - DNA, 203 bp, Homo sapiens
  source 1..203: mol_type = other DNA
ggcgcgccagtccttccaatttctcgcggctataaggggcggaggctgggcggcgttgctctgcgctctgcggctgacggcgcttttgtctccgggtccagagggggcctgttctttcaaggcagctctgtttctctgcagaggagtagggtcctttcagccatgaagcatgtgttgaacctctacctcgactcggaccgatg

SEQ ID NO: 12232 - DNA, 203 bp, Homo sapiens
  source 1..203: mol_type = other DNA
ggcgcgccagtccttacgaaagctcgcggctcacggcgctcctggggcccatttacggtactcctgcccggcggccctatgccgggggtgccgctcagctggctctggacaagtcagattcccacccctctgacgctctgaccaggaaaaaaccggccaaggcggaatctaagtcctttgctgtgggacgactcggaccgatg

SEQ ID NO: 12233 - DNA, 203 bp, Homo sapiens
  source 1..203: mol_type = other DNA
ggcgcgccagtcctacattattctcggcaggaagagaccgacccgccacccgccgtagcccgcgcgcccctggcactcaatccccgccatgtgggggctcctgctcgccctggccgccttcgcatgacaatacggcccggctctgggggcgcccaggaactcggtgctgggcctcgcgcagcccgggacgactcggaccgatg

SEQ ID NO: 12234 - DNA, 203 bp, Homo sapiens
  source 1..203: mol_type = other DNA
ggcgcgccagtcctacgcgcctctcggcaggaagagaccgacccgccacccgccgtagcccgcgcgcccctggcactcaatccccgccatgtgggggctcctgctcgccctggccgccttcgcgccggccgtaatgattcagtaacgggcgcccaggaactcggtgctgggcctcgcgcagcccgggacgactcggaccgatg

SEQ ID NO: 12235 - DNA, 203 bp, Homo sapiens
  source 1..203: mol_type = other DNA
ggcgcgccagtcctagaagccgctcggcaggaagagaccgacccgccacccgccgtagcccgcgcgcccctggcactcaatccccgccatgtgggggctcctgctcgccctggccgccttcgcgccggccgtcggcccggctctggatcattaagacttgtcggtgctgggcctcgcgcagcccgggacgactcggaccgatg

SEQ ID NO: 12236 - DNA, 203 bp, Homo sapiens
  source 1..203: mol_type = other DNA
ggcgcgccagtcctgtactttgctcggcaggaagagaccgacccgccacccgccgtagcccgcgcgcccctggcactcaatccccgccatgtgggggctcctgctcgccctggccgccttcgcgccggccgtcggcccggctctgggggcgcccaggaacagatgctctaatgacgcgcagcccgggacgactcggaccgatg

SEQ ID NO: 12237 - DNA, 203 bp, Homo sapiens
  source 1..203: mol_type = other DNA
ggcgcgccagtcctagtccgccctcggcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtgctgggcctgcgtatcgtactagcgactcggaccgatg

SEQ ID NO: 12238 - DNA, 203 bp, Homo sapiens
  source 1..203: mol_type = other DNA
ggcgcgccagtcctgcccgtgactcgtgtttatggggtttcccctggaaaatggtgagggacgattggcatgctacaggctgttgctgacggcaaggctcatttcactgagtcagtgaagccagtgctcgacctgacaaattcaatcctgtgtcgggtggaatgaataacatgtcttctgctgcgccccgactcggaccgatg

SEQ ID NO: 12239 - DNA, 203 bp, Homo sapiens
  source 1..203: mol_type = other DNA
ggcgcgccagtccttcctggctctcgtgtttatggggtttcccctggactcgttcataacctcgggtcgtaagccgaggctgttgctgacggcaaggctcatttcactgagtcagtgaagccagtgctcgacctgacaaattcaatcctgtgtcgggtggaatgaataacatgtcttctgctgcgccccgactcggaccgatg

SEQ ID NO: 12240 - DNA, 203 bp, Homo sapiens
  source 1..203: mol_type = other DNA
ggcgcgccagtcctgcgtgtaactcgtgtttatggggtttcccctggactcgttcataacctgattggcatgctacaggctgttgctgacggcaaggctcatttcactgagtcagtgaagccagtgctcgacctgacaaattcaatcctgtgtcgggtggttatggagcagaaccttctgctgcgccccgactcggaccgatg

SEQ ID NO: 12241 - DNA, 203 bp, Homo sapiens
  source 1..203: mol_type = other DNA
ggcgcgccagtccttcagaagactcgtgtttatggggtttcccctggactcgttcataacctgattggcatgctacgattctcgcggagaggcaaggctcatttcactgagtcagtgaagccagtgctcgacctgacaaattcaatcctgtgtcgggtggaatgaataacatgtcttctgctgcgccccgactcggaccgatg

SEQ ID NO: 12242 - DNA, 203 bp, Homo sapiens
  source 1..203: mol_type = other DNA
ggcgcgccagtcctatcttagcctctaagcgagctgtgtgtgggcggatgcgagtggccggagaccagggcccaacataaacaagctttggagacaaacaaccttatgacctgtcagccctgacaaaggtcagctagccccttgaggacatcagctttggcctcagggtcctaatggcagcagaaccacgactcggaccgatg

SEQ ID NO: 12243 - DNA, 203 bp, Homo sapiens
  source 1..203: mol_type = other DNA
ggcgcgccagtcctctgtgggcctctaatggccatcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcaaccgactcggaccgatg

SEQ ID NO: 12244 - DNA, 203 bp, Homo sapiens
  source 1..203: mol_type = other DNA
ggcgcgccagtcctggctttcactctcacgcattttagtgtcatgaattagtgtttcaaatcagttgcatatcaattaagaaaaacttaggagacaggtatagaacctctctttcagataactggtcaattaaggacagaaattctgtttctcaaatccgctagcctttgtcaatagatgagtggattcgactcggaccgatg

SEQ ID NO: 12245 - DNA, 203 bp, Homo sapiens
  source 1..203: mol_type = other DNA
ggcgcgccagtcctgctctatactctcacgcattttagtgtcatgaattagtgtttcaaatcagttgcatatcaattaagaaaaacttaggagacaggtatagaacctctctttcagataactggtcaattaccccagagttgctcgtttctcaaatccgctagcctttgtcaaagaggacacaagcacgactcggaccgatg

SEQ ID NO: 12246 - DNA, 203 bp, Homo sapiens
  source 1..203: mol_type = other DNA
ggcgcgccagtccttgtgaacactctgatcctctacaactcttgaaacacagatttcccacaagtctcctcttcgtcatcaagcaaccaccgcatccagcatcaagcccacctgaaatgcgacggtctccatctctggccgaacgatatcggtagttaattaaaacttagggtgcaagatcatccacacgactcggaccgatg

SEQ ID NO: 12247 - DNA, 203 bp, Homo sapiens
  source 1..203: mol_type = other DNA
ggcgcgccagtcctgacatattctctgatcctctacaactcttgaaacacagatttcccacaagtctcctcttcgtgtctcttactattacgcatccagcatcaagcccacctgaaattgtctccggcttccctctggccgaacgatatcggtagttaattaaaacttagggtgcaagatcatccacacgactcggaccgatg

SEQ ID NO: 12248 - DNA, 203 bp, Homo sapiens
  source 1..203: mol_type = other DNA
ggcgcgccagtcctgcctggtcctctgatcctctctgtggaaccgccaacagatttcccacaagtctcctcttcgtcatcaagcaaccaccgcatccagcatcaagcccacctgaaattgtctccggcttccctctggccgaacgatatcggtagttaattaaaacttagggtgcaagatcatccacacgactcggaccgatg

SEQ ID NO: 12249 - DNA, 203 bp, Homo sapiens
  source 1..203: mol_type = other DNA
ggcgcgccagtcctaagtctgactctgcggccaaaagccacgtggataagatccacctttgtgtgcggtgcaacccagaagggggtcgaccttggtgacactctagtgaacccctgaatggcaatctcaagcgcctctgtagggaagccaagaatgtccaggaggtaccccttcctctcggaagggatcgactcggaccgatg

SEQ ID NO: 12250 - DNA, 203 bp, Homo sapiens
  source 1..203: mol_type = other DNA
ggcgcgccagtcctagtctacactctgcggccaaaagccacgtggataagatccacctttgtgtgcggtgcaaccccagcaccctggtttcttggtgacactctagtgaacccctgaatggcaatctcaagcgcctctgtagggaaagactagcccggatggaggtaccccttcctctcggaagggatcgactcggaccgatg

SEQ ID NO: 12251 - DNA, 203 bp, Homo sapiens
  source 1..203: mol_type = other DNA
ggcgcgccagtcctataaagttctctgcggccaaaagccacgtggataagatccacctttgtgtgcggtgcaaccccagcaccctggtttcttggtgacactctagtgaacccctgaatggcaatctcaagctttatccctacctcgccaagaatgtccaggaggtaccccttcctctcggaagggatcgactcggaccgatg

SEQ ID NO: 12252 - DNA, 203 bp, Homo sapiens
  source 1..203: mol_type = other DNA
ggcgcgccagtcctaaggagcgctctgcggccaaaagccacgtggataagatccacctttgtgtgcggtgcaaccccagcaccctggtttcttggtgacactctcaaccggattgtcctggcaatctcaagcgcctctgtagggaagccaagaatgtccaggaggtaccccttcctctcggaagggatcgactcggaccgatg

SEQ ID NO: 12253 - DNA, 203 bp, Homo sapiens
  source 1..203: mol_type = other DNA
ggcgcgccagtcctgtcattctctctgcggccaagcctactaatcgcgagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatcgactcggaccgatg

SEQ ID NO: 12254 - DNA, 203 bp, Homo sapiens
  source 1..203: mol_type = other DNA
ggcgcgccagtcctctgcaatactcttatcccgcgtaccctgctctacttagatcttgtttatttgtagtttccttttcaagtcagtggatctcagcgatgtacgctcaatgattccaatttttctgttcttgccttcaggttgtctattacactttcatgtcctctggacttaactctgtttcccatcgactcggaccgatg

SEQ ID NO: 12255 - DNA, 203 bp, Homo sapiens
  source 1..203: mol_type = other DNA
ggcgcgccagtcctcggatcgcctcttgagactggccgaaaggcagccacggggccaccaaggcggcgcagcgctgagaaactatctttcaaaaatccttcgggtgacccctggtggcaatcccttcccttaggagcatgagtgtggtcgacacattcaccatggcttggctgtggttgctggtttgccgactcggaccgatg

SEQ ID NO: 12256 - DNA, 203 bp, Homo sapiens
  source 1..203: mol_type = other DNA
ggcgcgccagtccttgcaggacctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgccgactcggaccgatg

SEQ ID NO: 12257 - DNA, 203 bp, Homo sapiens
  source 1..203: mol_type = other DNA
ggcgcgccagtcctggatgggactcttgagactggccgaaaggcagccacggggccaccaaggcggcgcagcgctgcatgcggcaagggggtgttgagacaaattgacccctggtggcaatcccttcccttaggagcatgagtgtggtcgacacattcaccatggcttggctgtggttgctggtttgccgactcggaccgatg

SEQ ID NO: 12258 - DNA, 203 bp, Homo sapiens
  source 1..203: mol_type = other DNA
ggcgcgccagtcctagccagcactgaaacaagaagtttgtgcctactcaacagctttgaaagagcacttcccaacgctgctagtagtcttataggcggcatcaactgtactgtgagattgcccggtacagcagcagttgtattctttattagcttggtagatcattttctctcgctcttttttttaatcgactcggaccgatg

SEQ ID NO: 12259 - DNA, 203 bp, Homo sapiens
  source 1..203: mol_type = other DNA
ggcgcgccagtcctggaatcaactgaaacaagaagtttgtgcctactcaacagctttgaaagagcacttcccaacgctgctagtagtctttgttttcttcagtgctgtactgtgagattgcccggtacagcagcagttgtattcttccgacttggacgtcatcattttctctcgctcttttttttaatcgactcggaccgatg

SEQ ID NO: 12260 - DNA, 203 bp, Homo sapiens
  source 1..203: mol_type = other DNA
ggcgcgccagtcctaatcacttctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcggatgcccggccggccgactcggaccgatg

SEQ ID NO: 12261 - DNA, 203 bp, Homo sapiens
  source 1..203: mol_type = other DNA
ggcgcgccagtcctcaggtacactgaatgtggctggatcgctaagcttagctagagcacgtaacccaatgtgtatctagtcgtaatgagcaattgcgggatgggaccaactactttgggtgtccgtgtttcactttttcctttatatttgcttatggtgacaatatatacaatatatatattggcacccgactcggaccgatg

SEQ ID NO: 12262 - DNA, 203 bp, Homo sapiens
  source 1..203: mol_type = other DNA
ggcgcgccagtcctctatacaactgagcagccagtaggggagagagcaacccgttgggctttagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 12263 - DNA, 203 bp, Homo sapiens
  source 1..203: mol_type = other DNA
ggcgcgccagtcctaacgcggcctgagcagccagtaggggagagagcagttaaggcacacagagcaccagctccctcctgcctgaagatgttccaccaaatttgccttctaacctgagacttctatggtattatccttaactccatctaccagtgccctgagcacagtcaactgacaactctgggcgtcgactcggaccgatg

SEQ ID NO: 12264 - DNA, 203 bp, Homo sapiens
  source 1..203: mol_type = other DNA
ggcgcgccagtccttcgatcgtctgagcagccagtaggggagagagcagttaaggcacacagagcaccagctccctcctgcctgaagatgttccaccaaatttgggcagctctgctctacttctatggtattatccttaactccatagttgtaaaaatgtagcacagtcaactgacaactctgggcgtcgactcggaccgatg

SEQ ID NO: 12265 - DNA, 203 bp, Homo sapiens
  source 1..203: mol_type = other DNA
ggcgcgccagtcctgatccagactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 12266 - DNA, 203 bp, Homo sapiens
  source 1..203: mol_type = other DNA
ggcgcgccagtcctcccatttgctgagcagccagtaggggagagagcagttaaggcacacagagcaccagctccctcctgcctgaagatgttccaccaaatttgggcagctctgctctacttctatggtattatccttaactccatctaccagtgccctggattggccagctgtacaactctgggcgtcgactcggaccgatg

SEQ ID NO: 12267 - DNA, 203 bp, Homo sapiens
  source 1..203: mol_type = other DNA
ggcgcgccagtcctgggccggcctgagcagccagtaggggagagagcagttaaggcacacagctgtggtttattaacctgcctgaagatgttccaccaaatttgggcagctctgctctacttctatggtattatccttaactccatctaccagtgccctgagcacagtcaactgacaactctgggcgtcgactcggaccgatg

SEQ ID NO: 12268 - DNA, 203 bp, Homo sapiens
  source 1..203: mol_type = other DNA
ggcgcgccagtcctccagagaactgaggcccgggcactgagctgccataccccgaaagcaggatggagctggagtgaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12269 - DNA, 203 bp, Homo sapiens
  source 1..203: mol_type = other DNA
ggcgcgccagtcctcagacccactgatattaatatccctgatttacccatttgtgtgtatgatccgctaccagttattttgcttggcattcttttgggcgttgcgattgtaattattgtagttttgttgttatattttatggtggaagcgcgccgctttttgcatgatgcttagaccataatctaaaccgactcggaccgatg

SEQ ID NO: 12270 - DNA, 203 bp, Homo sapiens
  source 1..203: mol_type = other DNA
ggcgcgccagtccttacataacctgatattaatatccctgatttacccatttgtgtgtatgatccgctaccagttattttgcttggcattcttttgggcgttgcgattgtaattattgtagttttgttgttatattttatggtggataatgttactaggctgcatgatgcttaggatgacggtacgtgcgactcggaccgatg

SEQ ID NO: 12271 - DNA, 203 bp, Homo sapiens
  source 1..203: mol_type = other DNA
ggcgcgccagtcctccgccatgctgcagccgccgattttaaatcagcgcagtcagcagctcggcgccacctccggtcggcgactgcggcgggctcgacgaggcggctgacggggcggcggcgggaagacggccgggtgcgccttggggtttagtggcggcttctccatgggtccagccagccgcttcccgactcggaccgatg

SEQ ID NO: 12272 - DNA, 203 bp, Homo sapiens
  source 1..203: mol_type = other DNA
ggcgcgccagtcctatacgtctctgcagccgccgccgccggccgccttcagtcagcagctcggcgccacctccggtcggcgactgcggcgggctcgacgaggcggctgacggggcggcatacatttagtcttcgggtgcgccttggggtttagtggcggcttctccatgggtccagccagccgcttcccgactcggaccgatg

SEQ ID NO: 12273 - DNA, 203 bp, Homo sapiens
  source 1..203: mol_type = other DNA
ggcgcgccagtcctctccgtgcctgcagccgccgccgccggccgccttcagtcagcagctcggcgccacctccggtcggcgactgcggcgggctcgacgaggcggctgacggggcggcggcgggaagacggccgggtgcgccttggggtttagtggcggcttctccatgggtccccgtgttgttccttcgactcggaccgatg

SEQ ID NO: 12274 - DNA, 203 bp, Homo sapiens
  source 1..203: mol_type = other DNA
ggcgcgccagtcctgtttaaagctgccacagaaacgcttaggactcccattcccatggagaaactcctagatgaggttcttgcccccggtgggccttataacttaaccgtcggcagttgggtaagagaccacgtccgatcaattgtcgagggcgcgtgggaagtgcgcgatgttgttaccgctgcccacgactcggaccgatg

SEQ ID NO: 12275 - DNA, 203 bp, Homo sapiens
  source 1..203: mol_type = other DNA
ggcgcgccagtcctatcccgtgctgccctaaaatagcttcccatgtgagggctagagaaaggaaaagattagacccgttgctacgctagaagagaaagtgaaggagggcaggggagggggacagcgagccattgagcgatctttgtcaagcatcccagaagactgcgccatggggctcagcgacggggcgactcggaccgatg

SEQ ID NO: 12276 - DNA, 203 bp, Homo sapiens
  source 1..203: mol_type = other DNA
ggcgcgccagtcctatgttccactgccctaaaatagcttcccatgtgagggctagagaaaggaaaagattagaccctccctggatgagagagagaaagtgaaggagggcaggggagggggacagcgagccattgagcgatctttgtcaagcatcccagaactactgctagcaccgctcagcgacggggcgactcggaccgatg

SEQ ID NO: 12277 - DNA, 203 bp, Homo sapiens
  source 1..203: mol_type = other DNA
ggcgcgccagtcctcaccacaactgccctaaaatagcttcccatgtgagggctagagaaaggaaaagattagaccctccctggatgagagagagaaagtgaaggtctcgccctccaacggacagcgagccattgagcgatctttgtcaagcatcccagaagactgcgccatggggctcagcgacggggcgactcggaccgatg

SEQ ID NO: 12278 - DNA, 203 bp, Homo sapiens
  source 1..203: mol_type = other DNA
ggcgcgccagtcctcgtttgttctgccctaaaatagcttcccatgtgagggctagagaaaggcccgcggatatggttccctggatgagagagagaaagtgaaggagggcaggggagggggacagcgagccattgagcgatctttgtcaagcatcccagaagactgcgccatggggctcagcgacggggcgactcggaccgatg

SEQ ID NO: 12279 - DNA, 203 bp, Homo sapiens
  source 1..203: mol_type = other DNA
ggcgcgccagtccttggcattcctgccctaaaatcatcaaggtcaactgggctagagaaaggaaaagattagaccctccctggatgagagagagaaagtgaaggagggcaggggagggggacagcgagccattgagcgatctttgtcaagcatcccagaagactgcgccatggggctcagcgacggggcgactcggaccgatg

SEQ ID NO: 12280 - DNA, 203 bp, Homo sapiens
  source 1..203: mol_type = other DNA
ggcgcgccagtcctatggtagtctgccggccggcactagtctttgacgccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 12281 - DNA, 203 bp, Homo sapiens
  source 1..203: mol_type = other DNA
ggcgcgccagtcctactctgttctgccggccggcggccccgcgctcgcccgccccgcttccgaagatccgaggtgagcacgaacccttccaactctcctttcctcccccacccttgagttacccctctgtctttcctgctgttgcgcgggtgctcccacagcggagcggagattacagagccgccgggcgactcggaccgatg

SEQ ID NO: 12282 - DNA, 203 bp, Homo sapiens
  source 1..203: mol_type = other DNA
ggcgcgccagtcctccggctgactgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 12283 - DNA, 203 bp, Homo sapiens
  source 1..203: mol_type = other DNA
ggcgcgccagtcctccacttggctgccggccggcggccccgcgctcgcccgccccgcttccgcccgctgtcctgctgcacgaacccttccttgctatacgcaaacccccacccttgagttacccctctgtctttcctgctgttgcgcgggtgctcccacagcggagcggagattacagagccgccgggcgactcggaccgatg

SEQ ID NO: 12284 - DNA, 203 bp, Homo sapiens
  source 1..203: mol_type = other DNA
ggcgcgccagtcctaatattctctgccggccggcggccccgcgctcgcccgccccgcttccgcccgctgtcctgcttactttgattccataactctcctttcctcccccacccttgagttacccctctgtctttcctgctgttgcgcgggtgctcccacagcggagcggagattacagagccgccgggcgactcggaccgatg

SEQ ID NO: 12285 - DNA, 203 bp, Homo sapiens
  source 1..203: mol_type = other DNA
ggcgcgccagtcctgagcattgctgccggccggcggccccgcgctcgcgttagagcgcagttcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 12286 - DNA, 203 bp, Homo sapiens
  source 1..203: mol_type = other DNA
ggcgcgccagtcctccacccttctgctataagaaaggccttattaggacacatagttagccctaggtgtgaatatcaagcaggacataactgttatcaggtagaacaatacttggcactagcagcattaataacaccaaaaaagataaagccacctttgcctagtgttacgaaactgacagaggatagcgactcggaccgatg

SEQ ID NO: 12287 - DNA, 203 bp, Homo sapiens
  source 1..203: mol_type = other DNA
ggcgcgccagtcctacccaagtctgcttatggtgacaattgagagattgttaccatatagctcaactgccatagtaccggtgaccaatagagctattatatatctctttgttgggtttataccacttagcttgaaagaggttaaaacattacaattcattgttaagttgaatacagcaaaatgggagccgactcggaccgatg

SEQ ID NO: 12288 - DNA, 203 bp, Homo sapiens
  source 1..203: mol_type = other DNA
ggcgcgccagtccttatgtactctgcttatggtggttccgtgcgaccggttaccatatagctattggattggccatccggtgaccaatagagctattatatatctctttgttgggtttataccacttagcttgaaagaggttaaaacattacaattcattgttaagttgaatacagcaaaatgggagccgactcggaccgatg

SEQ ID NO: 12289 - DNA, 203 bp, Homo sapiens
  source 1..203: mol_type = other DNA
ggcgcgccagtcctaggtccatctggctctggaggcgcaggtggtcctgacctcctccaggtatggtgcgcgctgttttctaatcacgtggctgccacccaggtaagaagaggccgctcttcctggggttgtttctccgtgtgacgtgtggcctttgagatcaactctcctgtaccagcgtaggccgccgactcggaccgatg

SEQ ID NO: 12290 - DNA, 203 bp, Homo sapiens
  source 1..203: mol_type = other DNA
ggcgcgccagtcctgcatcgatctggctctggaggcgcaggtggtccttcttctactgtcacatggtgcgcgctgtggcgcctggttcccgctgccacccaggtaagaagaggccgctcttcctggggttgtttctccgtgtgacgtgtggcctttgagatcaactctcctgtaccagcgtaggccgccgactcggaccgatg

SEQ ID NO: 12291 - DNA, 203 bp, Homo sapiens
  source 1..203: mol_type = other DNA
ggcgcgccagtccttccactccctggctctggaggcgcaggtggtccttcttctactgtcacatggtgcgcgctgttttctaatcacgtggctgccacccaggtaagaagaggccgctcttcctggggttgtgggggaacaatttatgtggcctttgagatcaactctcctgtaccagcgtaggccgccgactcggaccgatg

SEQ ID NO: 12292 - DNA, 203 bp, Homo sapiens
  source 1..203: mol_type = other DNA
ggcgcgccagtcctgtaagcgtctggctgagcctatgtaattagccattccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 12293 - DNA, 203 bp, Homo sapiens
  source 1..203: mol_type = other DNA
ggcgcgccagtcctagtagttcctggctgagcctggcgggaggcggggagatgcattaacagtgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 12294 - DNA, 203 bp, Homo sapiens
  source 1..203: mol_type = other DNA
ggcgcgccagtcctccggtgtactggctgagcctggcgggaggcggggtccgagtcaccgcctgccgccgcgcccccggtttctataaattgagcccgcagcctcccgcttcgctctctgctcctcctgttcccagtcgtagtaagtcttcttttgcgtcgccagccgagccacatcgctcagacacccgactcggaccgatg

SEQ ID NO: 12295 - DNA, 203 bp, Homo sapiens
  source 1..203: mol_type = other DNA
ggcgcgccagtccttaccgcagctggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcagttctactaagttatcgctcagacacccgactcggaccgatg

SEQ ID NO: 12296 - DNA, 203 bp, Homo sapiens
  source 1..203: mol_type = other DNA
ggcgcgccagtccttgcaccggctgggtcgccagatttggttgtctttttttgaggccttgtgcgctgtacttctccaaatgggaaacaagcaagccaaagccccagaatcaaaagacagtccgagagccagcctgatcccagatgccacacatctagggccacagttctgtaagagctgctggttcgcgactcggaccgatg

SEQ ID NO: 12297 - DNA, 203 bp, Homo sapiens
  source 1..203: mol_type = other DNA
ggcgcgccagtcctacttgggtctggtacttggtccaaggacgcagacctctttttgagtatcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12298 - DNA, 203 bp, Homo sapiens
  source 1..203: mol_type = other DNA
ggcgcgccagtcctaggagtgtctggtgctgctcataaaacagacatcaatccattgaatcaactgccagaccgaacaaacaaatgtccgtcagcggaaccaccaaccaatcaatcaaccaactgatccatcagcaacctgacgaaattaacaatatagtaacaaaaaaagaacaagatggggcaaatcgactcggaccgatg

SEQ ID NO: 12299 - DNA, 203 bp, Homo sapiens
  source 1..203: mol_type = other DNA
ggcgcgccagtcctttctcggcctggttaccagcaacataggaaattgtcgttgaactacatgttgtaaggctttagagaaataagggagtgtcctatttaggaccgacaagagtcaaggcagccccaccaaaacctctagcgactaggaacagctatatcgggttgctatagcagtcaggatgtcatcgactcggaccgatg

SEQ ID NO: 12300 - DNA, 203 bp, Homo sapiens
  source 1..203: mol_type = other DNA
ggcgcgccagtcctctttggcgctgtcctcgccgccgtcgcgggcagtaatccagtcataagtgacaagctagccggaggagcgcctaggaacccgagccggagctcagcgagcgcagcctgcacgcccgcctcgcgtcccgggggggtcccgcctcccaccccgcctctggacttgtctctttcccccgactcggaccgatg

SEQ ID NO: 12301 - DNA, 203 bp, Homo sapiens
  source 1..203: mol_type = other DNA
ggcgcgccagtccttatactgtctgtcctcgccgccgtcgcgggcagtgtctagccaggcctcactgctgagcgttgaggagcgcctaggaacccgagccggagctcagcgagcgcagcctgcacgcccgcctcgcgtcccgggggggtcccgcctcccaccccgcctctggacttgtctctttcccccgactcggaccgatg

SEQ ID NO: 12302 - DNA, 203 bp, Homo sapiens
  source 1..203: mol_type = other DNA
ggcgcgccagtcctcggagaccctgtcctcgccgccgtcgcgggcagtgtctagccaggccttgacaagctagccgataagttaggctcaaacccgagccggagctcagcgagcgcagcctgcacgcccgcctcgcgtcccgggggggtcccgcctcccaccccgcctctggacttgtctctttcccccgactcggaccgatg

SEQ ID NO: 12303 - DNA, 203 bp, Homo sapiens
  source 1..203: mol_type = other DNA
ggcgcgccagtcctgtacggccctgtcctcgccgccgtcgcgggcagtgtctagccaggccttgacaagctagccggaggagcgcctaggaacccgagccggagctcagcgagcgcagcctgcacgcccgccggctactagccataggtcccgcctcccaccccgcctctggacttgtctctttcccccgactcggaccgatg

SEQ ID NO: 12304 - DNA, 203 bp, Homo sapiens
  source 1..203: mol_type = other DNA
ggcgcgccagtcctaattcgttctgtcctcgccgccgtcgcgggcagtgtctagccaggccttgacaagctagccggaggagcgcctaggaacccgagccggagctcagcgagcgcagcctgcacgcccgcctcgcgtcccgggggttagaacagaaaatccccgcctctggacttgtctctttcccccgactcggaccgatg

SEQ ID NO: 12305 - DNA, 203 bp, Homo sapiens
  source 1..203: mol_type = other DNA
ggcgcgccagtccttcacgcatctgtcctcgccgtgcctcacttattggtctagccaggccttgacaagctagccggaggagcgcctaggaacccgagccggagctcagcgagcgcagcctgcacgcccgcctcgcgtcccgggggggtcccgcctcccaccccgcctctggacttgtctctttcccccgactcggaccgatg

SEQ ID NO: 12306 - DNA, 203 bp, Homo sapiens
  source 1..203: mol_type = other DNA
ggcgcgccagtcctgtggaccactgtgagatcaactacgatccttttatgggagctggggcagggactacgagagcagccagatgggctgaaagtggaactcaaggggtttctggcacctacctacctgcttcccgctggggggtggggagttggcccagagtcttaagattggggcagggtggagagcgactcggaccgatg

SEQ ID NO: 12307 - DNA, 203 bp, Homo sapiens
  source 1..203: mol_type = other DNA
ggcgcgccagtcctagggctttctgtgagatcaagggtctcttaaggggttttcgaccacgtgggactacgagagcagccagatgggctgaaagtggaactcaaggggtttctggcacctacctacctgcttcccgctggggggtggggagttggcccagagtcttaagattggggcagggtggagagcgactcggaccgatg

SEQ ID NO: 12308 - DNA, 203 bp, Homo sapiens
  source 1..203: mol_type = other DNA
ggcgcgccagtcctggtgtttcctgtgagatcaagggtctcttaagggtgggagctggggcagggactacgagagcagccagatgggctgaaagtggaactcaaggggtttctggcacctacctacctgcttcccgctggggggtggggagttggcccaggtaaacccagcgttggcagggtggagagcgactcggaccgatg

SEQ ID NO: 12309 - DNA, 203 bp, Homo sapiens
  source 1..203: mol_type = other DNA
ggcgcgccagtcctaggaacggctgtgagatcaagggtctcttaagggtgggagctggggcagggactacgagagcagccagatgggctgaaagtggaactcaatttaacgtacatctctacctacctgcttcccgctggggggtggggagttggcccagagtcttaagattggggcagggtggagagcgactcggaccgatg

SEQ ID NO: 12310 - DNA, 203 bp, Homo sapiens
  source 1..203: mol_type = other DNA
ggcgcgccagtcctagtttggcctgtgagatcaagggtctcttaagggtgggagctggggcagggactacgagagctcatgtgcccctgaaaagtggaactcaaggggtttctggcacctacctacctgcttcccgctggggggtggggagttggcccagagtcttaagattggggcagggtggagagcgactcggaccgatg

SEQ ID NO: 12311 - DNA, 203 bp, Homo sapiens
  source 1..203: mol_type = other DNA
ggcgcgccagtcctatagtgctctgtgagattgcccggtacagcagcaccatgcacaggctctagcttggtagatcattttctctcgctcttttttttaatactagcaactttcatcctttgaaacgtgtgctgaaaaagaagaatcagcaaatactactgaaagtgcaatatttgagtatcactgcgcgactcggaccgatg

SEQ ID NO: 12312 - DNA, 203 bp, Homo sapiens
  source 1..203: mol_type = other DNA
ggcgcgccagtcctagcaatatctgtgagattgcccggtacagcagcagttgtattctttatgtaaagacaccgctattttctctcgctcttttttttaatactagcaactttcatcctttgaaacgtgtgctgaaaaagaagaatcagcaaatactactgaaagtgcaatatttgagtatcactgcgcgactcggaccgatg

SEQ ID NO: 12313 - DNA, 203 bp, Homo sapiens
  source 1..203: mol_type = other DNA
ggcgcgccagtcctcctggcgtctgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatattgctaagatctcaatcgactcggaccgatg

SEQ ID NO: 12314 - DNA, 203 bp, Homo sapiens
  source 1..203: mol_type = other DNA
ggcgcgccagtcctgggctcccctgtgagccccggccccagccgcggacagacccgcggagtcgcctcccggcccacccgcccggccgcctgtttctttcgtttggacgggaccccggcgcccccaccccatccccgggagaactctaagaaggagctgatgtggaggagcagctgagacagttcaagcgactcggaccgatg

SEQ ID NO: 12315 - DNA, 203 bp, Homo sapiens
  source 1..203: mol_type = other DNA
ggcgcgccagtccttttagggtctgtgagccccggccccagccgcggacagacccgcggagtcgcctcccggcccaggtagtaatggagagaggagcgggaggaggacgggaccccggcgcccccaccccatccccgggagaactctaagaaggagctgatgtggaggagcagctgagacagttcaagcgactcggaccgatg

SEQ ID NO: 12316 - DNA, 203 bp, Homo sapiens
  source 1..203: mol_type = other DNA
ggcgcgccagtcctattacatgctgtgagccccggccccagccgcggacagacccgcggagtgaatggagtcggagcccgcccggccgccgaggagcgggaggaggacgggaccccggcgcccccaccccatccccgggagaactctaagaaggagctgatgtggaggagcagctgagacagttcaagcgactcggaccgatg

SEQ ID NO: 12317 - DNA, 203 bp, Homo sapiens
  source 1..203: mol_type = other DNA
ggcgcgccagtcctccagctacctgtgagccccgtaatgcttactttccagacccgcggagtcgcctcccggcccacccgcccggccgccgaggagcgggaggaggacgggaccccggcgcccccaccccatccccgggagaactctaagaaggagctgatgtggaggagcagctgagacagttcaagcgactcggaccgatg

SEQ ID NO: 12318 - DNA, 203 bp, Homo sapiens
  source 1..203: mol_type = other DNA
ggcgcgccagtccttccaccatctgtgcagtcagccttaaacactgactgcacccctcccagatttcttttacattcttcccgccagggcatcacacaatctcataaaatttatgtaatttcatttaattttagccacaaatcatcaaaatgacgaggattttgacagctttcaaagtggtgaggacacgactcggaccgatg

SEQ ID NO: 12319 - DNA, 203 bp, Homo sapiens
  source 1..203: mol_type = other DNA
ggcgcgccagtcctcttccctgctgtggtaggggaatgccacctgtcatttgaggagcagccgtgtggtatgattgatgattcaacacgcgttctcgccaagtccagcaaggactacatcaatgctagttatattagaatagtcaattgtggagaagagtatttttatatcgctactcaaggaccactcgactcggaccgatg

SEQ ID NO: 12320 - DNA, 203 bp, Homo sapiens
  source 1..203: mol_type = other DNA
ggcgcgccagtcctctttaagcctgtggtaggggcgacagtgtcgaatcctgaggagcagccgtgtggtatgattgatgattcaacacgcgttcctcttggaaaaagcaaggactacatcaatgctagttatattagaatagtcaattgtggagaagagtatttttatatcgctactcaaggaccactcgactcggaccgatg

SEQ ID NO: 12321 - DNA, 203 bp, Homo sapiens
  source 1..203: mol_type = other DNA
ggcgcgccagtcctaggcgtacctgtgtgctaataacatcttcgaatgctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 12322 - DNA, 203 bp, Homo sapiens
  source 1..203: mol_type = other DNA
ggcgcgccagtcctccgggcccctgtgtgctaattgaggtgcattggtctgcaaatcgagttgctaggcaataaacacatttggattaatcacttcacacgtccgagcgattagcagagaactgaccagaacatgtctggtcgtaaagctcagggaaaaaccctgggcgtcaatatggtacgacgaggcgactcggaccgatg

SEQ ID NO: 12323 - DNA, 203 bp, Homo sapiens
  source 1..203: mol_type = other DNA
ggcgcgccagtcctgtgatacgctgtgtgctaattgaggtgcattggtctgcaaatcgagttgctaggcaataaacacatttggattaattttaatcgttcgttgagcgattagcagagaactgaccagaacatgtctggtcgtaaagctcagggaaaaaatgcctctcgactaatggtacgacgaggcgactcggaccgatg

SEQ ID NO: 12324 - DNA, 203 bp, Homo sapiens
  source 1..203: mol_type = other DNA
ggcgcgccagtcctttcgtctgctgtgtgctaattgaggtgcattggtctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 12325 - DNA, 203 bp, Homo sapiens
  source 1..203: mol_type = other DNA
ggcgcgccagtccttatgcttcctgttgctccttaaatactgaggggactgtattgaaagcgtttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12326 - DNA, 203 bp, Homo sapiens
  source 1..203: mol_type = other DNA
ggcgcgccagtcctagacggttctgttgctccttctgcctcccctctcacagggcatgtctctttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12327 - DNA, 203 bp, Homo sapiens
  source 1..203: mol_type = other DNA
ggcgcgccagtcctgtgtgctactgttgctccttctgcctcccctctcctgtattgaaagcgcgcactacacgagcatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12328 - DNA, 203 bp, Homo sapiens
  source 1..203: mol_type = other DNA
ggcgcgccagtcctacttaatgctgttgctccttctgcctcccctctcctgtattgaaagcgtttgtgttcatcttatcagggacctgaccctaagagaatccttcccctgccaaggcagttccagcccccagaactcatcaccccatctcctgaggtggttcctatcctccctctcttctcctcgcccgactcggaccgatg

SEQ ID NO: 12329 - DNA, 203 bp, Homo sapiens
  source 1..203: mol_type = other DNA
ggcgcgccagtcctatgtagacctgttgctccttctgcctcccctctcctgtattgaaagcgtttgtgttcatcttatcagggacctgaccctaagagaatccttcccctgccaaggcagttccagcccccagaactcatcaccccgctaaacccacaatttcctatcctccctctcttctcctcgcccgactcggaccgatg

SEQ ID NO: 12330 - DNA, 203 bp, Homo sapiens
  source 1..203: mol_type = other DNA
ggcgcgccagtcctatctaacactgtttcctcctcctccttctcctcctcctccgtgacctcctcctcctctttctcctgagaaacttcgccccagcggtgcggagcgccgctgcgcacaactactcatcttcaggcaggcggcgggcagcgggaggcggcagcccggtgcggtccccgcggctctcgcgactcggaccgatg

SEQ ID NO: 12331 - DNA, 203 bp, Homo sapiens
  source 1..203: mol_type = other DNA
ggcgcgccagtcctttcgcgcgctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggacaggatccttctgccccgcggctctcgcgactcggaccgatg

SEQ ID NO: 12332 - DNA, 203 bp, Homo sapiens
  source 1..203: mol_type = other DNA
ggcgcgccagtccttattaagtctgtttcctcctcctccttctcctcctcctccgtgacctcctcctcctctttctcctgagaaacttcgccccagcggtgcggttatagctgctcgcgccggggagggacgcaggcaggcggcgggcagcgggaggcggcagcccggtgcggtccccgcggctctcgcgactcggaccgatg

SEQ ID NO: 12333 - DNA, 203 bp, Homo sapiens
  source 1..203: mol_type = other DNA
ggcgcgccagtcctctagttagcttacctgcaaccacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12334 - DNA, 203 bp, Homo sapiens
  source 1..203: mol_type = other DNA
ggcgcgccagtcctattggacccttactaataataacgtgcctcatgaaataaagatccgaaaggaattggaataaaaatttcctgcgtctcatgccaagagggaaacaccagaatcaagtgttccgcgtgaagtgcacgcgagtgtcgtccaagaatgcaaagcacatccaataaaatagctggattcgactcggaccgatg

SEQ ID NO: 12335 - DNA, 203 bp, Homo sapiens
  source 1..203: mol_type = other DNA
ggcgcgccagtcctatgcgcaacttactaataataacgtgcctcatgaaataaagatccgaaaggaattggaataaaaatttcctgcgtctcatgccaagagggttggcgtgactaatagtgttccgcgtgattgaagacaccccctcgtccaagaatgcaaagcacatccaataaaatagctggattcgactcggaccgatg

SEQ ID NO: 12336 - DNA, 203 bp, Homo sapiens
  source 1..203: mol_type = other DNA
ggcgcgccagtccttgttcgcacttactaataataacgtgcctcatgaaataaagatccgaaaggaattggaataactgcgattcatccgtcatgccaagagggaaacaccagaatcaagtgttccgcgtgattgaagacaccccctcgtccaagaatgcaaagcacatccaataaaatagctggattcgactcggaccgatg

SEQ ID NO: 12337 - DNA, 203 bp, Homo sapiens
  source 1..203: mol_type = other DNA
ggcgcgccagtcctgctacggtcttactaataataacgtgcctcatgattattcctcgtaccaggaattggaataaaaatttcctgcgtctcatgccaagagggaaacaccagaatcaagtgttccgcgtgattgaagacaccccctcgtccaagaatgcaaagcacatccaataaaatagctggattcgactcggaccgatg

SEQ ID NO: 12338 - DNA, 203 bp, Homo sapiens
  source 1..203: mol_type = other DNA
ggcgcgccagtcctcatttaaacttatgtattgagactcattgccttgtgactttatattcacaaaactgctggaagacaatgatctggggtatcacattccctcttaggttaagtttcgcactactaggaatttttgcgaaaattcttaattccattcttatggtgtagtgtttgttcttttcaattcgactcggaccgatg

SEQ ID NO: 12339 - DNA, 203 bp, Homo sapiens
  source 1..203: mol_type = other DNA
ggcgcgccagtcctgggaaatccttatgtattgatgagagccttaaaatgactttatattcacaaaactgctggaagacaatgatctggggtatcacattccctcttaggttaagtttcgcactactaggaatttttgcgaaaattcttaattccattcttatggtgtagtgtttgttcttttcaattcgactcggaccgatg

SEQ ID NO: 12340 - DNA, 203 bp, Homo sapiens
  source 1..203: mol_type = other DNA
ggcgcgccagtcctttctaaaccttcaaaacaaatcatatcaatacaatatcaagtagtgtcgatgatctcattaggtactaatcctaacattgtgattcatcctgcattgagaaaagatttagaaaaaaacggtcaacccgcaatatatcctggggtcgtaacgtctcgtgaccctgccgttgcactcgactcggaccgatg

SEQ ID NO: 12341 - DNA, 203 bp, Homo sapiens
  source 1..203: mol_type = other DNA
ggcgcgccagtcctcgcgactgcttcaaaacaaatcatatcaatacaatatcaagtagtgtcgatgatctcattaggtactaatcctaacattgtgattcatcctgcattgagaaaagggactatctgttcgtaaattaagaatgaatatcctggggtcgtaacgtctcgtgaccctgccgttgcactcgactcggaccgatg

SEQ ID NO: 12342 - DNA, 203 bp, Homo sapiens
  source 1..203: mol_type = other DNA
ggcgcgccagtcctcggtcgagcttcccggaactggaaggttacattgattacccacctagtacaacatcttacgggaagagcatagtatttcctagaggaatagtctgcgtcgtcccaggtatcattggctctgaattaaatttgaacttgtcccctgaatagctacaggttttggaagctgaatcacgactcggaccgatg

SEQ ID NO: 12343 - DNA, 203 bp, Homo sapiens
  source 1..203: mol_type = other DNA
ggcgcgccagtcctcggattcacttcccggaactggaaggttacattgattacccacctagtacaacatcttacgggaagagcatagtatttcctagaggaatatgaacataacaggacctgcgtgggccagctgaattaaatttgaacttgtcccctgaatagctacaggttttggaagctgaatcacgactcggaccgatg

SEQ ID NO: 12344 - DNA, 203 bp, Homo sapiens
  source 1..203: mol_type = other DNA
ggcgcgccagtcctgttctaggcttcccggaactggaaggttacattggacgagatttgtcgacaacatcttacgggaagagcatagtatttcctagaggaatatgaacataacaggaaggtatcattggctctgaattaaatttgaacttgtcccctgaatagctacaggttttggaagctgaatcacgactcggaccgatg

SEQ ID NO: 12345 - DNA, 203 bp, Homo sapiens
  source 1..203: mol_type = other DNA
ggcgcgccagtcctggatcaagcttcttccccggcctgatctgcgcagcccggcgggcgcccagaaggagcaggcggcgcgggggcgcgctgggcgggggaggcgtggccggagctgcaaaccaggattatgtgggactgctcggccgcctcctgcccggcgagcagctcaggtcctgggctgaagagcgactcggaccgatg

SEQ ID NO: 12346 - DNA, 203 bp, Homo sapiens
  source 1..203: mol_type = other DNA
ggcgcgccagtcctgcgggtggcttcttccccggcctgatctgcgcagggtcttacagctatagaaggagcaggcggcgcgggggcgcgctgggcgggggaggcgtggccggagctgcggcggcaagcgggctgggactgctcggccgcctcctgcccggcgagcagctcaggtcctgggctgaagagcgactcggaccgatg

SEQ ID NO: 12347 - DNA, 203 bp, Homo sapiens
  source 1..203: mol_type = other DNA
ggcgcgccagtcctgaggcacccttgaaaaactatgccccggcgggtccgccggccggaggcgggagtcacaggaagagccctccacaaaaggaggcctcggcggatcaggacagctgcaggcttctgccaggtgggtgtgcagactggtgagctgccagcaggggcccagacgcgccaggcctggagcgactcggaccgatg

SEQ ID NO: 12348 - DNA, 203 bp, Homo sapiens
  source 1..203: mol_type = other DNA
ggcgcgccagtcctcaccaaggcttgaggcaagtcaccagcccctgatcatttcgcctaaaagagcaaggactagagttcctgacctccacctgttatagaacaccctgacctaatgttatcgcggaatgatgatatatgtatctacgggggcctggggctgggcgggctcctgcttctggcagtggtcgactcggaccgatg

SEQ ID NO: 12349 - DNA, 203 bp, Homo sapiens
  source 1..203: mol_type = other DNA
ggcgcgccagtcctacgactagcttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtcgactcggaccgatg

SEQ ID NO: 12350 - DNA, 203 bp, Homo sapiens
  source 1..203: mol_type = other DNA
ggcgcgccagtccttataacctcttgcagccaacttcccatcagatcaccctgctggacttgcagaccggaatggggctcgcctaaggagccgagcgctgcggaggctgctgcgtgttcacactattgcctcgggggctggagcgagatttccagggcgcagtcctccggggcgttacgccgggcatacgactcggaccgatg

SEQ ID NO: 12351 - DNA, 203 bp, Homo sapiens
  source 1..203: mol_type = other DNA
ggcgcgccagtcctagtaaacccttgcagccaacttcccatcagatcaccctgctggacttgcagaccggaatggggctcgcctaaggagccgagcgctgcggaggctgctgcgtgttggatgggagtgggatcccctgtacctaggatttccagggcgcagtcctccggggcgttacgccgggcatacgactcggaccgatg

SEQ ID NO: 12352 - DNA, 203 bp, Homo sapiens
  source 1..203: mol_type = other DNA
ggcgcgccagtcctaagggcgtcttgcagccaacttcccatcagatcataagcactactggacagaccggaatggggctcgcctaaggagccgagcgctgcggaggctgctgcgtgttggatgggagtgggagggggctggagcgagatttccagggcgcagtcctccggggcgttacgccgggcatacgactcggaccgatg

SEQ ID NO: 12353 - DNA, 203 bp, Homo sapiens
  source 1..203: mol_type = other DNA
ggcgcgccagtcctcgaacttacttgcgaggtgatcagaaggcaaagatgtcggagcgaaaagtattaaacaaatactacccgccggactttgacccatcaaagatccccaaactcaagctccccaaagaccggcagtacgtggtgcggctgatggccccgaaattgtattcccgtaagacgtgcggacgactcggaccgatg

SEQ ID NO: 12354 - DNA, 203 bp, Homo sapiens
  source 1..203: mol_type = other DNA
ggcgcgccagtcctccggcactcttgcgaggtgatcagaaggcaaagatgtcggagcgaaaagtattaaacaaatactacccgccggactttgacccatcaaagtggaagtgtggatggctccccaaagaccggcagtacgtggtgcggctgatggcccccttcaacatgaggtgtaagacgtgcggacgactcggaccgatg

SEQ ID NO: 12355 - DNA, 203 bp, Homo sapiens
  source 1..203: mol_type = other DNA
ggcgcgccagtcctgaggctgtcttggacagtttgtttgccatggtgacataaaggggtgtagaggaaggaaggagcaagaccagcctgtagactgtgcccctggctgggcaaaagggccaggggcccggagccttccctccactgccctcgaacgcctcacttcctaagtctctgcatttctcagtccgactcggaccgatg

SEQ ID NO: 12356 - DNA, 203 bp, Homo sapiens
  source 1..203: mol_type = other DNA
ggcgcgccagtcctcctacgcacttggcgacacatccaacacgataacctcgtttcaggtagattgttatctatggcacataagaaagctactcagtatgagagacatgtgtgatgccccctttgatgacaggctccgaagagaccaaaaggcattaaagggaagaggcagcacacttggactcgattcgactcggaccgatg

SEQ ID NO: 12357 - DNA, 203 bp, Homo sapiens
  source 1..203: mol_type = other DNA
ggcgcgccagtcctcgtgtgcccttgtatcacttaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 12358 - DNA, 203 bp, Homo sapiens
  source 1..203: mol_type = other DNA
ggcgcgccagtccttacttcttcttgtgtcgaaataaaccacagcttgctccggctcattgccgttaaacatcattgttcttatttacaatcaaatcgctatcgccacaaggctagtgataataactaagggatacggtaagctggctccaacctaatctccataaacagtgtctaagacgaacctcacgactcggaccgatg

SEQ ID NO: 12359 - DNA, 203 bp, Homo sapiens
  source 1..203: mol_type = other DNA
ggcgcgccagtccttctgcattcttgtgtcgaaataaaccacagcttgctccggctcattgccgttaaacatcattgttcttatttacaatcaaatcgctatcgccacaaggctagtgataataactaagggggcgaagtcaagccctccaacctaatctttcagcgtgtcccttaagacgaacctcacgactcggaccgatg

SEQ ID NO: 12360 - DNA, 203 bp, Homo sapiens
  source 1..203: mol_type = other DNA
ggcgcgccagtcctcaaccaccctttatccgccctgtgaccgtgttggtcgctctgttaatgaaacaagccagactggttgggcattctacgtccgtgctaaacatggtgatttttctggtgttgcctctcaggagggtgttttgtcagaaagagagaagttgcttcatttaatctaaactaaacaaacgactcggaccgatg

SEQ ID NO: 12361 - DNA, 203 bp, Homo sapiens
  source 1..203: mol_type = other DNA
ggcgcgccagtcctgaagggaacttttaaaaaaggtctccccagtgctagctgccgaagcacccagataagagctgcgaacttaactgctcggcagccccagcttcgcgccccgcccagtccctttcccctgctggggatcccccctcttccccgcccaccccttacccgcatgcagcccagcgccctcgactcggaccgatg

SEQ ID NO: 12362 - DNA, 203 bp, Homo sapiens
  source 1..203: mol_type = other DNA
ggcgcgccagtccttcataaatcttttaaaaaaggtctccccagtgctagctgccgaagcacccagataagagctggacggaggctaaagcggcagccccagcttcgcgccccgcccagtccctttcccctgctggggatccccccgtagttggctgattcccttacccgcatgcagcccagcgccctcgactcggaccgatg

SEQ ID NO: 12363 - DNA, 203 bp, Homo sapiens
  source 1..203: mol_type = other DNA
ggcgcgccagtccttgtcaagccttttaaaaaaggtctccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctcgactcggaccgatg

SEQ ID NO: 12364 - DNA, 203 bp, Homo sapiens
  source 1..203: mol_type = other DNA
ggcgcgccagtcctatcgaggacttttaaaaaaggtctccccagtgctagctgccgaagcacccagataagagctggacggaggctaaagcggcagccccagcttcgcgccccgcccagtccctttcccctgctggggatcccccctcttccccgcccacgtgcgggaacggaccagcccagcgccctcgactcggaccgatg

SEQ ID NO: 12365 - DNA, 203 bp, Homo sapiens
  source 1..203: mol_type = other DNA
ggcgcgccagtcctactaacatcttttaaaaaaggtctccccagtgctagctgccgaagcacgactgctcccagccgacggaggctaaagcggcagccccagcttcgcgccccgcccagtccctttcccctgctggggatcccccctcttccccgcccaccccttacccgcatgcagcccagcgccctcgactcggaccgatg

SEQ ID NO: 12366 - DNA, 203 bp, Homo sapiens
  source 1..203: mol_type = other DNA
ggcgcgccagtccttgcgtcgtcttttattctgaccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 12367 - DNA, 203 bp, Homo sapiens
  source 1..203: mol_type = other DNA
ggcgcgccagtcctgagtgacgctttttcttttttctcagcaaactgtacaaaaccaaatctctttttgattttcaaggaaactaggttcctgccaaattttgaatctggacaataaacagacactttgtcctagcatctttctggaatcatttcgggatgcaaattcactttcacacagaaacaggacgactcggaccgatg

SEQ ID NO: 12368 - DNA, 203 bp, Homo sapiens
  source 1..203: mol_type = other DNA
ggcgcgccagtcctaggatgccctttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaacgactcggaccgatg

SEQ ID NO: 12369 - DNA, 203 bp, Homo sapiens
  source 1..203: mol_type = other DNA
ggcgcgccagtcctggagatcgctttttgctgatacttcatttctaatcttgtagaaaatttcagctgtagccctttattatcttctcacaataacagaagctgtgtacgatgcattagggtattgaagaaaattaacttttgaattaaatatttggaatataaggaaataaggaaagttgactgaaacgactcggaccgatg

SEQ ID NO: 12370 - DNA, 203 bp, Homo sapiens
  source 1..203: mol_type = other DNA
ggcgcgccagtcctcatgatcccttttttagcaaggcaatctgcaccaatgcaactttgtggtttttgtaatttctttattatttcaccttcggcttacgtttataaaagaggtatgcagttgtataagtcttatagtgaacaagttataccacccacttcagattatttaatctaaatctaaacattcgactcggaccgatg

SEQ ID NO: 12371 - DNA, 203 bp, Homo sapiens
  source 1..203: mol_type = other DNA
ggcgcgccagtcctgcgggatcgaaaagagggatccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 12372 - DNA, 203 bp, Homo sapiens
  source 1..203: mol_type = other DNA
ggcgcgccagtcctccgtccgcgaaaaggcttaggcagccagcctgtcgtaacgcgcaagtccgtggcggaaccgactactttgggtgtccgtgtttccttttattcttgaatggctgcttatggtgacaatcatagattgttatcataaagcgagttggattggccatccagtgtgaatcagattaacgactcggaccgatg

SEQ ID NO: 12373 - DNA, 203 bp, Homo sapiens
  source 1..203: mol_type = other DNA
ggcgcgccagtcctgtcaccaggaaaatgaagatattcctgcatcgttacaaatagtgtaagaaacagtaagcccggaagtggtgttttgcgatttcgaggccgggctcgatcctcacctttcattgtcgataggggacattttgacactacctggaaaatgtcgtctgtgctcaaagcatttgagcgcgactcggaccgatg

SEQ ID NO: 12374 - DNA, 203 bp, Homo sapiens
  source 1..203: mol_type = other DNA
ggcgcgccagtcctcgacggcagaaaatgaagatgggatgttggtagaacaaatagtgtaagaaacagtaagcccggaagtggtgttttgaccccatcttaagtggctcgatcctcacctttcattgtcgataggggacattttgacactacctggaaaatgtcgtctgtgctcaaagcatttgagcgcgactcggaccgatg

SEQ ID NO: 12375 - DNA, 203 bp, Homo sapiens
  source 1..203: mol_type = other DNA
ggcgcgccagtcctttcattaagaaaatgaagatgggatgttggtagaacaaatagtgtaagaaacagtaagcccggaagtggtgttttgcgatttcgaggccgggctcgatcctcacctttcattgtcgataggggacattttgacactacctggaaaatgtcgtctgtgctcaaagcatttgagcgcgactcggaccgatg

SEQ ID NO: 12376 - DNA, 203 bp, Homo sapiens
  source 1..203: mol_type = other DNA
ggcgcgccagtcctagtaaggtgaaaatgaagtggtgactcaaatcatcgaagaccctcgagattacataggtccggaacctatggccttcgtgaccgacctcgagtcagagtagttcaataaggacctatcaagtttgggcaatttttcgtccccgacaacgtcggtcgtcgtgtgcttaaagcatacgactcggaccgatg

SEQ ID NO: 12377 - DNA, 203 bp, Homo sapiens
  source 1..203: mol_type = other DNA
ggcgcgccagtcctgtaagacagaaaccacggctaaccacaatcaagtcatactactagtcactatacaataatcaacaattttagtcaactgattaccaagatgttatcataggtccgaactgatcaatctaacaaaaaaactaaacgttccacaataaatcaacgttcaggccaaaatattcagcccgactcggaccgatg

SEQ ID NO: 12378 - DNA, 203 bp, Homo sapiens
  source 1..203: mol_type = other DNA
ggcgcgccagtcctacacgaccgaaacgagattgtgaggtgcattggtctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 12379 - DNA, 203 bp, Homo sapiens
  source 1..203: mol_type = other DNA
ggcgcgccagtccttgagtgatgaaagatggcggcgtctgtggtttgagccttcagtagcaggccagagtctgaacaagagctggggtggagggggcggggacctggggagcccggcgggtcgctatcgcggggggtactagtggcgccgccgccacagacaccaacgctgtcgccacctctgtagcccgactcggaccgatg

SEQ ID NO: 12380 - DNA, 203 bp, Homo sapiens
  source 1..203: mol_type = other DNA
ggcgcgccagtcctaagaaattgaaaggaaccggaaacgggatggggagctggaccaggtgacagcggcatggacatatgccccaggctttcctgctggggtccatccatgagcctgccctgaaaacgtctcagccccagccctgccctggaagcttggctgagagcttcctggaggaggagcttcggcgactcggaccgatg

SEQ ID NO: 12381 - DNA, 203 bp, Homo sapiens
  source 1..203: mol_type = other DNA
ggcgcgccagtccttcccgttcgaaaggaaccggaaacgggatggggagctggaccaggtgatcagcagcgcacattatgccccaggctttcctgctggggtccatccatgagcctgcaggtgccctcatggagccccagccctgccctggaagcttggctgagagcttcctggaggaggagcttcggcgactcggaccgatg

SEQ ID NO: 12382 - DNA, 203 bp, Homo sapiens
  source 1..203: mol_type = other DNA
ggcgcgccagtcctcctaaagggaaaggaaccggaaacgggatggggattctccggccagaccagcggcatggacatatgccccaggctttcctgctggggtccatccatgagcctgcaggtgccctcatggagccccagccctgccctggaagcttggctgagagcttcctggaggaggagcttcggcgactcggaccgatg

SEQ ID NO: 12383 - DNA, 203 bp, Homo sapiens
  source 1..203: mol_type = other DNA
ggcgcgccagtcctagcccagagaaaggaaccggccggctacatcatcgctggaccaggtgacagcggcatggacatatgccccaggctttcctgctggggtccatccatgagcctgcaggtgccctcatggagccccagccctgccctggaagcttggctgagagcttcctggaggaggagcttcggcgactcggaccgatg

SEQ ID NO: 12384 - DNA, 203 bp, Homo sapiens
  source 1..203: mol_type = other DNA
ggcgcgccagtcctggagtagtgaaaggcccgccgggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagacgactcggaccgatg

SEQ ID NO: 12385 - DNA, 203 bp, Homo sapiens
  source 1..203: mol_type = other DNA
ggcgcgccagtccttcgttatagaaatccgcatagccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaacgactcggaccgatg

SEQ ID NO: 12386 - DNA, 203 bp, Homo sapiens
  source 1..203: mol_type = other DNA
ggcgcgccagtcctagtgctgcgaaatttcgtcaagtttgtaaactggttaggcaagtgttgtattttctgtgtctaagcactggtgattctgttcactagtgcatacattgatatttaagtggtgttccgtcactgcttattgtggaagcaacgttctgggacaaatactttaaataactgctaacccgactcggaccgatg

SEQ ID NO: 12387 - DNA, 203 bp, Homo sapiens
  source 1..203: mol_type = other DNA
ggcgcgccagtcctcttccactgaaatttcgtcaagtttgtaaactggttaggcaagtgttgtattttctgtgtctaagcactggtgattctgttcactagtgcatacattgatatttaagtggtgttccgttgtaaacagaacacgaagcaacgttctgtcgttgtggaaaccaataactgctaacccgactcggaccgatg

SEQ ID NO: 12388 - DNA, 203 bp, Homo sapiens
  source 1..203: mol_type = other DNA
ggcgcgccagtcctaggtattggaaatttcgtcaagtttgtaaactggttaggcaagtgttgtattttctgtgtctaagcactggtgattctgttcactagtgcatacattgatatttccccaaccactttgcactgcttattgtggaagcaacgttctgtcgttgtggaaaccaataactgctaacccgactcggaccgatg

SEQ ID NO: 12389 - DNA, 203 bp, Homo sapiens
  source 1..203: mol_type = other DNA
ggcgcgccagtcctctctctcggaaatttcgtcattcagccgtgagtcttaggcaagtgttgtattttctgtgtctaagcactggtgattctgttcactagtgcatacattgatatttaagtggtgttccgtcactgcttattgtggaagcaacgttctgtcgttgtggaaaccaataactgctaacccgactcggaccgatg

SEQ ID NO: 12390 - DNA, 203 bp, Homo sapiens
  source 1..203: mol_type = other DNA
ggcgcgccagtcctaatttcatgaacagaccaccgattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagcccgactcggaccgatg

SEQ ID NO: 12391 - DNA, 203 bp, Homo sapiens
  source 1..203: mol_type = other DNA
ggcgcgccagtcctaagtgctcgaacatatgggcgtctgagtgtgttgtgggggcaatataacaaaaaaacatgttatggtgccattaaaccgctgcatttcatcaaagtcaagttaattacctttacattttgatcctcttggatgtgaaaaaaactattaacatccctcaaaagactcaaggaaagcgactcggaccgatg

SEQ ID NO: 12392 - DNA, 203 bp, Homo sapiens
  source 1..203: mol_type = other DNA
ggcgcgccagtcctacaagaatgaaccacaagttgggtagcctggcagtgtcagaagtctgaacccagcatagtggtcagcaggcaggacgaatcacactgaatgcaaaccacagggtttcgcagcgtggtacgtagcgggtgcatgtcccccgccttcagaagagggtgcattttcaggaggaagcgcgactcggaccgatg

SEQ ID NO: 12393 - DNA, 203 bp, Homo sapiens
  source 1..203: mol_type = other DNA
ggcgcgccagtcctcggcgtgagaacgtgtgctgtcgcgcgagacagcggaaggagcaagagtgggaggcgcgcgcggaggccgcgacggacgcaagatggcgacggcgaccatagctctcgtcaatggccagcaaggaggggggtccgagccggcggcggcggcggcagtggtggcagcgggagacacgactcggaccgatg

SEQ ID NO: 12394 - DNA, 203 bp, Homo sapiens
  source 1..203: mol_type = other DNA
ggcgcgccagtcctggctcctggaagaagtcaaacgtggtgtagtctgagattctctgggatataagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 12395 - DNA, 203 bp, Homo sapiens
  source 1..203: mol_type = other DNA
ggcgcgccagtccttggtacgcgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttatggttacaaatccagagtcaaatggctcgactcggaccgatg

SEQ ID NO: 12396 - DNA, 203 bp, Homo sapiens
  source 1..203: mol_type = other DNA
ggcgcgccagtcctgttcaattgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaatttagaggtgcttacgactcggaccgatg

SEQ ID NO: 12397 - DNA, 203 bp, Homo sapiens
  source 1..203: mol_type = other DNA
ggcgcgccagtcctgatgaatcgaagacaaacaacgtctgtagcgaccctttgcaggcagcggaaccccccacctggcgacaggtgcctctgcggccaaaagccacgtgtataagatagggtcatccgttgagcacaaccccagtgccacgttgtgagttggatagttgtggaaagagtcaaatggctcgactcggaccgatg

SEQ ID NO: 12398 - DNA, 203 bp, Homo sapiens
  source 1..203: mol_type = other DNA
ggcgcgccagtcctcatcccacgaagacaaacaacgtctgtagcgacctacaatccaaccacgaaccccccacctggcgacaggtgcctctgcggccaaaagccacgtgtataagatacacctgcaaaggcggcacaaccccagtgccacgttgtgagttggatagttgtggaaagagtcaaatggctcgactcggaccgatg

SEQ ID NO: 12399 - DNA, 203 bp, Homo sapiens
  source 1..203: mol_type = other DNA
ggcgcgccagtcctgaggttcggaagccgcaaccggtttaagctatcgtaccattatgaaaacaattcttggttcttccgacatgtctacaggaaaagttttcatttccgtaaggcttgtcaaaatttagattgtaattgtttggggttttatgaatcttcagttgaagaatattaaactcagtgaaacgactcggaccgatg

SEQ ID NO: 12400 - DNA, 203 bp, Homo sapiens
  source 1..203: mol_type = other DNA
ggcgcgccagtcctgggctgatgaagcgccccagccccgcagcgatcgcagattcggctttcaaacaaaagaggcgaagtaatctacacaaccgggacctcacccggtcctcgcagagttgcggccgcccgccccttcagccccggctctccgtatgcgcatgagcagaggcgcctccctctgttcctcgactcggaccgatg

SEQ ID NO: 12401 - DNA, 203 bp, Homo sapiens
  source 1..203: mol_type = other DNA
ggcgcgccagtcctagaccctggaagcgccccagccccgcagcgatcgcagattcggctttcaaacaaaagaggcgccccggggggtgggaccgggacctcacccggtcctcgcagaggacttagtcaagagcccttcagccccggctctccgtatgcgcatgagcagaggcgcctccctctgttcctcgactcggaccgatg

SEQ ID NO: 12402 - DNA, 203 bp, Homo sapiens
  source 1..203: mol_type = other DNA
ggcgcgccagtcctcgtgacgagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatggcgggcccccaagcgactcggaccgatg

SEQ ID NO: 12403 - DNA, 203 bp, Homo sapiens
  source 1..203: mol_type = other DNA
ggcgcgccagtcctgcgaacccgaagctggcaacatgtcacacctggaggagcgacacggctattaatactattatttggcagtaatccagattgcttttgccaccaacctgaagacatatagaggcagaaggacaggaataattctatttgtttcctgttttgaaacttccatctgtaagtattgttcgactcggaccgatg

SEQ ID NO: 12404 - DNA, 203 bp, Homo sapiens
  source 1..203: mol_type = other DNA
ggcgcgccagtcctcgagcccggaagcttctgcgaaacgtggacagtcccgactttcctccggactcctgcacgacctgctcctacagccggcgatccactcccggctgttcccccggagggtccagaggcctttcagaaggagaaggcagctctgtttctctgcagaggagtagggtcctttcagcccgactcggaccgatg

SEQ ID NO: 12405 - DNA, 203 bp, Homo sapiens
  source 1..203: mol_type = other DNA
ggcgcgccagtcctgcttgagggaagcttctgcgctggtgcttagtaaccgactttcctccggactcctgcacgacctgctcctacagccggcgatccactcccggctgttcccccggagggtccagaggcctttcagaaggagaaacggtggtgtcccttctgcagaggagtagggtcctttcagcccgactcggaccgatg

SEQ ID NO: 12406 - DNA, 203 bp, Homo sapiens
  source 1..203: mol_type = other DNA
ggcgcgccagtccttccacgtggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagcccgactcggaccgatg

SEQ ID NO: 12407 - DNA, 203 bp, Homo sapiens
  source 1..203: mol_type = other DNA
ggcgcgccagtcctgttcgcgagaagcttctgcgctggtgcttagtaaccgactttcctccggactcctgcacgacctgctcctacagccggcgatccactcccggctgttcccccggttatcgtctttaagtttcagaaggagaaggcagctctgtttctctgcagaggagtagggtcctttcagcccgactcggaccgatg

SEQ ID NO: 12408 - DNA, 203 bp, Homo sapiens
  source 1..203: mol_type = other DNA
ggcgcgccagtcctgcctaagcgaagcttctgcgctggtgcttagtaaccgactttcctccggactcctgcacgactgctggggctctgtggcgatccactcccggctgttcccccggagggtccagaggcctttcagaaggagaaggcagctctgtttctctgcagaggagtagggtcctttcagcccgactcggaccgatg

SEQ ID NO: 12409 - DNA, 203 bp, Homo sapiens
  source 1..203: mol_type = other DNA
ggcgcgccagtccttcaactgggaaggaggaggcacccacaggctgctgggaggagagcataaggaatctacttgaaaatggatcggtttatgttggattaaatgctgctctttgtggaggtcgtcacgtttgtctttttcgacgcatcttgaatgtgacaaaggctcgcatagctgctggcttaccacgactcggaccgatg

SEQ ID NO: 12410 - DNA, 203 bp, Homo sapiens
  source 1..203: mol_type = other DNA
ggcgcgccagtcctaaccgtaagaaggaggaggcacccacaggctgctgggaggagagcataaggaatctacttgaaaatggatcggtttatgttggattaaatgctgctctttgtggcctcatagcaaacagtctttttcgacgcatcttgaatgtgaccccaagaatacgtactgctggcttaccacgactcggaccgatg

SEQ ID NO: 12411 - DNA, 203 bp, Homo sapiens
  source 1..203: mol_type = other DNA
ggcgcgccagtcctacgaagaagaaggaggaggccatgcgccaaatgagggaggagagcataaggaatctacttgaaaatggatcggtttatgttggattaaatgctgctctttgtggcctcatagcaaacagtctttttcgacgcatcttgaatgtgacaaaggctcgcatagctgctggcttaccacgactcggaccgatg

SEQ ID NO: 12412 - DNA, 203 bp, Homo sapiens
  source 1..203: mol_type = other DNA
ggcgcgccagtcctggcccgctgaatactgtaccttgatcttagggccaatcggtgctgccgaggtaactctctggtcctaggtggaggtgtaggggaggttgggccagggatgccttcactgtgtctctctggtcttgccaccccagaccgagggacacacaggcactgctgtctgcaacacaagcacgactcggaccgatg

SEQ ID NO: 12413 - DNA, 203 bp, Homo sapiens
  source 1..203: mol_type = other DNA
ggcgcgccagtcctggtagattgaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgttccggcgtgcgtaccgactcggaccgatg

SEQ ID NO: 12414 - DNA, 203 bp, Homo sapiens
  source 1..203: mol_type = other DNA
ggcgcgccagtccttccaaggcgaatactgtaccttgatcttagggcctggaaaaatcaggtaggtaactctctggtcctaggtggaggtgtaggggaggttgggccagggatgccttcactgtgtctctctggtcttgccaccccgccttatctctgggacaggcactgctgtctgcaacacaagcacgactcggaccgatg

SEQ ID NO: 12415 - DNA, 203 bp, Homo sapiens
  source 1..203: mol_type = other DNA
ggcgcgccagtcctcgtggaaggaatggctgcttatggtgacaatcatagattgttatcataaagcgagttggattggccatccagtgtgaatcagattaattactcccttgtttgttggatccactcccgaaacgttttactcctatcgggcagctccctgtttgaagacaggatttcagtgtcacacgactcggaccgatg

SEQ ID NO: 12416 - DNA, 203 bp, Homo sapiens
  source 1..203: mol_type = other DNA
ggcgcgccagtcctctcagctggaatggctgcttatggtgacaatcatagattgttatcataaagcgagttggattggccatccagtgtgaatcagattaattactcccttgtttgttggatccactcccgaaacgttttactccttaacttattgaaattgtttgaagacaggcgcggctgtgagatcgactcggaccgatg

SEQ ID NO: 12417 - DNA, 203 bp, Homo sapiens
  source 1..203: mol_type = other DNA
ggcgcgccagtcctttcacatagaatggctgcttatggtgacaatcatagattgttatcataaagcgagttggattggccatccagtgtgccgggcgggccagcctcccttgtttgttggatccactcccgaaacgttttactccttaacttattgaaattgtttgaagacaggatttcagtgtcacacgactcggaccgatg

SEQ ID NO: 12418 - DNA, 203 bp, Homo sapiens
  source 1..203: mol_type = other DNA
ggcgcgccagtcctattcgtaggaatggctgcttatggtgacaatcatagattgttatcataaagcgagttggattggccatccagtgtgcgattctgagcgccctcccttgtttgttggatccactcccgaaacgttttactccttaacttattgaaattgtttgaagacaggatttcagtgtcacacgactcggaccgatg

SEQ ID NO: 12419 - DNA, 203 bp, Homo sapiens
  source 1..203: mol_type = other DNA
ggcgcgccagtcctgtagcaaagaatggctgcttatggtgacaatcatagattgttatcataaagcgagttggatttagggcttttctgaaatcagattaattactcccttgtttgttggatccactcccgaaacgttttactccttaacttattgaaattgtttgaagacaggatttcagtgtcacacgactcggaccgatg

SEQ ID NO: 12420 - DNA, 203 bp, Homo sapiens
  source 1..203: mol_type = other DNA
ggcgcgccagtcctccgcaggtgaatttctgattgaggcgctaacagctaattccacaggagttgtaaggcagcctgtgcataaactgagacagaagtttctcctcagagactctctttttattattattattattattattggcacttggcagactgattcctcagaggaataccttgttgcttaagcgactcggaccgatg

SEQ ID NO: 12421 - DNA, 203 bp, Homo sapiens
  source 1..203: mol_type = other DNA
ggcgcgccagtcctatttatgtgacaccaccagcatacacgaaaccaaccttcacagtggatacctcagcatccaaaactctccttcccgaatggatcaggatgccttcttttttgagagggatcctgaagccgaaggagaggcaccacgaaaacaagaaggttaactgttatgcatcggactccttgcgactcggaccgatg

SEQ ID NO: 12422 - DNA, 203 bp, Homo sapiens
  source 1..203: mol_type = other DNA
ggcgcgccagtccttggttcaagacaccaccagcatacacgaaaccaaccttcacagtggatacctcagcatccaaaactctccttcccgaatggatcaggatgccttcttttttgagagggatcctgaagccgaaggagaggcaccacgaaaacaagaatcactctcagatgtatctttcagaagctcgactcggaccgatg

SEQ ID NO: 12423 - DNA, 203 bp, Homo sapiens
  source 1..203: mol_type = other DNA
ggcgcgccagtcctcataacgcgacaccaccagcatacacgaaaccaaccttcacagtggatacctcagcatccaaaactctccttcccgaatggatcaggatgttgcggcgggatgaagggatcctgaagccgaaggagaggcaccacgaaaacaagaatcactctcagatgtcatcggactccttgcgactcggaccgatg

SEQ ID NO: 12424 - DNA, 203 bp, Homo sapiens
  source 1..203: mol_type = other DNA
ggcgcgccagtcctaccttacggacaccaccagcatacacgaaaccaaccttcacagtggatacctcagcatccaaaactctccttcccggcacttaggtatgcccttcttttttgagagggatcctgaagccgaaggagaggcaccacgaaaacaagaatcactctcagatgtcatcggactccttgcgactcggaccgatg

SEQ ID NO: 12425 - DNA, 203 bp, Homo sapiens
  source 1..203: mol_type = other DNA
ggcgcgccagtcctgcgaggaggacaccaccagcatacacgaaaccaaccttcacagtggatacctcagcatccaatcgaagagcgggtcaatggatcaggatgccttcttttttgagagggatcctgaagccgaaggagaggcaccacgaaaacaagaatcactctcagatgtcatcggactccttgcgactcggaccgatg

SEQ ID NO: 12426 - DNA, 203 bp, Homo sapiens
  source 1..203: mol_type = other DNA
ggcgcgccagtcctgtcgcagcgacaccaccagcatacacgaaaccaaccttcacagtggatcaaatcctcatggcaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 12427 - DNA, 203 bp, Homo sapiens
  source 1..203: mol_type = other DNA
ggcgcgccagtcctgcacaggagacaccaccagcatacacgaaaccaatgacatgttgtttcacctcagcatccaaaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 12428 - DNA, 203 bp, Homo sapiens
  source 1..203: mol_type = other DNA
ggcgcgccagtcctctacgattgacaccaccagcggctgttcctgtccccttcacagtggatacctcagcatccaaaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 12429 - DNA, 203 bp, Homo sapiens
  source 1..203: mol_type = other DNA
ggcgcgccagtcctgggtccgagacactgtcccatgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagccgactcggaccgatg

SEQ ID NO: 12430 - DNA, 203 bp, Homo sapiens
  source 1..203: mol_type = other DNA
ggcgcgccagtcctgtccgtcggacataatggattccaacacgataacctcgtttcaggtagattgttatctatggcacataagaaagctactcagtatgagagacatgtgtgatgccaggagatcaactcagctccgaagagaccaaaaggcattaaagggaagaggcagcacacttggactcgattcgactcggaccgatg

SEQ ID NO: 12431 - DNA, 203 bp, Homo sapiens
  source 1..203: mol_type = other DNA
ggcgcgccagtcctttactgtcgacataatggattccaacacgataacctcgtttcaggtagattgttatctatggcacataagaaagctactcagtatgagagacatgtgtgatgccccctttgatgacaggctccgaagagaccaaaaggcattaaagattcagttagctcaacttggactcgattcgactcggaccgatg

SEQ ID NO: 12432 - DNA, 203 bp, Homo sapiens
  source 1..203: mol_type = other DNA
ggcgcgccagtcctggttgaccgacatggtgcgaagagtctattgagctagttggtagtcctccggcccctgaatgcggctaatcctaacatgcataggatatgcctcaagccagagggcagtgtgtcgtaacgggcaactctgcagcggaaccgactactttgggtgtccgtgtttcattttattcccgactcggaccgatg

SEQ ID NO: 12433 - DNA, 203 bp, Homo sapiens
  source 1..203: mol_type = other DNA
ggcgcgccagtccttctagttggacatggtgcgaagagtctattgagctagttggtagtcctccggcccctgaatgcggctaatcctaactgcggagcacacaccctcaagccagagggcagtgtgtcgtaacgggcaactctgcaatcctgagcgtctgtttgggtgtccgtgtttcattttattcccgactcggaccgatg

SEQ ID NO: 12434 - DNA, 203 bp, Homo sapiens
  source 1..203: mol_type = other DNA
ggcgcgccagtcctggaaagtggacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcccgactcggaccgatg

SEQ ID NO: 12435 - DNA, 203 bp, Homo sapiens
  source 1..203: mol_type = other DNA
ggcgcgccagtcctcaatcattgacatggtgcgaagagtctattgagctagttggtagtcctggattgaagatcgtcggctaatcctaactgcggagcacacaccctcaagccagagggcagtgtgtcgtaacgggcaactctgcagcggaaccgactactttgggtgtccgtgtttcattttattcccgactcggaccgatg

SEQ ID NO: 12436 - DNA, 203 bp, Homo sapiens
  source 1..203: mol_type = other DNA
ggcgcgccagtcctccacaccagacatggtgcgatcctctgtaacttgtagttggtagtcctccggcccctgaatgcggctaatcctaactgcggagcacacaccctcaagccagagggcagtgtgtcgtaacgggcaactctgcagcggaaccgactactttgggtgtccgtgtttcattttattcccgactcggaccgatg

SEQ ID NO: 12437 - DNA, 203 bp, Homo sapiens
  source 1..203: mol_type = other DNA
ggcgcgccagtcctgggcgatagaccacgctggggtttgccatggtgacataaaggggtgtagaggaaggaaggagcaagaccagcctgtagactgtgcccctgaaaacttgggcaaaccaggggcccggagccttccctccactgccctcgaacgcctcacttcctaagtctctgcatttctcagtccgactcggaccgatg

SEQ ID NO: 12438 - DNA, 203 bp, Homo sapiens
  source 1..203: mol_type = other DNA
ggcgcgccagtcctctttattggaccacgctggggtttgccatggtgacataaaggggtgtagaggaaggaaggagcaagaccagcctgtagactgtgcccctggctgggcaaaagggaacactattgtcgcccttccctccactgccctcgaacgcctcacttcctaagtctctgcatttctcagtccgactcggaccgatg

SEQ ID NO: 12439 - DNA, 203 bp, Homo sapiens
  source 1..203: mol_type = other DNA
ggcgcgccagtcctgggaagctgaccacgctggggtttgccatggtgacataaaggggtgtagaggaaggaaggagcaagaccagcctgtagactgtgcccctggctgggcaaaagggccaggggcccggagaacaggtaatctccccctcgaacgcctcacttcctaagtctctgcatttctcagtccgactcggaccgatg

SEQ ID NO: 12440 - DNA, 203 bp, Homo sapiens
  source 1..203: mol_type = other DNA
ggcgcgccagtcctgatcttatgaccacgctggggtttgccatggtgacataaaggggtgtagaggaaggaaggagcaagaccagcctgtagactgtgcccctggctgggcaaaagggccaggggcccggagccttccctccactgccctcgaacgcctcacttcctaagtctctgcatttctcagtccgactcggaccgatg

SEQ ID NO: 12441 - DNA, 203 bp, Homo sapiens
  source 1..203: mol_type = other DNA
ggcgcgccagtcctgactaatagaccacgctggggtttgccatggtgacataaaggggtgtagaggaaggaaggagcaagaccagcctgtccgtgtaaagatctgctgggcaaaagggccaggggcccggagccttccctccactgccctcgaacgcctcacttcctaagtctctgcatttctcagtccgactcggaccgatg

SEQ ID NO: 12442 - DNA, 203 bp, Homo sapiens
  source 1..203: mol_type = other DNA
ggcgcgccagtccttttcgtccgaccacgctggggtttgccatggtgacataaaggggtgtagaggaaggaaggagtcgatggcaaagacagactgtgcccctggctgggcaaaagggccaggggcccggagccttccctccactgccctcgaacgcctcacttcctaagtctctgcatttctcagtccgactcggaccgatg

SEQ ID NO: 12443 - DNA, 203 bp, Homo sapiens
  source 1..203: mol_type = other DNA
ggcgcgccagtcctatcctaaggaccacgctggggtttgccatggtgatggtctcccagcctgaggaaggaaggagcaagaccagcctgtagactgtgcccctggctgggcaaaagggccaggggcccggagccttccctccactgccctcgaacgcctcacttcctaagtctctgcatttctcagtccgactcggaccgatg

SEQ ID NO: 12444 - DNA, 203 bp, Homo sapiens
  source 1..203: mol_type = other DNA
ggcgcgccagtccttgtgtggggaccggtcactaccaaggacgcagacctctttttgagtatcacgcctccggaagtagttgggcaagcccacctatatgtgttccatgatgcacttctagccatccataccgtactgcctgatagggtccttgcgaggggatctgggagtctcgtagaccgtagcaccgactcggaccgatg

SEQ ID NO: 12445 - DNA, 203 bp, Homo sapiens
  source 1..203: mol_type = other DNA
ggcgcgccagtcctagttggtagaccggtcactaccaaggacgcagacctctttttgagtatcacgcctccggaagtagttgggcaagcccacctatatgtgttgggatggttggggtcgcaaccagtaggtgtactgcctgatagggtccttgcgaggggatctgggagtctcgtagaccgtagcaccgactcggaccgatg

SEQ ID NO: 12446 - DNA, 203 bp, Homo sapiens
  source 1..203: mol_type = other DNA
ggcgcgccagtcctagaggagagaccggtcactaccaaggacgcagacctctttttgagtatcacgcctccggaagtagttgggcaagcccacctatatgtgttgggatggttggggttagccatccatacccgtgccaggctcgcggtccttgcgaggggatctgggagtctcgtagaccgtagcaccgactcggaccgatg

SEQ ID NO: 12447 - DNA, 203 bp, Homo sapiens
  source 1..203: mol_type = other DNA
ggcgcgccagtcctgtgtcgtcgaccggtcactaccaaggacgcagacctctttttgagtatcacgcctccggaagtagttgggcaagcccacctatatgtgttgggatggttggggttagccatccataccgtactgcctgatagatatgcctattattgatctgggagtctcgtagaccgtagcaccgactcggaccgatg

SEQ ID NO: 12448 - DNA, 203 bp, Homo sapiens
  source 1..203: mol_type = other DNA
ggcgcgccagtcctgacctgaagaccggtcactaccaaggacgcagacctctttttgagtatggatatcatatttatagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12449 - DNA, 203 bp, Homo sapiens
  source 1..203: mol_type = other DNA
ggcgcgccagtcctagcacttggaccggtcactaccaaggacgcagactgggaggcctactgcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12450 - DNA, 203 bp, Homo sapiens
  source 1..203: mol_type = other DNA
ggcgcgccagtcctgcgcaagggaccggtcactatatgccggatgcggctctttttgagtatcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12451 - DNA, 203 bp, Homo sapiens
  source 1..203: mol_type = other DNA
ggcgcgccagtcctcaacgaaggaccggtcactatgtcatctatgtcactctttttgagtatcacgcctccggaagtagttgggcaagcccacctatatgtgttgggatggttggggttagccatccataccgtactgcctgatagggtccttgcgaggggatctgggagtctcgtagaccgtagcaccgactcggaccgatg

SEQ ID NO: 12452 - DNA, 203 bp, Homo sapiens
  source 1..203: mol_type = other DNA
ggcgcgccagtccttaggatcagaccggtcggaacgagctgattgcccgctacatcaagctcaaatgcactggactccgcaccaggaagcaggtctccagccacatccaggtgctggctcgtcgcaaagctcgcgagatccaggccaagctaaaggaccaggcagctaaggacaaggccctgcagagccgactcggaccgatg

SEQ ID NO: 12453 - DNA, 203 bp, Homo sapiens
  source 1..203: mol_type = other DNA
ggcgcgccagtcctattacggagaccggtcggaacgagctgattgcccgctacatcaagctccggacagggaagacccgcaccaggaagcaggtctccagccacatccaggtgctggcctccacgtgtcgatgcgagatccaggccaagctaaaggaccaggcagctaaggacaaggccctgcagagccgactcggaccgatg

SEQ ID NO: 12454 - DNA, 203 bp, Homo sapiens
  source 1..203: mol_type = other DNA
ggcgcgccagtcctgtttgtctgaccggtcggaacgagctgattgcccgctacatcaagctccggacagggaagacccgcaccaggaagcgcaagatacaaacgatccaggtgctggctcgtcgcaaagctcgcgagatccaggccaagctaaaggaccaggcagctaaggacaaggccctgcagagccgactcggaccgatg

SEQ ID NO: 12455 - DNA, 203 bp, Homo sapiens
  source 1..203: mol_type = other DNA
ggcgcgccagtcctcctcaaacgacctgagtaaatttaattgcaaacagtggcttgagcgatttgtgcaattaaaggatagtgatattaatgaaatggtgcttagtcttgttaggagtggtaagttgcttgtaaggggtaatggcaagtgtttgagttttagtaatcatttagtctcaactaaataaacgactcggaccgatg

SEQ ID NO: 12456 - DNA, 203 bp, Homo sapiens
  source 1..203: mol_type = other DNA
ggcgcgccagtcctttatttatgacgcgaggctctgcggagaccaggagtcagactgtaggaaagttaaaaccatgacgtgtccccggtactcgccggccggagcccccggcttcccggggccgggggaccttagcggcacccacacacagcctactttccaagcggagccatgtctggtaacggcaacgactcggaccgatg

SEQ ID NO: 12457 - DNA, 203 bp, Homo sapiens
  source 1..203: mol_type = other DNA
ggcgcgccagtcctgtagaactgacgcgaggctctgcggagaccaggagtcagactgtaggacgacctcgggtcccacgtgtccccggtactcgccggccggagaggaacctgggagagggccgggggaccttagcggcacccacacacagcctactttccaagcggagccatgtctggtaacggcaacgactcggaccgatg

SEQ ID NO: 12458 - DNA, 203 bp, Homo sapiens
  source 1..203: mol_type = other DNA
ggcgcgccagtcctctaatgatgacgcgaggctctgcggagaccaggagtcagactgtaggacgacctcgggtcccacgtgtccccggtactcgccggccggagcccccggcttcccgactatcatctggtatagcggcacccacacacagcctactttccaagcggagccatgtctggtaacggcaacgactcggaccgatg

SEQ ID NO: 12459 - DNA, 203 bp, Homo sapiens
  source 1..203: mol_type = other DNA
ggcgcgccagtcctacgcgcctgacgggacccgacggtgactgcgcaagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggcgactcggaccgatg

SEQ ID NO: 12460 - DNA, 203 bp, Homo sapiens
  source 1..203: mol_type = other DNA
ggcgcgccagtcctgaacctgggacgttagcgacaataaaattctgtacataaaagtcgaaagtattgctatagttaaggttgcgcttgcctatttaggcatacttctcaggatggcgcgttgcagtccaacaagatccagggactgtacagaattttcctatacctcgagtcgggtttggaatctaacgactcggaccgatg

SEQ ID NO: 12461 - DNA, 203 bp, Homo sapiens
  source 1..203: mol_type = other DNA
ggcgcgccagtccttgaaaccagactccggctcggcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaacgactcggaccgatg

SEQ ID NO: 12462 - DNA, 203 bp, Homo sapiens
  source 1..203: mol_type = other DNA
ggcgcgccagtcctgcagcctggactcctatcgcggacccccaccgctgcccttcccggggaggcgggaaatgcatggggccacccagctccgcggcggcctacagccggggtagcccaagaaccttcgggtgagggcgggtggcattttcttttcctataccgatcatggcagtccttctgctcctacgactcggaccgatg

SEQ ID NO: 12463 - DNA, 203 bp, Homo sapiens
  source 1..203: mol_type = other DNA
ggcgcgccagtccttgttatgggactgattcatcactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtccgactcggaccgatg

SEQ ID NO: 12464 - DNA, 203 bp, Homo sapiens
  source 1..203: mol_type = other DNA
ggcgcgccagtcctgcccgtgagacttattaggcggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 12465 - DNA, 203 bp, Homo sapiens
  source 1..203: mol_type = other DNA
ggcgcgccagtccttcctggctgacttgtcagcaccgtcaggtgacactatcctaaaggcagaagccttcaggtctgacccagccaatcaaagcattataccagaccatggaatgcataccaaacattattgacactaatgacacacaaaattggttttaagaaaaaccaagagaacaataggccagacgactcggaccgatg

SEQ ID NO: 12466 - DNA, 203 bp, Homo sapiens
  source 1..203: mol_type = other DNA
ggcgcgccagtccttgccgaccgactttgaaatccaacccggtcacctacccgcgcgactgtcaaacgttggacgccgaaagccaagcgagtccccctgccgagctactcgcgtccgcctcctcccaagctgagctctgctccgcccacctgagtccttcgccagttaggaggaaacacagccgcttacgactcggaccgatg

SEQ ID NO: 12467 - DNA, 203 bp, Homo sapiens
  source 1..203: mol_type = other DNA
ggcgcgccagtccttttagacggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttacgactcggaccgatg

SEQ ID NO: 12468 - DNA, 203 bp, Homo sapiens
  source 1..203: mol_type = other DNA
ggcgcgccagtcctaaacatacgactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggatcgtagaaataacgcgactcggaccgatg

SEQ ID NO: 12469 - DNA, 203 bp, Homo sapiens
  source 1..203: mol_type = other DNA
ggcgcgccagtccttttatcatgactttgaaatccaacccggtcacctacccgcgcgactgtgtccacggatggcacgaaagccaagcgagtccccctgccgagctactcgcgtccgcctcctcccaagctggagaagtagatttgcacctgagtccttcgccagttaggaggaaacacagccgcttacgactcggaccgatg

SEQ ID NO: 12470 - DNA, 203 bp, Homo sapiens
  source 1..203: mol_type = other DNA
ggcgcgccagtcctgacaaaccgactttgaaatccaacccggtcacctacccgcgcgactgtgtccacggatggcacgaaagccaagcgagtccccctgccgagctactcgcgtccgctgaggtggccatccagctctgctccgcccacctgagtccttcgccagttaggaggaaacacagccgcttacgactcggaccgatg

SEQ ID NO: 12471 - DNA, 203 bp, Homo sapiens
  source 1..203: mol_type = other DNA
ggcgcgccagtcctgcaaggttgacttttacatgcgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgtcgactcggaccgatg

SEQ ID NO: 12472 - DNA, 203 bp, Homo sapiens
  source 1..203: mol_type = other DNA
ggcgcgccagtccttctaacgagagaaactccgtaggagtcatagcttaagcagatgaattagaaagaatcaggttacggcccggcggaaagaaaaagtacaggctaaaacatattgtgtgggcagcgaataaattggacagattcggattagcagagagcctgttggagtcaaaagagggttgtcaacgactcggaccgatg

SEQ ID NO: 12473 - DNA, 203 bp, Homo sapiens
  source 1..203: mol_type = other DNA
ggcgcgccagtcctgtttccaagagaaactccgtcttgagagggaaaaaagcagatgaattagaaagaatcaggttacggcccggcggaaagaaaaagtacagggccgcgttcgagtggtgggcagcgaataaattggacagattcggattagcagagagcctgttggagtcaaaagagggttgtcaacgactcggaccgatg

SEQ ID NO: 12474 - DNA, 203 bp, Homo sapiens
  source 1..203: mol_type = other DNA
ggcgcgccagtccttactaccagagaaactccgtcttgagagggaaaactttcatcacgcacgaaagaatcaggttacggcccggcggaaagaaaaagtacaggctaaaacatattgtgtgggcagcgaataaattggacagattcggattagcagagagcctgttggagtcaaaagagggttgtcaacgactcggaccgatg

SEQ ID NO: 12475 - DNA, 203 bp, Homo sapiens
  source 1..203: mol_type = other DNA
ggcgcgccagtcctccatgtttgagaatcagatgcgcataagtagatgcgaattgcaaaaagattacgtaggtccggaaccactagattcggtgccggtaacgattccagttttatactatctgatcattctctatctctattaaggatatttctagtctaaagttcaaaatgtcaagtgttttaaagcgactcggaccgatg

SEQ ID NO: 12476 - DNA, 203 bp, Homo sapiens
  source 1..203: mol_type = other DNA
ggcgcgccagtcctaagtctgagagaatcagatggcatcgttatatgacgaattgcaaaaagattacgtaggtccgagctattctcgcatggtgccggtaacgattccagttttatactatctgatcattctctatctctattaaggatatttctagtctaaagttcaaaatgtcaagtgttttaaagcgactcggaccgatg

SEQ ID NO: 12477 - DNA, 203 bp, Homo sapiens
  source 1..203: mol_type = other DNA
ggcgcgccagtcctgaccactcgagaatcagatggcatcgttatatgatctgccttgccgctattacgtaggtccggaaccactagattcggtgccggtaacgattccagttttatactatctgatcattctctatctctattaaggatatttctagtctaaagttcaaaatgtcaagtgttttaaagcgactcggaccgatg

SEQ ID NO: 12478 - DNA, 203 bp, Homo sapiens
  source 1..203: mol_type = other DNA
ggcgcgccagtcctgtcattctgagacccctttgtcatatcaatacaatatcaagtagtgtcgatgatctcattaggtactaatcctaacattgtgattcatcctgcattgagaaaagatttagaaaaaaactaaattaagaatgaatatcctggggtcgtaacgtctcgtgaccctgccgttgcactcgactcggaccgatg

SEQ ID NO: 12479 - DNA, 203 bp, Homo sapiens
  source 1..203: mol_type = other DNA
ggcgcgccagtcctctctgatcgagacctggaatttccggtctggttggtctggggccccgcggagccaggttgataccctcacctcccaaccccaggccctcggatgcccagaacctcgttcgtaagttccggacttgttcttaatcgagggggtgctggggggaccctgatgtggcaccaaatgaacgactcggaccgatg

SEQ ID NO: 12480 - DNA, 203 bp, Homo sapiens
  source 1..203: mol_type = other DNA
ggcgcgccagtccttcttcacggagacctggaatttccggtctggttggtctggggccccgcggagccaggttgataccctcacctcccaaccccaggccctcggatgcccagaacctgtaggccgcaccgtggacttgttcttaactagacctcacgacgggggaccctgatgtggcaccaaatgaacgactcggaccgatg

SEQ ID NO: 12481 - DNA, 203 bp, Homo sapiens
  source 1..203: mol_type = other DNA
ggcgcgccagtccttgcaggacgagacctggaatttccggtctggttggtctggggccccgcggagccaggttgataccctcacctcccaaccccaggccctcggatgcccagaacctgtaggccgcaccgtggacttgttcttaatcgagggggtgctgcactacgtagcgcatggcaccaaatgaacgactcggaccgatg

SEQ ID NO: 12482 - DNA, 203 bp, Homo sapiens
  source 1..203: mol_type = other DNA
ggcgcgccagtcctatccttccgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaacgactcggaccgatg

SEQ ID NO: 12483 - DNA, 203 bp, Homo sapiens
  source 1..203: mol_type = other DNA
ggcgcgccagtcctggatgggagagacctggaatttccggtctggttggtctggggccccgcggagccaggttgataccctcacctcccattgttttaaatctagatgcccagaacctgtaggccgcaccgtggacttgttcttaatcgagggggtgctggggggaccctgatgtggcaccaaatgaacgactcggaccgatg

SEQ ID NO: 12484 - DNA, 203 bp, Homo sapiens
  source 1..203: mol_type = other DNA
ggcgcgccagtcctaccaactggagagccaggagactctgatgatgaattctgaccagaaggcagtgaaattcctggcaaatttttacatcaatggaggcaaacactggacccatggtcacctgaggcagacacaaccagagcccacccagcccaaggcaaggcccagtcgtcggggcccggagccggcgactcggaccgatg

SEQ ID NO: 12485 - DNA, 203 bp, Homo sapiens
  source 1..203: mol_type = other DNA
ggcgcgccagtcctacgctttcgagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggcgactcggaccgatg

SEQ ID NO: 12486 - DNA, 203 bp, Homo sapiens
  source 1..203: mol_type = other DNA
ggcgcgccagtcctacaagcgcgagatacactacaggcagtgagcgagcaggcggcaggcagggtccgtgcggagcaggcgagcgagcgggaagacgcagccaccttcctcaccagccagcccacagcggtttgttccccttctcgggagtgcgccaatgcctgggccgacccaaaccctgtccccaacgactcggaccgatg

SEQ ID NO: 12487 - DNA, 203 bp, Homo sapiens
  source 1..203: mol_type = other DNA
ggcgcgccagtcctttaccacagagcagattcccacaactcccttggtacaataaaaaagacgagtatttacttttcattgaaagaatggagcttgcttgatatttcactagataaagaatttaaggcgagtatctatctttgttctccttggcaactgagagtctgcccttggaaacatcaggcacccgactcggaccgatg

SEQ ID NO: 12488 - DNA, 203 bp, Homo sapiens
  source 1..203: mol_type = other DNA
ggcgcgccagtccttagccgccgagcccgttacccacctgggcaaacgacgcccacgtacggtccacgtcgcccttcaatgtctctcttgaccaataggcgtagccggcgagttgacaaggaccagtgggggaactcttaaaatgaagggactccaagtcccgcccttcccggtgggccgggaaatgccgactcggaccgatg

SEQ ID NO: 12489 - DNA, 203 bp, Homo sapiens
  source 1..203: mol_type = other DNA
ggcgcgccagtcctcctggacagagcccgttacccacctgggcaaacgacgcccacgtacggtccacgtcgcccttcaatgtctctcttgaccaataggcgtagccggcgagttgacaaggaccagtgggggccgggggcttggagagggactccaagtctttatgggatgacggggccgggaaatgccgactcggaccgatg

SEQ ID NO: 12490 - DNA, 203 bp, Homo sapiens
  source 1..203: mol_type = other DNA
ggcgcgccagtcctaactgattgagcccgttacccacctgggcaaacgacgcccacgtacggtccacgtcgcccttcaatgtctctcttgaccaataggcgtagccggcgagttgacaccctgaccgaaaccccgggggcttggagagggactccaagtcccgcccttcccggtgggccgggaaatgccgactcggaccgatg

SEQ ID NO: 12491 - DNA, 203 bp, Homo sapiens
  source 1..203: mol_type = other DNA
ggcgcgccagtcctcaggtacagagcccgttacccacctgggcaaacgctttaggttatgcatccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 12492 - DNA, 203 bp, Homo sapiens
  source 1..203: mol_type = other DNA
ggcgcgccagtcctccattagcgagcccgttaccgtagctcttgtctcacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 12493 - DNA, 203 bp, Homo sapiens
  source 1..203: mol_type = other DNA
ggcgcgccagtcctggcacacggagccctgcacccctaattcccggtggaaaactcctgttgatccgcatggtgtacggcctggagtctcccagtcttgtcccggcagtgccgccctccccactaagacctaggcgcaaaggcttggctcatggttgacagctcagagagagaaagatctgagggaagcgactcggaccgatg

SEQ ID NO: 12494 - DNA, 203 bp, Homo sapiens
  source 1..203: mol_type = other DNA
ggcgcgccagtcctaacgcggcgagccctgcacccctaattcccggtggaaaactcctgttgccgtttccctccaccggcctggagtctcagcacaagacaagtgcagtgccgccctccccactaagacctaggcgcaaaggcttggctcatggttgacagctcagagagagaaagatctgagggaagcgactcggaccgatg

SEQ ID NO: 12495 - DNA, 203 bp, Homo sapiens
  source 1..203: mol_type = other DNA
ggcgcgccagtcctgatccagagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaacctgggtcattgttcgactcggaccgatg

SEQ ID NO: 12496 - DNA, 203 bp, Homo sapiens
  source 1..203: mol_type = other DNA
ggcgcgccagtccttacataacgagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccagatcctcttgattggcgactcggaccgatg

SEQ ID NO: 12497 - DNA, 203 bp, Homo sapiens
  source 1..203: mol_type = other DNA
ggcgcgccagtccttcagtgccgagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 12498 - DNA, 203 bp, Homo sapiens
  source 1..203: mol_type = other DNA
ggcgcgccagtcctcccaggccgagcctccagagggctgtcggcgcagtagcagcgagcagcagagtccgcacgctccggcgaggggcagaagagcgcgagggagcgcggggcagcaggctgtgatattccacgcggacccagccaggacccacagccctccccagctgcccaggaagagccccagcccgactcggaccgatg

SEQ ID NO: 12499 - DNA, 203 bp, Homo sapiens
  source 1..203: mol_type = other DNA
ggcgcgccagtccttgggcaacgagcctccagagggctgtcggcgcagtagcagcgagcagcagagtccgcacgctccggcgaggggcaggttgttctctttcggcgcggggcagcagaagcgagagccgagcgcggacccagccaggacccacagccctccccagctgcccaggaagagccccagcccgactcggaccgatg

SEQ ID NO: 12500 - DNA, 203 bp, Homo sapiens
  source 1..203: mol_type = other DNA
ggcgcgccagtccttggtgtccgagcctccagagggctgtcggcgcagtagcagcgagcagcttccagtcgtgtagccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 12501 - DNA, 203 bp, Homo sapiens
  source 1..203: mol_type = other DNA
ggcgcgccagtcctgcgctggggagcctggcgtggtagggctgtgctgcgcggtccttcccattcaccctagtctggcgctcgccggcgtgggcgggccggaccttcgccgcttccagagctacatcgttaagccgtcggaccacggcgcggcggccagttcctttatagttttgttcagaaaaacatcgactcggaccgatg

SEQ ID NO: 12502 - DNA, 203 bp, Homo sapiens
  source 1..203: mol_type = other DNA
ggcgcgccagtcctcatatcttgagcctggcgtggtagggctgtgctgcgcggtccttcccattcaccctagtctggcgctcgccggcgtgggcgggccggaccttcgccgcttccaggaagggccacaacgcaacgacacaacgcgcgcggcggccagttcctttatagttttgttcagaaaaacatcgactcggaccgatg

SEQ ID NO: 12503 - DNA, 203 bp, Homo sapiens
  source 1..203: mol_type = other DNA
ggcgcgccagtcctatgttccagagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttacaattggccgacgcgactcggaccgatg

SEQ ID NO: 12504 - DNA, 203 bp, Homo sapiens
  source 1..203: mol_type = other DNA
ggcgcgccagtcctatggtagtgagcggttagagccaacaccactccctgcgagtggccggagaccagggcccaacataaacaagctttggagacaaacaaccttatgacctgtcagccctgacaaaggtcagctagccccttgaggacatcagctttggcctcagggtcctaatggcagcagaaccacgactcggaccgatg

SEQ ID NO: 12505 - DNA, 203 bp, Homo sapiens
  source 1..203: mol_type = other DNA
ggcgcgccagtcctcccaccgagagcggttagagtgtgtgtgggcggatgcgagtggccggagaccagggcccaacataaacaagctttgctcctcgcagtgagtatgacctgtcagccctgacaaaggtcagctagccccttgaggacatcagctttggcctcagggtcctaatggcagcagaaccacgactcggaccgatg

SEQ ID NO: 12506 - DNA, 203 bp, Homo sapiens
  source 1..203: mol_type = other DNA
ggcgcgccagtcctctcttctagagcggttagagtgtgtgtgggcggatgcgagtggccggagaccagggcccaacataaacaagctttggagacaaacaacctccgttttcagttttcctgacaaaggtcagctagccccttgaggacatcagctttggcctcagggtcctaatggcagcagaaccacgactcggaccgatg

SEQ ID NO: 12507 - DNA, 203 bp, Homo sapiens
  source 1..203: mol_type = other DNA
ggcgcgccagtcctaatattctgagcggttagagtgtgtgtgggcggatgcgagtggccggagaccagggcccaacgagggtggttggacgagacaaacaaccttatgacctgtcagccctgacaaaggtcagctagccccttgaggacatcagctttggcctcagggtcctaatggcagcagaaccacgactcggaccgatg

SEQ ID NO: 12508 - DNA, 203 bp, Homo sapiens
  source 1..203: mol_type = other DNA
ggcgcgccagtcctgagcattggagcggttagagtgtgtgtgggcggatgcgagtggccggattaacttcaaagctataaacaagctttggagacaaacaaccttatgacctgtcagccctgacaaaggtcagctagccccttgaggacatcagctttggcctcagggtcctaatggcagcagaaccacgactcggaccgatg

SEQ ID NO: 12509 - DNA, 203 bp, Homo sapiens
  source 1..203: mol_type = other DNA
ggcgcgccagtcctggcacggagaggactcgggacagggaattggccctgggagaaaacgcgatccaacgccgatggacgccccgtgaaagccgtgccgacccttgggaggactgacaggtctagagacacgcgctgtctgttgtggtgggcctcccgggaataagtgaggggctctgtgtttcgaggcgactcggaccgatg

SEQ ID NO: 12510 - DNA, 203 bp, Homo sapiens
  source 1..203: mol_type = other DNA
ggcgcgccagtcctacgtcgctgaggactcgggacagggaattggccctgggagaaaacgcgcggggggcgtccgagacgccccgtgaaagccgtgccgaccctataccacctaacttggtctagagacacgcgctgtctgttgtggtgggcctcccgggaataagtgaggggctctgtgtttcgaggcgactcggaccgatg

SEQ ID NO: 12511 - DNA, 203 bp, Homo sapiens
  source 1..203: mol_type = other DNA
ggcgcgccagtccttgtaagaggaggactcgggacagggaattggccctgggagaaaacgcgcggggggcgtccgagacgccccgtgaaagccgtgccgacccttgggaggactgacaggtctagagacacgcgctgtctgttgtgcccccttatgatccaataagtgaggggctctgtgtttcgaggcgactcggaccgatg

SEQ ID NO: 12512 - DNA, 203 bp, Homo sapiens
  source 1..203: mol_type = other DNA
ggcgcgccagtcctcctagtgagaggactcgggacagggaattggccctgggagaaaacgcgcggggggcgtccgagacgccccgtgaaagccgtgccgacccttgggaggactgacaggtctagagacacgtagccatcagcaatgtgggcctcccgggaataagtgaggggctctgtgtttcgaggcgactcggaccgatg

SEQ ID NO: 12513 - DNA, 203 bp, Homo sapiens
  source 1..203: mol_type = other DNA
ggcgcgccagtccttaataggcgaggactcgggatgctccccgtctaatgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggcgactcggaccgatg

SEQ ID NO: 12514 - DNA, 203 bp, Homo sapiens
  source 1..203: mol_type = other DNA
ggcgcgccagtcctacaatggggaggagagactaccgtcctggagataacggttccacggaggcccaaggcgaaacggaaggatcctcatgtacaaaactgagcggaatggagctgtgagcacgcatcaggtatgtacatcataaaggcacgtagtagaggtcctcagccagcagagccacgttccttcgactcggaccgatg

SEQ ID NO: 12515 - DNA, 203 bp, Homo sapiens
  source 1..203: mol_type = other DNA
ggcgcgccagtcctgctgaagtgaggagagactaccgtcctggagataacggttccacggaggcccaaggcgaaacggaaggatcctcatgtacaaaactgagcggaatggagctgtgagcacgcatcaggtgctgtttcaggcctggcacgtagtagagacgtatgatttcatgagccacgttccttcgactcggaccgatg

SEQ ID NO: 12516 - DNA, 203 bp, Homo sapiens
  source 1..203: mol_type = other DNA
ggcgcgccagtccttatgacacgaggagagactaccgtcctggagataacggttccacggaggcccaaggcgaaacggaaggatcctcattggtgccgggagctggaatggagctgtgagcacgcatcaggtgctgtttcaggcctggcacgtagtagaggtcctcagccagcagagccacgttccttcgactcggaccgatg

SEQ ID NO: 12517 - DNA, 203 bp, Homo sapiens
  source 1..203: mol_type = other DNA
ggcgcgccagtcctcgctgtaggaggagagactagttatgaattcgatacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttcgactcggaccgatg

SEQ ID NO: 12518 - DNA, 203 bp, Homo sapiens
  source 1..203: mol_type = other DNA
ggcgcgccagtcctcctataatgaggagggaagaggactccaagcgccatggccgctgccgcccgagcccgggtcgcgtacttgctgaggcaactgcaacgcgcagcgtgccagtgcccaactcattctcatactggaaggaaagcccctggactttcaccccaccaacgtccaacagattatgccttcgactcggaccgatg

SEQ ID NO: 12519 - DNA, 203 bp, Homo sapiens
  source 1..203: mol_type = other DNA
ggcgcgccagtcctagctacaagaggagggaagaggactccaagcgccatggccgctgccgcccgagcccgggtcgcgtacttgctgaggcaactgcaacgcgcagcgtgccagtgcccaactcattctcatacttactcccaagcccctggactttcaccccaccaacgtccaacagattatgccttcgactcggaccgatg

SEQ ID NO: 12520 - DNA, 203 bp, Homo sapiens
  source 1..203: mol_type = other DNA
ggcgcgccagtcctaggtccatgaggagggaagaggactccaagcgccatggccgctgccgcccgagcccgggtcgcgtacttgctgaggcaactgcaacgcgcagcgtgccagtgcccaactcattctcatacttactcccaagcccctggactttcaccttctgggaaaacaacagattatgccttcgactcggaccgatg

SEQ ID NO: 12521 - DNA, 203 bp, Homo sapiens
  source 1..203: mol_type = other DNA
ggcgcgccagtccttgggaggtgaggagggaagaggactccaagcgccatggccgctgccgcccgagcccgggtcgcgtacttgctgaggcaactgcaacgcgcagcgtgccagtgcccaactcattctcatcaggtgaagttcaaccctggactttcaccttctgggaaaacaacagattatgccttcgactcggaccgatg

SEQ ID NO: 12522 - DNA, 203 bp, Homo sapiens
  source 1..203: mol_type = other DNA
ggcgcgccagtcctacaatacagaggagggaagaggactccaagcgccatggccgctgccgcccgagcccgggtcgcgtacttgctgaggtcttgatcttatagagcgtgccagtgcccaactcattctcatacttactcccaagcccctggactttcaccttctgggaaaacaacagattatgccttcgactcggaccgatg

SEQ ID NO: 12523 - DNA, 203 bp, Homo sapiens
  source 1..203: mol_type = other DNA
ggcgcgccagtcctagactcacgaggagggaagaggactccaagcgcctcattaagactgttccgagcccgggtcgcgtacttgctgaggcaactgcaacgcgcagcgtgccagtgcccaactcattctcatacttactcccaagcccctggactttcaccttctgggaaaacaacagattatgccttcgactcggaccgatg

SEQ ID NO: 12524 - DNA, 203 bp, Homo sapiens
  source 1..203: mol_type = other DNA
ggcgcgccagtcctgtaagcgtgaggccgcggggacccggcggacttcggcgcgggctgggagagaccacccgcagtcccttcctccaggaacgattatcttttcgcggagactcgtccggcgctctccagccgccctggagcaactttgcttcgaagttccctgggcccgggcagggcccggcagcccgactcggaccgatg

SEQ ID NO: 12525 - DNA, 203 bp, Homo sapiens
  source 1..203: mol_type = other DNA
ggcgcgccagtccttaccgcaggaggccgcggggacccggcggacttcggcgcgggctgggattttattgtgctcctcccttcctccagggctcgccccaggcccgcggagactcgtccggcgctctccagccgccctggagcaactttgcttcgaagttccctgggcccgggcagggcccggcagcccgactcggaccgatg

SEQ ID NO: 12526 - DNA, 203 bp, Homo sapiens
  source 1..203: mol_type = other DNA
ggcgcgccagtccttaagtctagaggcgaagcttcagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctcgactcggaccgatg

SEQ ID NO: 12527 - DNA, 203 bp, Homo sapiens
  source 1..203: mol_type = other DNA
ggcgcgccagtccttaaagtaagaggcgggacgcggggtgataacagcactacaaatacatagggcgggagctggggaggaggagcaggagaggcccacaggcttcatttggagtcaggcctggctgttgctcaggtgaccagcttgtgtctctgggagggcgctgctttccccggccacccggcgcgcgactcggaccgatg

SEQ ID NO: 12528 - DNA, 203 bp, Homo sapiens
  source 1..203: mol_type = other DNA
ggcgcgccagtcctacttgggtgaggcgggacgcggggtgataacagctggctctggtgggcgggcgggagctggggaggaggagcaggacgctatattcctactcatttggagtcaggcctggctgttgctcaggtgaccagcttgtgtctctgggagggcgctgctttccccggccacccggcgcgcgactcggaccgatg

SEQ ID NO: 12529 - DNA, 203 bp, Homo sapiens
  source 1..203: mol_type = other DNA
ggcgcgccagtcctggttagtcgaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgcgactcggaccgatg

SEQ ID NO: 12530 - DNA, 203 bp, Homo sapiens
  source 1..203: mol_type = other DNA
ggcgcgccagtcctacttatacgaggctcacaccaaggcaggcggggtaccttccctagtccctgcactaggttggacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12531 - DNA, 203 bp, Homo sapiens
  source 1..203: mol_type = other DNA
ggcgcgccagtccttaggtggagaggctcacacctttcatccttccccaccttcccggtgagttgcactaggttggacagcccccattggctacaggaaagcgggaggggtgtgagtccccatggttttctttgcagtggccccagcccccttaccgtctgcctgggatctgagtacatattgcagtgcgactcggaccgatg

SEQ ID NO: 12532 - DNA, 203 bp, Homo sapiens
  source 1..203: mol_type = other DNA
ggcgcgccagtcctcaaagtcggaggctcacacctttcatccttccccaccttcccggtgagttgcactaggttggacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12533 - DNA, 203 bp, Homo sapiens
  source 1..203: mol_type = other DNA
ggcgcgccagtcctcgcgtggagaggctcacacctttcatccttccccaccttccctagtccctgcactaggttggacagcccccattggctacaggaaagcggatccacgcgagagaccctactccctctttgcagtggccccagcccccttaccgtctgcctgggatctgagtacatattgcagtgcgactcggaccgatg

SEQ ID NO: 12534 - DNA, 203 bp, Homo sapiens
  source 1..203: mol_type = other DNA
ggcgcgccagtcctgatgccaggaggctcacacctttcatccttccccaccttccctagtccctgcactaggttggacagcccccattggctacaggaaagcgggaggggtgtgagtcatacctgtagggcctgcagtggccccagcccccttaccgtctgcctgggatctgagtacatattgcagtgcgactcggaccgatg

SEQ ID NO: 12535 - DNA, 203 bp, Homo sapiens
  source 1..203: mol_type = other DNA
ggcgcgccagtcctctgggtcggaggctcacacctttcatccttccccaccttccctagtccctgcactaggttggacagcccccattggctacaggaaagcgggaggggtgtgagtcccctactccctctttgcagtggccccagcccccttaccgtctcgtaactcatcatatacatattgcagtgcgactcggaccgatg

SEQ ID NO: 12536 - DNA, 203 bp, Homo sapiens
  source 1..203: mol_type = other DNA
ggcgcgccagtcctatcatccggaggctcacacctttcatccttccccaccttccctagtccctgcactaggttggacagcccccattggctacaggaaagcgggaggggtgtgagtcccctactccctctttgcagtggccccagcccccttaccgtctgcctgggatctgagggataccactccgccgactcggaccgatg

SEQ ID NO: 12537 - DNA, 203 bp, Homo sapiens
  source 1..203: mol_type = other DNA
ggcgcgccagtcctgataatcagaggctcacacctttcatccttccccaccttccctagtcctgcgtacgatacaaacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12538 - DNA, 203 bp, Homo sapiens
  source 1..203: mol_type = other DNA
ggcgcgccagtcctagaaccgagaggctcacacctttcatccttccccgagccgaagctgtgctgcactaggttggacagcccccattggctacaggaaagcgggaggggtgtgagtcccctactccctctttgcagtggccccagcccccttaccgtctgcctgggatctgagtacatattgcagtgcgactcggaccgatg

SEQ ID NO: 12539 - DNA, 203 bp, Homo sapiens
  source 1..203: mol_type = other DNA
ggcgcgccagtccttcccataagaggggggtagcaacagtggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagcgactcggaccgatg

SEQ ID NO: 12540 - DNA, 203 bp, Homo sapiens
  source 1..203: mol_type = other DNA
ggcgcgccagtcctcccgagctgaggggggtagcaacagtggtgagttcgttggatggcttaagccctgagtacagggtagtcgtcagtggttcgacgccttggaataaaggtctcgagatgccacgtggacgagggcatgcccaaagcacatcttaacctgagcgggggtcgctgcctacccctttacgactcggaccgatg

SEQ ID NO: 12541 - DNA, 203 bp, Homo sapiens
  source 1..203: mol_type = other DNA
ggcgcgccagtcctctccaaccgaggggggtagcaacagtggtgagttcgttggatggcttaagccctgagtacagggtagtcgtcagtggttcgacgccttggaataaaggtctcgatcccgattaattctgagggcatgcccaaagcacatcttaacctgagcgggggtcgcccaggtaaaagcagcgactcggaccgatg

SEQ ID NO: 12542 - DNA, 203 bp, Homo sapiens
  source 1..203: mol_type = other DNA
ggcgcgccagtccttagagcgcgaggggggtagcaacagtggtgagttcgttggatggcttaagccctgagtacagggtagtcgtcagtgtgcatggcagagacaataaaggtctcgagatgccacgtggacgagggcatgcccaaagcacatcttaacctgagcgggggtcgcccaggtaaaagcagcgactcggaccgatg

SEQ ID NO: 12543 - DNA, 203 bp, Homo sapiens
  source 1..203: mol_type = other DNA
ggcgcgccagtcctggtccgtggaggggggtagcggtgtgttgagaggcgttggatggcttaagccctgagtacagggtagtcgtcagtggttcgacgccttggaataaaggtctcgagatgccacgtggacgagggcatgcccaaagcacatcttaacctgagcgggggtcgcccaggtaaaagcagcgactcggaccgatg

SEQ ID NO: 12544 - DNA, 203 bp, Homo sapiens
  source 1..203: mol_type = other DNA
ggcgcgccagtcctagcgcgaggaggggtttcccgacgccctggtctgagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgccgactcggaccgatg

SEQ ID NO: 12545 - DNA, 203 bp, Homo sapiens
  source 1..203: mol_type = other DNA
ggcgcgccagtcctatgtgagagaggttaagccgtcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggtcgactcggaccgatg

SEQ ID NO: 12546 - DNA, 203 bp, Homo sapiens
  source 1..203: mol_type = other DNA
ggcgcgccagtcctcagtatttgaggttgcctaggcagaagcgggagaaggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtcgactcggaccgatg

SEQ ID NO: 12547 - DNA, 203 bp, Homo sapiens
  source 1..203: mol_type = other DNA
ggcgcgccagtcctctttggcggagtcccctgggcgcccccacaccggatatatagaacctgggttcgcgacgcagccccccggccgtggatgctcactcgggctcgggatccgcccaggtagccggctcggacccaggtcctgcgcccaggtcctcccctgccccccagcgacggagccggggccggcgactcggaccgatg

SEQ ID NO: 12548 - DNA, 203 bp, Homo sapiens
  source 1..203: mol_type = other DNA
ggcgcgccagtcctcataggaagagtcccctgggcgcccccacaccggtagacgcctcggctggttcgcgacgcagccccccggccgtggatgctcactcgggctcgggatccgcccaggtagccggctcggacccaggtcctgcgaagcatcgagattgtgccccccagcgacggagccggggccggcgactcggaccgatg

SEQ ID NO: 12549 - DNA, 203 bp, Homo sapiens
  source 1..203: mol_type = other DNA
ggcgcgccagtcctctcaacatgagtcccctgggcgcccccacaccggtagacgcctcggctggttcgcgacgcagccccccggccgtggatgctcactcgggctcgggatccgcccaggtagccggctcggacccaggtcctgcgcccaggtcctcccctgccccccagcgacggagccggggccggcgactcggaccgatg

SEQ ID NO: 12550 - DNA, 203 bp, Homo sapiens
  source 1..203: mol_type = other DNA
ggcgcgccagtcctggacaaccgagtcccctgggcgcccccacaccggtagacgcctcggctggttcgcgacgcagccccccggccgtggatgctcactcgggctcgggatccgcccatccgcagatagaaaacccaggtcctgcgcccaggtcctcccctgccccccagcgacggagccggggccggcgactcggaccgatg

SEQ ID NO: 12551 - DNA, 203 bp, Homo sapiens
  source 1..203: mol_type = other DNA
ggcgcgccagtccttcacgcatgagtcccctgggtttagtttgtaacatagacgcctcggctggttcgcgacgcagccccccggccgtggatgctcactcgggctcgggatccgcccaggtagccggctcggacccaggtcctgcgcccaggtcctcccctgccccccagcgacggagccggggccggcgactcggaccgatg

SEQ ID NO: 12552 - DNA, 203 bp, Homo sapiens
  source 1..203: mol_type = other DNA
ggcgcgccagtcctactgcgtggagtgtcagctctccatctgtctctgcctggcaggcgcacaacgtttttcgaaggcctccggcgatgccgccccagcccctctgatggccctcctctctgctgccactcattccagaacaggaggcatgagcccggaacgcgcttgcttttaggagacagccacttcgactcggaccgatg

SEQ ID NO: 12553 - DNA, 203 bp, Homo sapiens
  source 1..203: mol_type = other DNA
ggcgcgccagtcctaaagcactgagtgtcagctctccatctgtctctgcctggcaggcgcacgcgcccagcaccctgcctccggcgatgccgccccagcccctcgtggttatagttagtctgctgccactcattccagaacaggaggcatgagcccggaacgcgcttgcttttaggagacagccacttcgactcggaccgatg

SEQ ID NO: 12554 - DNA, 203 bp, Homo sapiens
  source 1..203: mol_type = other DNA
ggcgcgccagtcctctatagccgagtgtcagctctccatctgtctctgcctggcaggcgcacgcgcccagcaccctgcctccggcgatgccgccccagcccctctgatggccctcctcatccactgtcgaatttccagaacaggaggcatgagcccggaacgcgcttgcttttaggagacagccacttcgactcggaccgatg

SEQ ID NO: 12555 - DNA, 203 bp, Homo sapiens
  source 1..203: mol_type = other DNA
ggcgcgccagtcctggtgtttcgagtgtcagctctccatctgtctctgcctggcaggcgcacgcgcccagcaccctgcctccggcgatgccgccccagcccctctgatggccctcctctctgctgccactcacgaacatctctactgcatgagcccggaacgcgcttgcttttaggagacagccacttcgactcggaccgatg

SEQ ID NO: 12556 - DNA, 203 bp, Homo sapiens
  source 1..203: mol_type = other DNA
ggcgcgccagtcctgcacctcagagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccacttcgactcggaccgatg

SEQ ID NO: 12557 - DNA, 203 bp, Homo sapiens
  source 1..203: mol_type = other DNA
ggcgcgccagtcctgggagccagagtgtcagctctccatctgtctctgcctggcaggcgcacgcgcccagcaccctgcctccggcgatgccgccccagcccctctgatggccctcctctctgctgccactcattccagaacaggagtttactaggatcggcgcgcttgcttttaggagacagccacttcgactcggaccgatg

SEQ ID NO: 12558 - DNA, 203 bp, Homo sapiens
  source 1..203: mol_type = other DNA
ggcgcgccagtcctagtttggcgagtgtcagctctccatctgtctctgcctggcaggcgcacgcgcccagcaccctgcctccggcgatgcttggggcctgaaattgatggccctcctctctgctgccactcattccagaacaggaggcatgagcccggaacgcgcttgcttttaggagacagccacttcgactcggaccgatg

SEQ ID NO: 12559 - DNA, 203 bp, Homo sapiens
  source 1..203: mol_type = other DNA
ggcgcgccagtcctatagtgctgagtgtcagctctccatctgtctctgcctggcaggcgcacgcgcccagcacccttgaattctgcgatacgccccagcccctctgatggccctcctctctgctgccactcattccagaacaggaggcatgagcccggaacgcgcttgcttttaggagacagccacttcgactcggaccgatg

SEQ ID NO: 12560 - DNA, 203 bp, Homo sapiens
  source 1..203: mol_type = other DNA
ggcgcgccagtcctcactgtgagatactcatcctacctgaatataaactgagataaatccagtaaagaaagtgtagccttccaacaccctgagtctatcattgatttctttttgtggtaaaaatcttagttcatgtgaagaaatttcatgtgaatgttttagctatcaaacagtactgtcacctactccgactcggaccgatg

SEQ ID NO: 12561 - DNA, 203 bp, Homo sapiens
  source 1..203: mol_type = other DNA
ggcgcgccagtcctaccggtgcgatactcatcctacctgaatataaactgagataaatccagtaaagaaagtgtagtaaattctacataagagtctatcattgatttctttttgtggtgctctatcgcaacaatgtgaagaaatttcatgtgaatgttttagctatcaaacagtactgtcacctactccgactcggaccgatg

SEQ ID NO: 12562 - DNA, 203 bp, Homo sapiens
  source 1..203: mol_type = other DNA
ggcgcgccagtcctgcgcatgcgatagcgcctttcccctaatgtagtacccacctgccaggtgtgaagtggagtgagcggatctccaatttggtctgttctgaactacaccatttactgctgtgaagaatgccctggaggcaagctggttacagccctgaccaggccctgcccgtgactctcgaccggcgactcggaccgatg

SEQ ID NO: 12563 - DNA, 203 bp, Homo sapiens
  source 1..203: mol_type = other DNA
ggcgcgccagtcctcctgggtcgatagcgccttttgggatgcaggaaccccacctgccaggtgtgaagtggagtgactactgtaatcggatggtctgttctgaactacaccatttactgctgtgaagaatgccctggaggcaagctggttacagccctgaccaggccctgcccgtgactctcgaccggcgactcggaccgatg

SEQ ID NO: 12564 - DNA, 203 bp, Homo sapiens
  source 1..203: mol_type = other DNA
ggcgcgccagtcctatggtgaggatagcgccttttgggatgcaggaaccccacctgccaggtgtgaagtggagtgagcggatctccaattgctgtgacataatcctacaccatttactgctgtgaagaatgccctggaggcaagctggttacagccctgaccaggccctgcccgtgactctcgaccggcgactcggaccgatg

SEQ ID NO: 12565 - DNA, 203 bp, Homo sapiens
  source 1..203: mol_type = other DNA
ggcgcgccagtcctctcccaaagatagcgccttttgggatgcaggaaccccacctgccaggtgtgaagtggagtgagcggatctccaatttggtctgttctgaactacaccatttactgctgtgaagaatgccctggaggcaagctggttacagccctgaggtacgatatggaatgactctcgaccggcgactcggaccgatg

SEQ ID NO: 12566 - DNA, 203 bp, Homo sapiens
  source 1..203: mol_type = other DNA
ggcgcgccagtcctttgtagtagatagcgccttttgggatgcaggaactgactgaatgtacagtgaagtggagtgagcggatctccaatttggtctgttctgaactacaccatttactgctgtgaagaatgccctggaggcaagctggttacagccctgaccaggccctgcccgtgactctcgaccggcgactcggaccgatg

SEQ ID NO: 12567 - DNA, 203 bp, Homo sapiens
  source 1..203: mol_type = other DNA
ggcgcgccagtcctatgagcccgataggatgtgaaggctccgatttgtgaataggtttttatattcgaagtaggtagtattgcgcatactattaattccacaatacgtggtcttcgtcagttttttaggttgtttcgtccctatggaaatggctcttcggacctgagtacagtgggacaaccccaacgcgactcggaccgatg

SEQ ID NO: 12568 - DNA, 203 bp, Homo sapiens
  source 1..203: mol_type = other DNA
ggcgcgccagtcctcgcaatcggatatagcacagggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctcccgactcggaccgatg

SEQ ID NO: 12569 - DNA, 203 bp, Homo sapiens
  source 1..203: mol_type = other DNA
ggcgcgccagtcctcggcctccgatcccctgcagtcggcgggagtgttggaggtcggcgccgagtaaataagataccgccccccacgggaaggaagcacccccggtattaaaacgaacggggcggaaagaagccctcagtcgccggccgggaggcgagccgatgccgagctgctccacgtccaccatgcgactcggaccgatg

SEQ ID NO: 12570 - DNA, 203 bp, Homo sapiens
  source 1..203: mol_type = other DNA
ggcgcgccagtcctgcgtaattgatcccctgcagtcggcgggagtgttggaggtcggcgccggcccccgccttccgcgccccccacgggaaggaagcacccccgaagaagtgtgcgtaggggcggaaagaagccctcagtcgccggccgggaggcgagccgatgccgagctgctccacgtccaccatgcgactcggaccgatg

SEQ ID NO: 12571 - DNA, 203 bp, Homo sapiens
  source 1..203: mol_type = other DNA
ggcgcgccagtccttcaacctagatcccctgcagtcggcgggagtgttggaggtcggcgccggcccccgccttccgcgccccccacgggaaggaagcacccccggtattaaaacgaacctcctatgtcagtcccctcagtcgccggccgggaggcgagccgatgccgagctgctccacgtccaccatgcgactcggaccgatg

SEQ ID NO: 12572 - DNA, 203 bp, Homo sapiens
  source 1..203: mol_type = other DNA
ggcgcgccagtcctcttccctggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccataaattgcggtgcccacgtccaccatgcgactcggaccgatg

SEQ ID NO: 12573 - DNA, 203 bp, Homo sapiens
  source 1..203: mol_type = other DNA
ggcgcgccagtcctccgggcccgatcccctgcagtcggcgggagtgttggaggtcggcgccggcccccgccttccgcgccccccacgggaaggaagcacccccggtattaaaacgaacggggcggaaagaagggtgactaatatctccgggaggcgagccgatgccgagctgctccacgtccaccatgcgactcggaccgatg

SEQ ID NO: 12574 - DNA, 203 bp, Homo sapiens
  source 1..203: mol_type = other DNA
ggcgcgccagtcctttcatgttgatcgaagacccaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 12575 - DNA, 203 bp, Homo sapiens
  source 1..203: mol_type = other DNA
ggcgcgccagtccttccgacgggatcgtgtggatgtctttgctgaccagacaaagcataccagatctcaccagagagtcctaggggactacagaaggaaaaagacaagaggcagtaggatatctgtgtgtcctcccgctgaccacacttcctttagtgacccgattgcctcctcaagtcgcagacactcgactcggaccgatg

SEQ ID NO: 12576 - DNA, 203 bp, Homo sapiens
  source 1..203: mol_type = other DNA
ggcgcgccagtccttatgcttcgatgcgctaatatcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 12577 - DNA, 203 bp, Homo sapiens
  source 1..203: mol_type = other DNA
ggcgcgccagtcctgtgtgctagatgtcctaacacggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 12578 - DNA, 203 bp, Homo sapiens
  source 1..203: mol_type = other DNA
ggcgcgccagtcctgacgtgccgattcagaccccctacgcgcgcgccaatctccacgacgccactatggttgatattacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 12579 - DNA, 203 bp, Homo sapiens
  source 1..203: mol_type = other DNA
ggcgcgccagtcctcaagttgagattcagaccccctacgcgcgcgccaatctccacgacgccgactaacgcccctggcttattttttccaaatcttacctactctaaccaggtcatcacccaccgttgtttcgccgcatctggtgggtacccaacttttgccattcgggagagccccagggtgcccgacgactcggaccgatg

SEQ ID NO: 12580 - DNA, 203 bp, Homo sapiens
  source 1..203: mol_type = other DNA
ggcgcgccagtccttgaatgtagattcagaccccctacgcgcgcgccaatctccacgacgccgactaacgcccctgtacgtggggcctttaatcttacctactctaaccaggtcatcacccaccgttgtttcgccgcatctggtggaggatattaaacatccattcgggagagccccagggtgcccgacgactcggaccgatg

SEQ ID NO: 12581 - DNA, 203 bp, Homo sapiens
  source 1..203: mol_type = other DNA
ggcgcgccagtcctatgtagacgattcagaccccctacgcgcgcgccaatctccacgacgccgactaacgcccctgtacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 12582 - DNA, 203 bp, Homo sapiens
  source 1..203: mol_type = other DNA
ggcgcgccagtcctgtctgagtgattcagaccccctacgcgcgcgccaatctccacgacgccgactaacgcccctgtacgtggggcctttaatcttacctactctaaccaggtcatcacccaccgttgtttcgccgcatctggtgggtacccaacttttgtttaaactagcttacccagggtgcccgacgactcggaccgatg

SEQ ID NO: 12583 - DNA, 203 bp, Homo sapiens
  source 1..203: mol_type = other DNA
ggcgcgccagtcctttcgcgcggattcagacccctgttttcatgtggtatctccacgacgccgactaacgcccctgtacgtggggcctttaatcttacctactctaaccaggtcatcacccaccgttgtttcgccgcatctggtgggtacccaacttttgccattcgggagagccccagggtgcccgacgactcggaccgatg

SEQ ID NO: 12584 - DNA, 203 bp, Homo sapiens
  source 1..203: mol_type = other DNA
ggcgcgccagtcctaactcctagattggctttttaagcacctcccccagttattcaagtttctggtctttaaaaaactctgtggcggtacggtaaccgaggaggttccagcgcggcggaagtacaagcgttaagggtgtgtgcgcaaggccagggccagaggggcacgtggcgccgggaggagagagacgactcggaccgatg

SEQ ID NO: 12585 - DNA, 203 bp, Homo sapiens
  source 1..203: mol_type = other DNA
ggcgcgccagtccttattaagtgattggcttttttttttggcaaaccacaatcgtcgccgaatggtctttaaaaaactctgtggcggtacggtaaccgaggaggttccagcgcggcggaagtaccccgcgggtgggtgtgtgcgcaaggccagggccagaggggcacgtggcgccgggaggagagagacgactcggaccgatg

SEQ ID NO: 12586 - DNA, 203 bp, Homo sapiens
  source 1..203: mol_type = other DNA
ggcgcgccagtcctctagttaggattggcttttttttttggcaaaccagttattcaagtttctggtctttaaaaaactctgtggcggtacggtaaccgaggaggttccagcgcggcggaagtaccccgcgggactaatacgtttgcaggccagggccagaggggcacgtggcgccgggaggagagagacgactcggaccgatg

SEQ ID NO: 12587 - DNA, 203 bp, Homo sapiens
  source 1..203: mol_type = other DNA
ggcgcgccagtcctctgaagtcgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagacaatgcaacaattacgggaggagagagacgactcggaccgatg

SEQ ID NO: 12588 - DNA, 203 bp, Homo sapiens
  source 1..203: mol_type = other DNA
ggcgcgccagtcctccaacggcgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgcttttttctatccaccgactcggaccgatg

SEQ ID NO: 12589 - DNA, 203 bp, Homo sapiens
  source 1..203: mol_type = other DNA
ggcgcgccagtcctaacattgggattggcttttttttttggcaaaccagttattcaagtttctggtctttaaaaaactctgtggcggtacggtaaccgaggaggttccagcgcggcggaagtaccccgcgggtgggtgtgtgcgcactaggcaacatgttggggcacgtggcgccgggaggagagagacgactcggaccgatg

SEQ ID NO: 12590 - DNA, 203 bp, Homo sapiens
  source 1..203: mol_type = other DNA
ggcgcgccagtccttgttgtaagattggcttttttttttggcaaaccagttattcaagtttctggtctttaaaaaactctgtggcggtacggtaaccgaggaggttccagcgcggcggcctctaaagtaccttgggtgtgtgcgcaaggccagggccagaggggcacgtggcgccgggaggagagagacgactcggaccgatg

SEQ ID NO: 12591 - DNA, 203 bp, Homo sapiens
  source 1..203: mol_type = other DNA
ggcgcgccagtcctttattcgggatttcagagaggcttagggcaaacatcatttggccttaaatgggattctgtgagaggggatccctccattgacagctggactgttctttggggccttatgtggtgtttgcctctgaggtactcaggggcatttaggtttttcctcattcttaaataataatgaaccgactcggaccgatg

SEQ ID NO: 12592 - DNA, 203 bp, Homo sapiens
  source 1..203: mol_type = other DNA
ggcgcgccagtcctatgcgcaagcaaaagggccactaatgttctattatccctccactgccctcgaacgcctcacttcctaagtctctgcatttctcagtcagtggacagcttttgggactcttgtgtgaggactttgggggaccaggccaggctgggcctctgctgattgagatcttgggatccagacgactcggaccgatg

SEQ ID NO: 12593 - DNA, 203 bp, Homo sapiens
  source 1..203: mol_type = other DNA
ggcgcgccagtccttcgagagagcaaaagggccaggggcccggagccttccctccactgcccggcggactgaatggtcctaagtctctgcatttctcagtcagtggacagcttttgggactcttgtgtgaggactttgggggaccaggccaggctgggcctctgctgattgagatcttgggatccagacgactcggaccgatg

SEQ ID NO: 12594 - DNA, 203 bp, Homo sapiens
  source 1..203: mol_type = other DNA
ggcgcgccagtcctgaaagctggcaaaagggccaggggcccggagccttccctccactgccctcgaacgcctcacttcctaagtctctgcatttctcagtcagtggacagcttttgggactcttgtgtgaggactttgggggaccactgtctagaactgatctgctgattgagatcttgggatccagacgactcggaccgatg

SEQ ID NO: 12595 - DNA, 203 bp, Homo sapiens
  source 1..203: mol_type = other DNA
ggcgcgccagtccttcattcctgcaaaagggccaggggcccggagccttccctccactgccctcgaacgcctcacttcctaagtctctgcatttctcagtcagtggacagcttttgggttgaaacaaacgcaactttgggggaccaggccaggctgggcctctgctgattgagatcttgggatccagacgactcggaccgatg

SEQ ID NO: 12596 - DNA, 203 bp, Homo sapiens
  source 1..203: mol_type = other DNA
ggcgcgccagtcctgtaaaccggcaaaagggccaggggcccggagccttccctccactgccctcgaacgcctcacttcctaagtctctgcatttctcagtcagtttcacctagacaacactcttgtgtgaggactttgggggaccaggccaggctgggcctctgctgattgagatcttgggatccagacgactcggaccgatg

SEQ ID NO: 12597 - DNA, 203 bp, Homo sapiens
  source 1..203: mol_type = other DNA
ggcgcgccagtccttcctcttagcaaaattctgcctccaaggattttctgccgtctcttggcaaaaatggcaaataatgatgctgttctgaagagactggagcagaagggtgcagaggcagatcaaatcattgaatatcttaagcagcaagtttctctacttaaggagaaagcatagcaatcccttgtcgactcggaccgatg

SEQ ID NO: 12598 - DNA, 203 bp, Homo sapiens
  source 1..203: mol_type = other DNA
ggcgcgccagtccttgatggcggcaaaattctgcctccaaggattttctgccgtctcttggcaaaaatggcaaataatgatgctgttctgaagagactggagcagaagggtgcagagggttcaacccggtgggaatatcttaagcagcaagtttctctacttaaggagaaagcaattttgcaggcaaccgactcggaccgatg

SEQ ID NO: 12599 - DNA, 203 bp, Homo sapiens
  source 1..203: mol_type = other DNA
ggcgcgccagtcctgagcggcagcaaaattctgcctccaaggattttctgccgtctcttggcaaaaatggcaaataatgatgctgttctgaagagactggagcatccctcacggtcaacagatcaaatcattgaatatcttaagcagcaagtttctctacttaaggagaaagcaattttgcaggcaaccgactcggaccgatg

SEQ ID NO: 12600 - DNA, 203 bp, Homo sapiens
  source 1..203: mol_type = other DNA
ggcgcgccagtcctggcatgtcgcaaaattctgcctccaaggattttctgccgtctcttggcaaaaatggcaaataatgatgctgttctggctgctaaacccatgaagggtgcagaggcagatcaaatcattgaatatcttaagcagcaagtttctctacttaaggagaaagcaattttgcaggcaaccgactcggaccgatg

SEQ ID NO: 12601 - DNA, 203 bp, Homo sapiens
  source 1..203: mol_type = other DNA
ggcgcgccagtcctaagctcgagcaacgagagagggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagccccgactcggaccgatg

SEQ ID NO: 12602 - DNA, 203 bp, Homo sapiens
  source 1..203: mol_type = other DNA
ggcgcgccagtccttgcgagtagcaagcgttttccccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagtcgactcggaccgatg

SEQ ID NO: 12603 - DNA, 203 bp, Homo sapiens
  source 1..203: mol_type = other DNA
ggcgcgccagtcctggagccgcgcaaggcatatcgcgcctgcgcggtggcccttccatcccggcagtcgtggctgcagcgctgaggcgagaggttggtgggtgtctccggccataatgacccaggctgagaagggtgatacggagaacggaaaggagaagggcggcgagaaggagaaggagcagcgcgcgactcggaccgatg

SEQ ID NO: 12604 - DNA, 203 bp, Homo sapiens
  source 1..203: mol_type = other DNA
ggcgcgccagtcctcgcgactggcaaggcatatcgcgcctgcgcggtggcccttccatcccggcagtcgtggctgcagcgctgaggcgagaggttggtgggtgtctccggccataatgacccaggctgagaagggtgatacggaggcgtaccgcactcggggcggcgagaaggagaaggagcagcgcgcgactcggaccgatg

SEQ ID NO: 12605 - DNA, 203 bp, Homo sapiens
  source 1..203: mol_type = other DNA
ggcgcgccagtccttttgatgagcacacctgtgtaatctaaaattgacatacctaattgattagttagatggaactacagtggattccataaggttcctgcctaccatcggctttaaagaaaaaaataggcccggacgggttagcaacaagcgactgccggtgccaacagcgcaatccacaatctacacgactcggaccgatg

SEQ ID NO: 12606 - DNA, 203 bp, Homo sapiens
  source 1..203: mol_type = other DNA
ggcgcgccagtcctgctaagtagcaccttgccgcgatacgttaaaatatataacgtatttttaaaacttaggaaccaagacaaacacttttggtcttggtattggatcctcaagaaatatatcatcatgagtgatatctttgaagaggcggctagttttaggagttatcaatctaagttagggagagacgactcggaccgatg

SEQ ID NO: 12607 - DNA, 203 bp, Homo sapiens
  source 1..203: mol_type = other DNA
ggcgcgccagtcctaaccagatgcacgtaaccttcagagagtgcggatctgagtaggagacccatcgtggtataactacagatgcagcccggtttaaaaagcgtctatgcccctacagggtagcggtgggccgcgccctttccttttaaaactacttgttctatggtgacaatggcaggaaacatgatcgactcggaccgatg

SEQ ID NO: 12608 - DNA, 203 bp, Homo sapiens
  source 1..203: mol_type = other DNA
ggcgcgccagtcctctcttggggcacgtaaccttcagagagtgcggatctgagtaggagaccgtggtgcactgcttgcgcatcattattgggtttaaaaagcgtctatgcccctacagggtagcggtgggccgcgccctttccttttaaaactacttgttctatggtgacaatggcaggaaacatgatcgactcggaccgatg

SEQ ID NO: 12609 - DNA, 203 bp, Homo sapiens
  source 1..203: mol_type = other DNA
ggcgcgccagtcctttcggcacgcacgtaaccttcagagagtgcggatctgagtaggagaccgtggtgcactgctttacagatgcagcccggtttaaaaagcgttgggcaaagatggtggtagcggtgggccgcgccctttccttttaaaactacttgttctatggtgacaatggcaggaaacatgatcgactcggaccgatg

SEQ ID NO: 12610 - DNA, 203 bp, Homo sapiens
  source 1..203: mol_type = other DNA
ggcgcgccagtcctcacagttcgcagatggggggcttttagccacggtctctggtctgatgaagcagaaaagaagatgaggatcagggggggtagtccttttaggtcacgaatcaatatgttaaggatacctgtaagaaaggccttagtaggcctttctaagtctcctaaaggatgtgttcgaacaaccgactcggaccgatg

SEQ ID NO: 12611 - DNA, 203 bp, Homo sapiens
  source 1..203: mol_type = other DNA
ggcgcgccagtcctacatctgcgcagatggggggcttttagccacggtctctggtctgatgaagcagaaaagaagatgaggatcagggggtcctcgggaacgctgtcacgaatcaatagagcggtacccatagtaagaaaggccttagtaggcctttctaagtctcctaaaggatgtgttcgaacaaccgactcggaccgatg

SEQ ID NO: 12612 - DNA, 203 bp, Homo sapiens
  source 1..203: mol_type = other DNA
ggcgcgccagtcctaagaatgcgcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaaccgactcggaccgatg

SEQ ID NO: 12613 - DNA, 203 bp, Homo sapiens
  source 1..203: mol_type = other DNA
ggcgcgccagtcctaaatcgacgcagcagcgactaagggcgtaaacagttgaggccgtccccgactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 12614 - DNA, 203 bp, Homo sapiens
  source 1..203: mol_type = other DNA
ggcgcgccagtccttgggacaggcagcagcgactcctctgagctgagtagtctcaaacggtggactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 12615 - DNA, 203 bp, Homo sapiens
  source 1..203: mol_type = other DNA
ggcgcgccagtccttccgtaatgcagcagcgactcctctgagctgagtttgaggccgtccccgactccttcctcccccttccctcccccttttttttgttttccgttcccctttcccccgggggtatctcgaccgacgaccggatcctgaggaggcagctgcggtggcagctgctgagttctcggtgacgactcggaccgatg

SEQ ID NO: 12616 - DNA, 203 bp, Homo sapiens
  source 1..203: mol_type = other DNA
ggcgcgccagtcctcgtacgatgcagcagcgactcctctgagctgagtttgaggccgtccccgactccttcctcccccttccctcccccttttttttgttttccgttcccctttcccctcccttccctatccccgacgaccggatcaacgcagactgaaggcggtggcagctgctgagttctcggtgacgactcggaccgatg

SEQ ID NO: 12617 - DNA, 203 bp, Homo sapiens
  source 1..203: mol_type = other DNA
ggcgcgccagtcctgcgggtgggcagcagcgactcctctgagctgagtttgaggccgtccccgactccttcctcccccttccctcccccttttttttgttttccgttcccctttcccctcccttccctatccccgacgaccggatcctgaggaggcagctcgttccattagcagtgagttctcggtgacgactcggaccgatg

SEQ ID NO: 12618 - DNA, 203 bp, Homo sapiens
  source 1..203: mol_type = other DNA
ggcgcgccagtcctgaggcaccgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 12619 - DNA, 203 bp, Homo sapiens
  source 1..203: mol_type = other DNA
ggcgcgccagtcctcagcgtatgcagcagcgactcctctgagctgagtttgaggccgtccccgactccttcctcccccttccctcccccttttttttgttttcctccggaagcgagtgtcccttccctatccccgacgaccggatcctgaggaggcagctgcggtggcagctgctgagttctcggtgacgactcggaccgatg

SEQ ID NO: 12620 - DNA, 203 bp, Homo sapiens
  source 1..203: mol_type = other DNA
ggcgcgccagtcctaacggcccgcagccggccgtgcgcctgcgcggtgagtacatttctttcgcagtcgtggctgcagcgctgaggcgagaggttggtgggtgtctccggccataatgacccaggctgagaagggtgatacggagaacggaaaggagaagggcggcgagaaggagaaggagcagcgcgcgactcggaccgatg

SEQ ID NO: 12621 - DNA, 203 bp, Homo sapiens
  source 1..203: mol_type = other DNA
ggcgcgccagtcctacgactaggcagccggccgtgcgcctgcgcggtggcccttccatcccggcagtcgtggctgcagcgctgaggcgagaggttggtgggtgtctccggccataatgacccaggctgagaaccccagcgattgctacggaaaggagaagggcggcgagaaggagaaggagcagcgcgcgactcggaccgatg

SEQ ID NO: 12622 - DNA, 203 bp, Homo sapiens
  source 1..203: mol_type = other DNA
ggcgcgccagtcctttaggttcgcagccggccgtgcgcctgcgcggtggcccttccatcccggcagtcgtggctgcagcgctgaggcgagaggttggtgggtgtctccggccataatgacccaggctgagaagggtgatacggagagattcctcagaggcggcggcgagaaggagaaggagcagcgcgcgactcggaccgatg

SEQ ID NO: 12623 - DNA, 203 bp, Homo sapiens
  source 1..203: mol_type = other DNA
ggcgcgccagtccttgctatctgcagccggccgtgcgcctgcgcggtggcccttccatcccggcagtcgtggctgccagtaaagacaagtaggttggtgggtgtctccggccataatgacccaggctgagaagggtgatacggagaacggaaaggagaagggcggcgagaaggagaaggagcagcgcgcgactcggaccgatg

SEQ ID NO: 12624 - DNA, 203 bp, Homo sapiens
  source 1..203: mol_type = other DNA
ggcgcgccagtcctgctcagctgcagctgctgctacggctggactcgttcttttccatcagattcatcatcaacagcatggaagcgagaaaccaaacagctatttcaaaattccttctcctgggactgatagaggatccggaactgcagcccgtccttttcagcctgttcctgtccatgtacttggtccgactcggaccgatg

SEQ ID NO: 12625 - DNA, 203 bp, Homo sapiens
  source 1..203: mol_type = other DNA
ggcgcgccagtcctcactgcatgcagctgctgcttacagattttattatcttttccatcagacgacgacgatgattcatggaagcgagaaaccaaacagctatttcaaaattccttctcctgggactgatagaggatccggaactgcagcccgtccttttcagcctgttcctgtccatgtacttggtccgactcggaccgatg

SEQ ID NO: 12626 - DNA, 203 bp, Homo sapiens
  source 1..203: mol_type = other DNA
ggcgcgccagtcctaagggcgtgcagctgctgcttacagattttattatcttttccatcagattcatcatcaacagcatggaagcgagaaaccaaacagctattgaccggagatcctacctgggactgatagaggatccggaactgcagcccgtccttttcagcctgttcctgtccatgtacttggtccgactcggaccgatg

SEQ ID NO: 12627 - DNA, 203 bp, Homo sapiens
  source 1..203: mol_type = other DNA
ggcgcgccagtcctggtaacacgcaggacagccccagcgagcctctggagtccctgtggcagaactcaaatggaagactccaggtactgtcccaggggagcagggtgtcacctccgttggatagagccggccaggttgcagcgcggacacactcgcaggtcgctgtggccccagcctcgcctgacagacgactcggaccgatg

SEQ ID NO: 12628 - DNA, 203 bp, Homo sapiens
  source 1..203: mol_type = other DNA
ggcgcgccagtccttactattcgcaggacagccccagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagacgactcggaccgatg

SEQ ID NO: 12629 - DNA, 203 bp, Homo sapiens
  source 1..203: mol_type = other DNA
ggcgcgccagtcctggctatacgcaggacagccccagcgagcctctggagtccctgtggcagaactcaaatggaaggaggagcagctgcacccaggggagcagggtgtcacctccgttggatagagccggccaggttgcagcgcggacacactcgcaggtgttccaaatatagtcctcgcctgacagacgactcggaccgatg

SEQ ID NO: 12630 - DNA, 203 bp, Homo sapiens
  source 1..203: mol_type = other DNA
ggcgcgccagtcctgatacttggcaggtgttgcaagatactactgtccgggtgtgggcctcgctcaccggcggttggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 12631 - DNA, 203 bp, Homo sapiens
  source 1..203: mol_type = other DNA
ggcgcgccagtcctgcaccagtgcaggtgttgcagatcctgcgccaggcatctcataaagacctcaccggcggttggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 12632 - DNA, 203 bp, Homo sapiens
  source 1..203: mol_type = other DNA
ggcgcgccagtcctgacatcgagcaggtgttgcagatcctgcgccagggggtgtgggcctcgctcaattctaacgggttcttcgacccgcaccagagcaccttctccaactgcttccacctctatgtgtggatcttcctgctcatctttcccttcttactgtacatggtcctgcctcccagcttgatgcgactcggaccgatg

SEQ ID NO: 12633 - DNA, 203 bp, Homo sapiens
  source 1..203: mol_type = other DNA
ggcgcgccagtcctacctagttgcaggtgttgcagatcctgcgccagggggtgtgggcctcgctcaccggcggttgcacaggaccgtaaaaccagagcaccttctccaactgcttccacctctatgtgtggatcttcctgctcatctttcccttcttactgtacatggtcctgcctcccagcttgatgcgactcggaccgatg

SEQ ID NO: 12634 - DNA, 203 bp, Homo sapiens
  source 1..203: mol_type = other DNA
ggcgcgccagtcctcctctccggcaggtgttgcagatcctgcgccagggggtgtgggcctcgctcaccggcggttggttcttcgacccgcaccagagcaccttctccaactgcttccacctctatgtgtggatcttcctgctcatcgaattgggggattcgtacatggtcctgcctcccagcttgatgcgactcggaccgatg

SEQ ID NO: 12635 - DNA, 203 bp, Homo sapiens
  source 1..203: mol_type = other DNA
ggcgcgccagtcctcctacgcagcaggtgttgcagatcctgcgccagggggtgtgggcctcgctcaccggcggttggttcttcgacccgcaccagagcaccttctccaactgcttccacctctatgtgtggatcttcctgctcatctttcccttcttactgtacatggtcctgctgggttcaagaggacgactcggaccgatg

SEQ ID NO: 12636 - DNA, 203 bp, Homo sapiens
  source 1..203: mol_type = other DNA
ggcgcgccagtccttgatctgtgcaggtgttgcagatcctgcgccagggggtgtgggcctcgctcaccggcggttggttcttcgacccgcaccagagcaccttctccaactgcttccacctctatgtgtggatcttcctgctcatctttcccttcttacttgttcgtaggggaactcccagcttgatgcgactcggaccgatg

SEQ ID NO: 12637 - DNA, 203 bp, Homo sapiens
  source 1..203: mol_type = other DNA
ggcgcgccagtcctctgaggctgcaggtgttgcagatcctgcgccagggggtgtgggcctcgctcaccggcggttggttcttcgacccgcaccagagcaccttctccaactgcttccagagagtatgcaacttcttcctgctcatctttcccttcttactgtacatggtcctgcctcccagcttgatgcgactcggaccgatg

SEQ ID NO: 12638 - DNA, 203 bp, Homo sapiens
  source 1..203: mol_type = other DNA
ggcgcgccagtcctcgtgtgccgcaggtgttgcagatcctgcgccagggggtgtgggcctcgctcaccggcggttggttcttcgacccgcctagcgaaggaccgtccaactgcttccacctctatgtgtggatcttcctgctcatctttcccttcttactgtacatggtcctgcctcccagcttgatgcgactcggaccgatg

SEQ ID NO: 12639 - DNA, 203 bp, Homo sapiens
  source 1..203: mol_type = other DNA
ggcgcgccagtccttcccgagggcataatctcctgaatcccgggtttgccatttaatcatacaacatccacacgggagacaccttctacttccccaacttccgcgcgtccggggcgcagcttcccgggctgccttcgctgtcctacccacgccgcgacaacgtgtgctccctgtcctggccgtcggcgcgactcggaccgatg

SEQ ID NO: 12640 - DNA, 203 bp, Homo sapiens
  source 1..203: mol_type = other DNA
ggcgcgccagtcctaaactagggcataatctcctgaatcccgggtttgtggggccgctggtaaacatccacacgggagacaccttcccacaagccaacttccgcgcgtccggggcgcagcttcccgggctgccttcgctgtcctacccacgccgcgacaacgtgtgctccctgtcctggccgtcggcgcgactcggaccgatg

SEQ ID NO: 12641 - DNA, 203 bp, Homo sapiens
  source 1..203: mol_type = other DNA
ggcgcgccagtccttggcgccggcataatctcctgaatcccgggtttgtggggccgctggtaaacatccacacgggagacaccttctacttccccaacttccgcatcgtatccctatggcttcccgggctgccttcgctgtcctacccacgccgcgacaacgtgtgctccctgtcctggccgtcggcgcgactcggaccgatg

SEQ ID NO: 12642 - DNA, 203 bp, Homo sapiens
  source 1..203: mol_type = other DNA
ggcgcgccagtccttagcaactgcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgacacgattgtcctggccgtcggcgcgactcggaccgatg

SEQ ID NO: 12643 - DNA, 203 bp, Homo sapiens
  source 1..203: mol_type = other DNA
ggcgcgccagtcctaatccgaggcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcgcgactcggaccgatg

SEQ ID NO: 12644 - DNA, 203 bp, Homo sapiens
  source 1..203: mol_type = other DNA
ggcgcgccagtcctcggcagcggcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtgtgacgatcgtcttcgactcggaccgatg

SEQ ID NO: 12645 - DNA, 203 bp, Homo sapiens
  source 1..203: mol_type = other DNA
ggcgcgccagtcctgttcatacgcataatctcctgaatcccgggtttgtggggccgctggtaaacatccacacgggagacaccttctacttccccaacttccgcgcgtccggggcgcagcttcccgggctgccttcgctgtcctactgcatggcgttgtgcgtgtgctccctgtcctggccgtcggcgcgactcggaccgatg

SEQ ID NO: 12646 - DNA, 203 bp, Homo sapiens
  source 1..203: mol_type = other DNA
ggcgcgccagtcctcaaccaccgcataatctcctgaatcccgggtttgtggggccgctggtaaacatccacacgggagacaccttctacttccccaacttccgcgcgtccggggcgcagcttcccgggctgcggcaagctaagctgccacgccgcgacaacgtgtgctccctgtcctggccgtcggcgcgactcggaccgatg

SEQ ID NO: 12647 - DNA, 203 bp, Homo sapiens
  source 1..203: mol_type = other DNA
ggcgcgccagtcctggacgttcgcatacccaataaaagattattatatgtagccgtgtaccataataaaatacattgcataccctcttttaataaaaaatattgcatacgttgacgaaacaaattttcgttgcatacccaataaaagattattatattgcataccttttcttgccataccatttagcccgactcggaccgatg

SEQ ID NO: 12648 - DNA, 203 bp, Homo sapiens
  source 1..203: mol_type = other DNA
ggcgcgccagtcctagtggccagcatacccaataaaagattattatattgcatacccgtttttaataaaatacattcgggcgagcggacaaataaaaaatattgcatacgttgacgaaacaaattttcgttgcatacccaataaaagattattatattgcataccttttcttgccataccatttagcccgactcggaccgatg

SEQ ID NO: 12649 - DNA, 203 bp, Homo sapiens
  source 1..203: mol_type = other DNA
ggcgcgccagtccttcatcatcgcatgttacagaaaagcaccggttacccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12650 - DNA, 203 bp, Homo sapiens
  source 1..203: mol_type = other DNA
ggcgcgccagtcctccttagaggcatgttacagagaattgataatatgccagcttggagacaacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12651 - DNA, 203 bp, Homo sapiens
  source 1..203: mol_type = other DNA
ggcgcgccagtcctcactttccgcatgttacagatttcacctggtgaaccagcttggagacaacatgtgggaacgccgctgtctgctcctttggggctggctactactgcaggtctccagcagagtcttcatggaaggagaacctctggccttgaggtgtcatgcgtggaaggataagctggtgtacacgactcggaccgatg

SEQ ID NO: 12652 - DNA, 203 bp, Homo sapiens
  source 1..203: mol_type = other DNA
ggcgcgccagtcctgagtgacggcatgttacagatttcacctggtgaaccagcttggagacaacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12653 - DNA, 203 bp, Homo sapiens
  source 1..203: mol_type = other DNA
ggcgcgccagtccttggccctagcatgttacagatttcactactcccaagtcgaactctcgtacatgtggttcttgacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12654 - DNA, 203 bp, Homo sapiens
  source 1..203: mol_type = other DNA
ggcgcgccagtcctggcctatggcatgttacagatttcactactcccaccagcttggagacaacatgtggcaaacacgtcatctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12655 - DNA, 203 bp, Homo sapiens
  source 1..203: mol_type = other DNA
ggcgcgccagtcctctggaagggcatgttacagatttcactactcccaccagcttggagacaacatgtggttcttgacaactctgctcctacaacgagggtagcatgggcaagtggacaccacaaaggcagtgatcactttgcagcctccatgggtcagcgtgttccaagaggaaaccgtaaccttgccgactcggaccgatg

SEQ ID NO: 12656 - DNA, 203 bp, Homo sapiens
  source 1..203: mol_type = other DNA
ggcgcgccagtccttcgggcttgcatgttacagatttcactactcccaccagcttggagacaacatgtggttcttgacaactctgctcctttggggctggctactactgcaggtctccagcagagtcttcatggaaggagaacctctggccttgaggtgtcatgcgtggaaggaagctagaaccgcttcgactcggaccgatg

SEQ ID NO: 12657 - DNA, 203 bp, Homo sapiens
  source 1..203: mol_type = other DNA
ggcgcgccagtcctaggatgccgcatgttacagatttcactactcccaccagcttggagacaacatgtggttcttgacaactctgctcctttggggctggctactactgcaggtctcccatgttcagcattgggaaggagaacctctggccttgaggtgtcatgcgtggaaggataagctggtgtacacgactcggaccgatg

SEQ ID NO: 12658 - DNA, 203 bp, Homo sapiens
  source 1..203: mol_type = other DNA
ggcgcgccagtcctggagatcggcatgttacagatttcactactcccaccagcttggagacaacatgtggttcttgacaactctgctcctttgggttccagttgatgggcaagtggacaccacaaaggcagtttctgggggcgccgctccatgggtcagcgtgttccaagaggaaaccgtaaccttgccgactcggaccgatg

SEQ ID NO: 12659 - DNA, 203 bp, Homo sapiens
  source 1..203: mol_type = other DNA
ggcgcgccagtcctagaggtccgcatgttacagatttcactactcccaccagcttggagacaacatgtggttcttgctcgggaccaatgcttggggctggctactactgcaggtctccagcagagtcttcatggaaggagaacctctggccttgaggtgtcatgcgtggaaggataagctggtgtacacgactcggaccgatg

SEQ ID NO: 12660 - DNA, 203 bp, Homo sapiens
  source 1..203: mol_type = other DNA
ggcgcgccagtcctggcgcattgcatgttacagatttcactactcccaccagcttggagacacggctccccgggacacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12661 - DNA, 203 bp, Homo sapiens
  source 1..203: mol_type = other DNA
ggcgcgccagtccttcggtagggcatgttacagatttcactactcccaccagcttggagacatgtccacaaggcccacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 12662 - DNA, 203 bp, Homo sapiens
  source 1..203: mol_type = other DNA
ggcgcgccagtcctcgttgtgtgcatgttacagatttcactactcccaggtataaactatggacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 12663 - DNA, 203 bp, Homo sapiens
  source 1..203: mol_type = other DNA
ggcgcgccagtccttagaaggggcattctgtgtttgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 12664 - DNA, 203 bp, Homo sapiens
  source 1..203: mol_type = other DNA
ggcgcgccagtccttcggcccagcattgcccccaaatgaggaggggggtgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 12665 - DNA, 203 bp, Homo sapiens
  source 1..203: mol_type = other DNA
ggcgcgccagtcctgaattaatgcattgcccccagtctcccccaaatttgggcattgtccccgggtcttccaacggactgggcgttgctcccggacactgaggactggccccggggtctcgctcaccttcagcagcgtccaccgccgcttgatccctaagcgatcgctcgctgcctgagctcctggtgcgactcggaccgatg

SEQ ID NO: 12666 - DNA, 203 bp, Homo sapiens
  source 1..203: mol_type = other DNA
ggcgcgccagtcctgcgggatcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgctgtgtagaaaatcacgactcggaccgatg

SEQ ID NO: 12667 - DNA, 203 bp, Homo sapiens
  source 1..203: mol_type = other DNA
ggcgcgccagtcctttcattaagccaaggaacttcagtgctgtgaactcacaactctaaggacgtggtttttcactcagtctccaggtgctgttactcaactcagtcctaggaacgtcgggtcctgggaaggagcccaagcgctcccagccagcttccaggcgctaagaaaccccggtgcttcccatccgactcggaccgatg

SEQ ID NO: 12668 - DNA, 203 bp, Homo sapiens
  source 1..203: mol_type = other DNA
ggcgcgccagtcctaacgttcagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaacccttcattccgaaggtcgactcggaccgatg

SEQ ID NO: 12669 - DNA, 203 bp, Homo sapiens
  source 1..203: mol_type = other DNA
ggcgcgccagtcctgctagtatgccaaggaacttcagtgctgtgaactcacaactctaaggagccctccaaagttccagtctccaggtgctgttactcaactcagtcctaggaacgtcgggtcctgggaaggcaggattttttggacagccagcttccaggcgctaagaaaccccggtgcttcccatccgactcggaccgatg

SEQ ID NO: 12670 - DNA, 203 bp, Homo sapiens
  source 1..203: mol_type = other DNA
ggcgcgccagtcctaagcctcggccacccctcctagtctagtcgtgtaggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtcgactcggaccgatg

SEQ ID NO: 12671 - DNA, 203 bp, Homo sapiens
  source 1..203: mol_type = other DNA
ggcgcgccagtcctgttggcatgccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagccgtagcttactagttcaaattctagcagtcgactcggaccgatg

SEQ ID NO: 12672 - DNA, 203 bp, Homo sapiens
  source 1..203: mol_type = other DNA
ggcgcgccagtccttctggagcgccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccaacctaatacaagtgcgactcggaccgatg

SEQ ID NO: 12673 - DNA, 203 bp, Homo sapiens
  source 1..203: mol_type = other DNA
ggcgcgccagtccttccgcgaagccacccctcctgcgtctccacaaatggtccgacccgcaagcaagggggcgggtccggctttgaaaagccggcgggtcgggctggaccaccccttacgggaaaatggcggattcctcggggcgaggcgctgggaagcctgcaaccggccccacaaattctagcagtcgactcggaccgatg

SEQ ID NO: 12674 - DNA, 203 bp, Homo sapiens
  source 1..203: mol_type = other DNA
ggcgcgccagtcctacagccaagccacccctcctgcgtctccacaaatggtccgacccgcaagcaagggggcgggtccggctttgaaaagggcaataagtaatacttgaggtggaaggcgggaaaatggcggattcctcggggcgaggcgctgggaagcctgcaaccggccccacaaattctagcagtcgactcggaccgatg

SEQ ID NO: 12675 - DNA, 203 bp, Homo sapiens
  source 1..203: mol_type = other DNA
ggcgcgccagtcctcccttgcagccacctccggtcggcgactgcggcgggctcgacgaggcgagccttcttcgcttggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 12676 - DNA, 203 bp, Homo sapiens
  source 1..203: mol_type = other DNA
ggcgcgccagtcctcttaccgtgccacctccggtcggcgactgcggcgggctcgacgaggcggctgacggggcggcggcgggaagacggcactagcatggcgttggtttagtggcggcttctccatgggtccagccagccgcttccctgtgctgtgagtgtttccaccactccaggagacagcattcacgactcggaccgatg

SEQ ID NO: 12677 - DNA, 203 bp, Homo sapiens
  source 1..203: mol_type = other DNA
ggcgcgccagtcctcctttcacgccacctccggtcggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 12678 - DNA, 203 bp, Homo sapiens
  source 1..203: mol_type = other DNA
ggcgcgccagtcctaacgatttgccacctccggtcggcgactgcggcgggctcgacgaggcggctgacggggcggcggcgggaagacggccgggtgcgccttggggtttagtggcggcttctccatgggtccagccagccgcttccgcagcggcgtttgctttccaccactccaggagacagcattcacgactcggaccgatg

SEQ ID NO: 12679 - DNA, 203 bp, Homo sapiens
  source 1..203: mol_type = other DNA
ggcgcgccagtcctaccatcaagccacctccggtcggcgactgcggcgtaagtctacctaatgctgacggggcggcggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 12680 - DNA, 203 bp, Homo sapiens
  source 1..203: mol_type = other DNA
ggcgcgccagtcctgaatcctcgccaggaacgattactattcttggttctctggaattactcagtttcaaaagggaaaggagtttgagtttgtagaaggacaaggtgtgcctattgcaccaggagtcccagctactgaagctaaggggtactggtacagacacaacagacgttcttttaaaacagccgcgactcggaccgatg

SEQ ID NO: 12681 - DNA, 203 bp, Homo sapiens
  source 1..203: mol_type = other DNA
ggcgcgccagtcctaatcgtgtgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctccggctgttaaaggacgactcggaccgatg

SEQ ID NO: 12682 - DNA, 203 bp, Homo sapiens
  source 1..203: mol_type = other DNA
ggcgcgccagtcctggagtagtgccaggacgaccgggtcctttcttggataaacccgctcaatgcctggagatttgggcgtgcccccgcatccacttattaaaggtagtgttgggtcgcgaaaggccttgtggtactgcctgatagggtgcttgcgagtgccccgggaggtctcgtagaccgtgcacccgactcggaccgatg

SEQ ID NO: 12683 - DNA, 203 bp, Homo sapiens
  source 1..203: mol_type = other DNA
ggcgcgccagtcctctgtgaaggccaggacgaccgggtcctttcttggtccgcggtcaggcgtgcctggagatttgggcgtgcccccgcaagactgctagccgagtagtgttgggtcgcgaaaggccttgtggtactgcctgatagggtgcttgcgagtgccccgggaggtctcgtagaccgtgcacccgactcggaccgatg

SEQ ID NO: 12684 - DNA, 203 bp, Homo sapiens
  source 1..203: mol_type = other DNA
ggcgcgccagtcctgcagtcgagccatggtaagcatatgaattgaatcaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactcgactcggaccgatg

SEQ ID NO: 12685 - DNA, 203 bp, Homo sapiens
  source 1..203: mol_type = other DNA
ggcgcgccagtccttgaggtgggccatggtaagcgcggacgccatggtaagcgcggacgccatggtaagcgcggacgccatggtaagcgcggacgccatggtaagcgcggacgccatgcattcactattgaacatggtaagcgcggacgccatggtaagcgcggacgccatgcacacggaccctgactcgactcggaccgatg

SEQ ID NO: 12686 - DNA, 203 bp, Homo sapiens
  source 1..203: mol_type = other DNA
ggcgcgccagtcctttgcgctcgccatggtaagcgcggacgccatggtaagcgcggacgccatggtaagcgcggacgccatggtaagcgcggacgccatggtaagcgcggacgccatggtaagcgcggacgccatggtaagcgcggtaaagcctagggatgcggacgccatgcacacggaccctgactcgactcggaccgatg

SEQ ID NO: 12687 - DNA, 203 bp, Homo sapiens
  source 1..203: mol_type = other DNA
ggcgcgccagtcctgtcctacagccatggtaagcgcggacgccatggtaagcgcggacgccatggtaagcgcggacgccatggtaagcgcggacgccatggtaagcgcggacgccatggtaagcgcggacgctgatcattcaagcaacgccatggtaagcgcggacgccatgcacacggaccctgactcgactcggaccgatg

SEQ ID NO: 12688 - DNA, 203 bp, Homo sapiens
  source 1..203: mol_type = other DNA
ggcgcgccagtcctaagtgctcgcccacgtacggtccacgtcgcccttcaatgtctctcttgaccaataggcgtagccggcgagttgacaaggaccagtgggggccgggcgggaggggacgcctgttgtgaagctgcccttcccggggaggcgggaaatgcatggggccacccagctccgcggcggcccgactcggaccgatg

SEQ ID NO: 12689 - DNA, 203 bp, Homo sapiens
  source 1..203: mol_type = other DNA
ggcgcgccagtcctacatggaggcccacgtacggtccacgtcgcccttcaatgtctctcttgaccaataggcgtagccggcgagttgacaaggaccagtgggggccgggcgggagggggaaggacccccaccgctgcccttcccggggaggcgggaaatgcatggggccacccagctccgcggcggcccgactcggaccgatg

SEQ ID NO: 12690 - DNA, 203 bp, Homo sapiens
  source 1..203: mol_type = other DNA
ggcgcgccagtcctgtgagtacgcccacgtacggtccacgtcgcccttcaatgtctctcttgaccaataggcgtagccggcgagttgacaaggaccagtggggggttacgatattaacgaaggacccccaccgctgcccttcccggggaggcgggaaatgcatggggccacccagctccgcggcggcccgactcggaccgatg

SEQ ID NO: 12691 - DNA, 203 bp, Homo sapiens
  source 1..203: mol_type = other DNA
ggcgcgccagtcctagctggatgcccacgtacggtccacgtcgcccttcaatgtctctcttgaccaataggcgtagccggcgagttgacacttgtattaattctccgggcgggagggggaaggacccccaccgctgcccttcccggggaggcgggaaatgcatggggccacccagctccgcggcggcccgactcggaccgatg

SEQ ID NO: 12692 - DNA, 203 bp, Homo sapiens
  source 1..203: mol_type = other DNA
ggcgcgccagtcctcagggtgcgcccattccctgaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaacgactcggaccgatg

SEQ ID NO: 12693 - DNA, 203 bp, Homo sapiens
  source 1..203: mol_type = other DNA
ggcgcgccagtcctaacagagcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaaacaccagtaaggcgcacagtaggaactccgactcggaccgatg

SEQ ID NO: 12694 - DNA, 203 bp, Homo sapiens
  source 1..203: mol_type = other DNA
ggcgcgccagtcctcttgcgttgccccactgcgcatggcacgttgcgtactcccctcccagcaaccggtctggcggcggcgcggcagtaacctgacaacttaccagccaagacggtcggggctgcttgctaactccaggaacaggtttaagtttttgaaactgaagtaggcctacacagtaggaactccgactcggaccgatg

SEQ ID NO: 12695 - DNA, 203 bp, Homo sapiens
  source 1..203: mol_type = other DNA
ggcgcgccagtcctccgaacttgccccactgcgcatggcacgttgcgtactcccctcccagcaaccggtctggcggtctgtaacggactgaactgaggaggcggagccaagacggtcggggctgcttgctaactccaggaacaggtttaagtttttgaaactgaagtaggcctacacagtaggaactccgactcggaccgatg

SEQ ID NO: 12696 - DNA, 203 bp, Homo sapiens
  source 1..203: mol_type = other DNA
ggcgcgccagtcctaatgagaagccccactgcgccatagtacaattcaactcccctcccagcaaccggtctggcggcggcgcggcagtaaaactgaggaggcggagccaagacggtcggggctgcttgctaactccaggaacaggtttaagtttttgaaactgaagtaggcctacacagtaggaactccgactcggaccgatg

SEQ ID NO: 12697 - DNA, 203 bp, Homo sapiens
  source 1..203: mol_type = other DNA
ggcgcgccagtcctcacgctgggccccctggctggttcggtgtcttttactggtaacgcccatgctcccagggggccctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 12698 - DNA, 203 bp, Homo sapiens
  source 1..203: mol_type = other DNA
ggcgcgccagtcctcgtcagtagccccctggctggttcggtgtcttttgacctgctgttgacgagagggttttccgcctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 12699 - DNA, 203 bp, Homo sapiens
  source 1..203: mol_type = other DNA
ggcgcgccagtcctttaaggaggccccctggctggttcggtgtcttttgacctgctgttgactgctcccagggggccctgacgccctggggcacttttgctctgacggaagagtactcggggtttgccatggtgacataaaggggtgtagaggaaggaaggagcaagaccagcctgtagactgtgccccgactcggaccgatg

SEQ ID NO: 12700 - DNA, 203 bp, Homo sapiens
  source 1..203: mol_type = other DNA
ggcgcgccagtcctttgggactgccccctggctggttcggtgtcttttgacctgctgttgactgctcccagggggccctgacgccctggggcacttttgctctgcacaggaccacgctggggtttgccatggtgacataaaggggtcactttcgtcacgagagcaagaccagcctgtagactgtgccccgactcggaccgatg

SEQ ID NO: 12701 - DNA, 203 bp, Homo sapiens
  source 1..203: mol_type = other DNA
ggcgcgccagtcctgggtagaagccccctggctggttcggtgtcttttgacctgctgttgactgctcccagggggccctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 12702 - DNA, 203 bp, Homo sapiens
  source 1..203: mol_type = other DNA
ggcgcgccagtcctaagatcacgccccgacccgtgggtcccggccaccagcgccccagccccgaggctcagaagcggcaggcggaggcggggtccgggcgctatggccatgcccggcgggtctcacgcggctgcccctcgccccgcgcgccttcggtaggaccatgtgctttatcagctggcccggcccgactcggaccgatg

SEQ ID NO: 12703 - DNA, 203 bp, Homo sapiens
  source 1..203: mol_type = other DNA
ggcgcgccagtcctaggatagagccccgcctcctgcaggcggcccggccaccaacagcatgtcggtgcatggtggggcggtctccttcggcaaccccggccgaacggccacccagaggctgtgctgagctggcgcagcggcagcagcatgagccggaccctcgcatcggccgtgcccctgtcgagtcccgactcggaccgatg

SEQ ID NO: 12704 - DNA, 203 bp, Homo sapiens
  source 1..203: mol_type = other DNA
ggcgcgccagtcctatatgaacgccccgcctcctgcaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgagaaaagacctcgacgactcggaccgatg

SEQ ID NO: 12705 - DNA, 203 bp, Homo sapiens
  source 1..203: mol_type = other DNA
ggcgcgccagtcctgccgtcctgcccgactcgccctcagaaactcactcccccatcgacgcaactttctcgtcgtgccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12706 - DNA, 203 bp, Homo sapiens
  source 1..203: mol_type = other DNA
ggcgcgccagtcctcagtacaggcccgactcgccctcagaaactcactgtttggggctgcggactttctcgtcgtgccccacaaaagtaaagcttggggacctgattatcaattaggttatcgcttcgagatccccaaatactatcggggaaacggaagtggccgtcggtggcagagacctgtcggcccgactcggaccgatg

SEQ ID NO: 12707 - DNA, 203 bp, Homo sapiens
  source 1..203: mol_type = other DNA
ggcgcgccagtcctttggaatcgcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12708 - DNA, 203 bp, Homo sapiens
  source 1..203: mol_type = other DNA
ggcgcgccagtcctacggttatgcccgactcgccctcagaaactcactgtttggggctgcggcgaccgctaggcctccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12709 - DNA, 203 bp, Homo sapiens
  source 1..203: mol_type = other DNA
ggcgcgccagtccttgctcaaagcccgactcgccggtcttgtggtctagtttggggctgcggactttctcgtcgtgccccacaaaagtaaagcttggggacctggggggagccggaagtatcgcttcgagatccccaaatactatcggggaaacggaagtggccgtcggtggcagagacctgtcggcccgactcggaccgatg

SEQ ID NO: 12710 - DNA, 203 bp, Homo sapiens
  source 1..203: mol_type = other DNA
ggcgcgccagtccttgaatacggcccggaaccacaactatagttctcagcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccgactcggaccgatg

SEQ ID NO: 12711 - DNA, 203 bp, Homo sapiens
  source 1..203: mol_type = other DNA
ggcgcgccagtccttcaactgggcccggaaccacgtgatgcaggaggtctaaataaacctttggctcgcgcgggtggagccgcctcggcgttcgagcggggtgggggctgcccggttgagatttcccggcgggtcccggcctctgcgtgcacgcgcctgcgtgctcgcgctcgcggttctggcgctgccgactcggaccgatg

SEQ ID NO: 12712 - DNA, 203 bp, Homo sapiens
  source 1..203: mol_type = other DNA
ggcgcgccagtcctaaccgtaagcccggaaccacgtgatgcaggaggtgcccgaggcggcggggctcgcgcgggtggagccgcctcggcgcaatgcaacaccccgggctgcccggttgagatttcccggcgggtcccggcctctgcgtgcacgcgcctgcgtgctcgcgctcgcggttctggcgctgccgactcggaccgatg

SEQ ID NO: 12713 - DNA, 203 bp, Homo sapiens
  source 1..203: mol_type = other DNA
ggcgcgccagtcctcgtcttgcgcccggaaccacgtgatgcaggaggtgcccgaggcggcggggctcgcgcgggtggagccgcctcggcgttcgagcggggtgggggctgcccggttgagatttcccggcgggtcccggcctctgcactacgcatagctagtgctcgcgctcgcggttctggcgctgccgactcggaccgatg

SEQ ID NO: 12714 - DNA, 203 bp, Homo sapiens
  source 1..203: mol_type = other DNA
ggcgcgccagtcctccaaccaggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcagttgtcattgactggttctggcgctgccgactcggaccgatg

SEQ ID NO: 12715 - DNA, 203 bp, Homo sapiens
  source 1..203: mol_type = other DNA
ggcgcgccagtcctaggccaaggcccggaaccacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccgactcggaccgatg

SEQ ID NO: 12716 - DNA, 203 bp, Homo sapiens
  source 1..203: mol_type = other DNA
ggcgcgccagtcctgcgttctggcccggaaccacgtgatgcaggaggtgcccgaggcggcggggctcgcgcgggtggagccgcctcggcgttcgagcggggtggttatgtgagttcccagatttcccggcgggtcccggcctctgcgtgcacgcgcctgcgtgctcgcgctcgcggttctggcgctgccgactcggaccgatg

SEQ ID NO: 12717 - DNA, 203 bp, Homo sapiens
  source 1..203: mol_type = other DNA
ggcgcgccagtcctgtcgatccgccctcacgctcagcaccccagcctgcctgcccgcccgcctgccctgccgctgcatatgacgggcttgtgtagcgcgggagcttctcgcagcgccccgggccttctcgtggtaccctgcctgctgcctttgcccccgcactgactgcccggctccagcagccatggcgactcggaccgatg

SEQ ID NO: 12718 - DNA, 203 bp, Homo sapiens
  source 1..203: mol_type = other DNA
ggcgcgccagtcctggcccgctgccctcacgctcagcaccccagcctgcctgcccgcccgcctgccctgccgctgcccgctgtcacaccctgtagcgcgggagcgctctaatcaagggcgggccttctcgtggtaccctgcctgctgcctttgcccccgcactgactgcccggctccagcagccatggcgactcggaccgatg

SEQ ID NO: 12719 - DNA, 203 bp, Homo sapiens
  source 1..203: mol_type = other DNA
ggcgcgccagtcctccagtatggccctcacgctcagcaccccagcctgcctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggcgactcggaccgatg

SEQ ID NO: 12720 - DNA, 203 bp, Homo sapiens
  source 1..203: mol_type = other DNA
ggcgcgccagtcctcggccgttgccctcacgctcagcaccccagcctgcctgcccgcccgcctgccctgccgctgcccgctgtcacaccctgtagcgcgggagcttctcgcagcgcccttaatgcatataatgtaccctgcctgctgcctttgcccccgcactgactgcccggctccagcagccatggcgactcggaccgatg

SEQ ID NO: 12721 - DNA, 203 bp, Homo sapiens
  source 1..203: mol_type = other DNA
ggcgcgccagtccttccaaggcgccctcacgctcagcaccccagcctgtacctttcgtgtggtgccctgccgctgcccgctgtcacaccctgtagcgcgggagcttctcgcagcgccccgggccttctcgtggtaccctgcctgctgcctttgcccccgcactgactgcccggctccagcagccatggcgactcggaccgatg

SEQ ID NO: 12722 - DNA, 203 bp, Homo sapiens
  source 1..203: mol_type = other DNA
ggcgcgccagtcctgttatccagccctcacgctctcgcttgagtgagccctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggcgactcggaccgatg

SEQ ID NO: 12723 - DNA, 203 bp, Homo sapiens
  source 1..203: mol_type = other DNA
ggcgcgccagtcctgagcgcacgccgattgatgtggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagcgaattggattggcccgactcggaccgatg

SEQ ID NO: 12724 - DNA, 203 bp, Homo sapiens
  source 1..203: mol_type = other DNA
ggcgcgccagtcctccaggctagccgcagtcagactggtatcagctcgcccctctgagtcaggaaacattttcagacctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 12725 - DNA, 203 bp, Homo sapiens
  source 1..203: mol_type = other DNA
ggcgcgccagtcctacgtcagggccgcagtcagatcctagcgtcgagccccctctgagtcaggaaacattttcagaatggaaccgtagttttcctgaaaacaacgttctgtcccccttgccgtcccaagcaatggatgatttgatgctgtccccggacgatattgaacaatggttcactgaagacccacgactcggaccgatg

SEQ ID NO: 12726 - DNA, 203 bp, Homo sapiens
  source 1..203: mol_type = other DNA
ggcgcgccagtcctgctgggcggccgcagtcagatcctagcgtcgagccccctctgagtcaggaaacattttcagacctatggaaactacgcaggtttgcggcggttctgtcccccttgccgtcccaagcaatggatgatttgatgctgtccccggacgatattgaacaatggttcactgaagacccacgactcggaccgatg

SEQ ID NO: 12727 - DNA, 203 bp, Homo sapiens
  source 1..203: mol_type = other DNA
ggcgcgccagtcctcgtggaaggccgcagtcagatcctagcgtcgagccccctctgagtcaggaaacattttcagacctatggaaactacttcctgaaaacaacgttctgtcccccttcggaataaggaaggtggatgatttgatgctgtccccggacgatattgaacaatggttcactgaagacccacgactcggaccgatg

SEQ ID NO: 12728 - DNA, 203 bp, Homo sapiens
  source 1..203: mol_type = other DNA
ggcgcgccagtcctagcttcccgccgcagtcagatcctagcgtcgagccccctctgagtcaggaaacattttcagacctatggaaactacttcctgaaaacaacgttctgtcccccttgccgtcccaagcaatggatgatttgatgctgtccccggacgactaactgaccgttctcactgaagacccacgactcggaccgatg

SEQ ID NO: 12729 - DNA, 203 bp, Homo sapiens
  source 1..203: mol_type = other DNA
ggcgcgccagtcctcagattaggccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggtgagggccgtcaagccgactcggaccgatg

SEQ ID NO: 12730 - DNA, 203 bp, Homo sapiens
  source 1..203: mol_type = other DNA
ggcgcgccagtcctgagtaaacgccgcagtcagatcctagcgtcgagccccctctgagtcagtctgaggaaatgttcctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 12731 - DNA, 203 bp, Homo sapiens
  source 1..203: mol_type = other DNA
ggcgcgccagtccttcgtagccgccgcggcagccgaagcgcagcgagagaacgcgccaccgcggggcccgggtgcaatagagatttggtacgccacctgcgcgcagcccgaggtgagcagtgagcggcgagcgggagggcagcgaggcgttcgcgggccccctcctgctgcccgggcccggcccgctccgactcggaccgatg

SEQ ID NO: 12732 - DNA, 203 bp, Homo sapiens
  source 1..203: mol_type = other DNA
ggcgcgccagtccttagtgaatgccgcggcagccgaagcgcagcgagagaacgcgccaccgcggggcccgggtgcagctagcgaccctctcgccacctgcgcgcagcccgaggtgagcagtgagcggcgagccttccctgccgtcagcgttcgcgggccccctcctgctgcccgggcccggcccgctccgactcggaccgatg

SEQ ID NO: 12733 - DNA, 203 bp, Homo sapiens
  source 1..203: mol_type = other DNA
ggcgcgccagtcctctaaatgtgccgcggggggtcaggtcagcttctaggcgtgcgctcccgacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 12734 - DNA, 203 bp, Homo sapiens
  source 1..203: mol_type = other DNA
ggcgcgccagtcctccagtggtgccgcggggggtggaccgcctaagagggcgtgcgctcccgacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 12735 - DNA, 203 bp, Homo sapiens
  source 1..203: mol_type = other DNA
ggcgcgccagtccttatccatggccgcggggggtggaccgcctaagagggcgtgcgctcccgacatgccccgccgcgcgccattaaccgccagatttgaatcgcgggacccgttggcagaggtggcggcggcggcatgggtgccccgacgttgccccctgcctggcagcccttttagtgcttaatgaccgactcggaccgatg

SEQ ID NO: 12736 - DNA, 203 bp, Homo sapiens
  source 1..203: mol_type = other DNA
ggcgcgccagtccttaacacgtgccgcggggggtggaccgcctaagagggcgtgcgctcccgacatgccccgccgcgcgccattaaccgctgaccgattcagttgggacccgttggcagaggtggcggcggcggcatgggtgccccgacgttgccccctgcctggcagccctttctcaaggaccaccgcgactcggaccgatg

SEQ ID NO: 12737 - DNA, 203 bp, Homo sapiens
  source 1..203: mol_type = other DNA
ggcgcgccagtcctcttggtacgccgcggggggtggaccgcctaagagggcgtgcgctcccgacatgccccgcggcctcagggctgtttgcagatttgaatcgcgggacccgttggcagaggtggcggcggcggcatgggtgccccgacgttgccccctgcctggcagccctttctcaaggaccaccgcgactcggaccgatg

SEQ ID NO: 12738 - DNA, 203 bp, Homo sapiens
  source 1..203: mol_type = other DNA
ggcgcgccagtcctccgcaggtgccgcggggggtggaccgcctaagagttttctaagatttcacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 12739 - DNA, 203 bp, Homo sapiens
  source 1..203: mol_type = other DNA
ggcgcgccagtcctatatctaagccgctcaccccgccgttctcagcgcattatcgtagatgccgcgcgccctcccgccgccagtcccggcagcgccctcagttgtcctccgactcgccctcggccttccgcgccagccgcagccacagccgcaacgccacccgcagccacagccacagccacagcccccgactcggaccgatg

SEQ ID NO: 12740 - DNA, 203 bp, Homo sapiens
  source 1..203: mol_type = other DNA
ggcgcgccagtccttacaggcagccgctcaccccgccgttctcagcgctgcccgaccccgctaatctattactgtaccgccagtcccggcagcgccctcagttgtcctccgactcgccctcggccttccgcgccagccgcagccacagccgcaacgccacccgcagccacagccacagccacagcccccgactcggaccgatg

SEQ ID NO: 12741 - DNA, 203 bp, Homo sapiens
  source 1..203: mol_type = other DNA
ggcgcgccagtcctatttatgtgccgctcaccccgccgttctcagcgctgcccgaccccgctcgcgcgccctcccgccgccagtcccggcagcgccctcagttgattattataatattctcggccttccgcgccagccgcagccacagccgcaacgccacccgcagccacagccacagccacagcccccgactcggaccgatg

SEQ ID NO: 12742 - DNA, 203 bp, Homo sapiens
  source 1..203: mol_type = other DNA
ggcgcgccagtccttagatttcgccgctcaccccgccgttctcagcgctgcccgaccccgctcgcgcgccctcccgccgccagtcccggcagcgccctcagttgtcctccgactcgccctcggccttccgcgccagccgcagccacagccgcaacgccacttagtttgttgttaacagccacagcccccgactcggaccgatg

SEQ ID NO: 12743 - DNA, 203 bp, Homo sapiens
  source 1..203: mol_type = other DNA
ggcgcgccagtcctatagcgtagccgctcaccccgccgttctcagcgctgcccgaccccgctcgcgcgccctcccgccgccagtcccggcagcgccctcagttgtcctccgactcgccctcggccttccgcgccagccgcagccactaaacactgtttgtccgcagccacagccacagccacagcccccgactcggaccgatg

SEQ ID NO: 12744 - DNA, 203 bp, Homo sapiens
  source 1..203: mol_type = other DNA
ggcgcgccagtcctcataacgcgccgctcaccccgccgttctcagcgctgcccgaccccgctcgcgcgccctcccgccgccagtcccggcagcgccctcagttgtcctccgactcgccctcggccttccgcgtattttcagcaactagccgcaacgccacccgcagccacagccacagccacagcccccgactcggaccgatg

SEQ ID NO: 12745 - DNA, 203 bp, Homo sapiens
  source 1..203: mol_type = other DNA
ggcgcgccagtcctgtcgcagcgccgctcaccccgccgttctcagcgctgcccgaccccgctcgcgcgccctcccgttaagtccgggttgagcgccctcagttgtcctccgactcgccctcggccttccgcgccagccgcagccacagccgcaacgccacccgcagccacagccacagccacagcccccgactcggaccgatg

SEQ ID NO: 12746 - DNA, 203 bp, Homo sapiens
  source 1..203: mol_type = other DNA
ggcgcgccagtcctgcacaggagccgctgtttttagacattgacgttgaccccgaaagcaggatggagctggagtgaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12747 - DNA, 203 bp, Homo sapiens
  source 1..203: mol_type = other DNA
ggcgcgccagtcctctacgattgccgctgtttttcactgagctgccataccccgaaagcaggatggagctggagtgaggtggaggggccgcaagctgctgaccgcgtaacaattgtagggtggtttgcagatcactgaggctggacaacgttcatggctctcgggtagaacctagtgaaacggccagacgactcggaccgatg

SEQ ID NO: 12748 - DNA, 203 bp, Homo sapiens
  source 1..203: mol_type = other DNA
ggcgcgccagtcctggcgggcagccgctgtttttcactgagctgccataccccgaaagcaggatggagctggagtgaggtggaggggccgcaagctgctgaccggcgtgtggaacactggtggtttgcagatcactgaggctggacgtgtgcaggactggtcgggtagaacctagtgaaacggccagacgactcggaccgatg

SEQ ID NO: 12749 - DNA, 203 bp, Homo sapiens
  source 1..203: mol_type = other DNA
ggcgcgccagtcctattcaggggccgctgtttttcactgagctgccataccccgaaagcaggatggagctggagtgttcgtcgatatattcaagctgctgaccggcgtgtggaacactggtggtttgcagatcactgaggctggacaacgttcatggctctcgggtagaacctagtgaaacggccagacgactcggaccgatg

SEQ ID NO: 12750 - DNA, 203 bp, Homo sapiens
  source 1..203: mol_type = other DNA
ggcgcgccagtcctactgtgcagccgctgtttttcactgagctgccataccccgaaagcaggtacttatgcactgaaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12751 - DNA, 203 bp, Homo sapiens
  source 1..203: mol_type = other DNA
ggcgcgccagtcctgcttaacagccgctgtttttcactgagctgccatcagttatttattatatggagctggagtgaggtggaggggccgcaagctgctgaccggcgtgtggaacactggtggtttgcagatcactgaggctggacaacgttcatggctctcgggtagaacctagtgaaacggccagacgactcggaccgatg

SEQ ID NO: 12752 - DNA, 203 bp, Homo sapiens
  source 1..203: mol_type = other DNA
ggcgcgccagtcctggttgaccgccggcagaggggcgctaggccgccctcgatcccctcgccgcggtcccatggaggaggaggcgagccgcagcgccgcggcgacgaacccagggagtaatggattaaatgcgccgcctcctgacaagcgggagggatccgcggtggacccagggaagcggaggagcccgactcggaccgatg

SEQ ID NO: 12753 - DNA, 203 bp, Homo sapiens
  source 1..203: mol_type = other DNA
ggcgcgccagtcctcaatcattgccggccaagacagcacagacagattgacctattggggtgagcgaatgacaaccgagggaagcgccgcggcctgtatttctagacctgcccttcgcctggttcgtggcgccttgtgaccccgggcccctgccgcctgcaagtcggaaattgcgctgtgctcctgtgcgactcggaccgatg

SEQ ID NO: 12754 - DNA, 203 bp, Homo sapiens
  source 1..203: mol_type = other DNA
ggcgcgccagtcctactcgctcgccggccaagacagcacagacagattgacctattggggtgtttcgcgagtgtgagagggaagcgccgcggcctgtatttctagacctgcccttcgcctggttcgtggcgccttgtgaccccgggagaaacggtaagctaagtcggaaattgcgctgtgctcctgtgcgactcggaccgatg

SEQ ID NO: 12755 - DNA, 203 bp, Homo sapiens
  source 1..203: mol_type = other DNA
ggcgcgccagtcctgggaagctgccggccaagacagcacagacagattgacctattggggtgtttcgcgagtgtgagagggaagcgccgcggcctgtatttctagacctgcccttcgcctggttcgtggcgctaatgtgtagatttcccctgccgcctgcaagtcggaaattgcgctgtgctcctgtgcgactcggaccgatg

SEQ ID NO: 12756 - DNA, 203 bp, Homo sapiens
  source 1..203: mol_type = other DNA
ggcgcgccagtcctgatggtgagccggccaagacagcacagacagattgacctattggggtgtttcgcgagtgtgagagggaagcgccgcggcctgtatttctagacctgcccttcgcgcaccaacacagaacttgtgaccccgggcccctgccgcctgcaagtcggaaattgcgctgtgctcctgtgcgactcggaccgatg

SEQ ID NO: 12757 - DNA, 203 bp, Homo sapiens
  source 1..203: mol_type = other DNA
ggcgcgccagtcctgatcttatgccggccaagacagcacagacagattgacctattggggtgtttcgcgagtgtgagagggaagcgccgcttggaaagacaaaggacctgcccttcgcctggttcgtggcgccttgtgaccccgggcccctgccgcctgcaagtcggaaattgcgctgtgctcctgtgcgactcggaccgatg

SEQ ID NO: 12758 - DNA, 203 bp, Homo sapiens
  source 1..203: mol_type = other DNA
ggcgcgccagtcctatcctaaggccggcggctggcggaggagggagggcgagggcgggcgcgaatgtagacttaatcggaagagggaggagaggcgcggggagccaggcctcggggcctcggagcaaccacccgagcagacggagtacacggagcagcggccccggccccgccaacgctgccgccgggcgactcggaccgatg

SEQ ID NO: 12759 - DNA, 203 bp, Homo sapiens
  source 1..203: mol_type = other DNA
ggcgcgccagtcctcctcgcaagccggcggctggcggaggagggagggcgagggcgggcgcgggccggcgggcgggcggaagagggaggagaggcgcggggagccaggcctcggggcctcggagcaaccaccgcctgctcttagtaacacggagcagcggccccggccccgccaacgctgccgccgggcgactcggaccgatg

SEQ ID NO: 12760 - DNA, 203 bp, Homo sapiens
  source 1..203: mol_type = other DNA
ggcgcgccagtcctttctgttggccgggaagactctacggggataatcataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcacccgactcggaccgatg

SEQ ID NO: 12761 - DNA, 203 bp, Homo sapiens
  source 1..203: mol_type = other DNA
ggcgcgccagtcctgtgtcgtcgccgggaagactgggtcctttcttggataaacccactctatgcccggccatttgggcgtgcccccgcaagactgctagccgacacaaaaccctaaccgaaaggccttgtggtactgcctgatagggtgcttgcgagtgccccgggaggtctcgtagaccgtgcacccgactcggaccgatg

SEQ ID NO: 12762 - DNA, 203 bp, Homo sapiens
  source 1..203: mol_type = other DNA
ggcgcgccagtcctaccgcacagccgggaagactgggtcctttcttggataaacccactctatgcccggccatttgggcgtgcccccgcaagactgctagccgagtagcgttgggttgcgaaaggccttgtgcagggcgtactattggtgcttgcgagtgccccgggaggtctcgtagaccgtgcacccgactcggaccgatg

SEQ ID NO: 12763 - DNA, 203 bp, Homo sapiens
  source 1..203: mol_type = other DNA
ggcgcgccagtcctgagatggcgccgggaagactgggtcctttcttggataaacccactctatgcccggccatttgggcgtgcccccgcaagactgctagccgagtagcgttgggttgcgaaaggccttgtggtactgcctgatagggtgcttgcgagtgaaaaactgtacaatgtagaccgtgcacccgactcggaccgatg

SEQ ID NO: 12764 - DNA, 203 bp, Homo sapiens
  source 1..203: mol_type = other DNA
ggcgcgccagtccttgaagagtgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctctcgcggaccatgtacgactcggaccgatg

SEQ ID NO: 12765 - DNA, 203 bp, Homo sapiens
  source 1..203: mol_type = other DNA
ggcgcgccagtcctcttgacaggccgggaagactgggtcctttcttggataaacccactctatgcccggccatttgggcgtgcccccgcaagactgctagccgagtagcgttgggttgcgaaaggccttgtggtactgcctgatagtcataaacactagaccccgggaggtctcgtagaccgtgcacccgactcggaccgatg

SEQ ID NO: 12766 - DNA, 203 bp, Homo sapiens
  source 1..203: mol_type = other DNA
ggcgcgccagtccttacgccctgccgggaagactgggtcctttcttgggacgcataggcaattgcccggccatttgggcgtgcccccgcaagactgctagccgagtagcgttgggttgcgaaaggccttgtggtactgcctgatagggtgcttgcgagtgccccgggaggtctcgtagaccgtgcacccgactcggaccgatg

SEQ ID NO: 12767 - DNA, 203 bp, Homo sapiens
  source 1..203: mol_type = other DNA
ggcgcgccagtcctgacctgaagccgggatgaccaatgttgagtcgaaattaacccgctcaatgcccggaaatttgggcgtgcccccgcaagactgctagccgagtagtgttgggtcgcgaaaggccttgcggtactgcctgatagggtgcttgcgagtgccccgggaggtctcgtagaccgtgcacccgactcggaccgatg

SEQ ID NO: 12768 - DNA, 203 bp, Homo sapiens
  source 1..203: mol_type = other DNA
ggcgcgccagtcctcccggaacgccgggatgaccgggtcctttcttggataaacccgctcaaactgaatgccccgcggcgtgcccccgcgagactgctagccgagtagtgttgggtcgcgaaaggccttgtggtactgcctgatagggtgcttgcgagtgccccgggaggtctcgtagaccgtgcacccgactcggaccgatg

SEQ ID NO: 12769 - DNA, 203 bp, Homo sapiens
  source 1..203: mol_type = other DNA
ggcgcgccagtcctgcgcaacggccgggatgaccgggtcctttcttggataaacccgctcaatgcccggagatttgggcgtgcccccgcgagactgctagccgagtagtgttgggtcgcgaaaggccttgtgagctacgggacgttggtgcttgcgagtgccccgggaggtctcgtagaccgtgcacccgactcggaccgatg

SEQ ID NO: 12770 - DNA, 203 bp, Homo sapiens
  source 1..203: mol_type = other DNA
ggcgcgccagtcctattacggagccgggatgaccgggtcctttcttggataaacccgctcaatgcccggagatttgggcgtgcccccgcgagactgctagccgagtagtgttgggtcgcgaaaggccttgtggtactgcctgatagtaatagcttagagaccccgggaggtctcgtagaccgtgcacccgactcggaccgatg

SEQ ID NO: 12771 - DNA, 203 bp, Homo sapiens
  source 1..203: mol_type = other DNA
ggcgcgccagtcctccgtctatgccgggatgaccgggtcctttcttggataaacccgctcaatgcccggagatttgggcgtgcccccgcggatgatacgcgtcggtagtgttgggtcgcgaaaggccttgtggtactgcctgatagggtgcttgcgagtgccccgggaggtctcgtagaccgtgcacccgactcggaccgatg

SEQ ID NO: 12772 - DNA, 203 bp, Homo sapiens
  source 1..203: mol_type = other DNA
ggcgcgccagtcctcgattccagccgggatgaccgggtcctttcttggattaacccgctcaatgcccggaaatttgccgcatgagtgaggagactgctagccgagtagtgttgggtcgcgaaaggccttgcggtactgcctgatagggtgcttgcgagtgccccgggaggtctcgtagaccgtgcacccgactcggaccgatg

SEQ ID NO: 12773 - DNA, 203 bp, Homo sapiens
  source 1..203: mol_type = other DNA
ggcgcgccagtcctgtttgtctgccgggatgaccgggtcctttcttggattaacccgctcaatgcccggaaatttgggcgtgcccccgcaagactgctagccgagtagtgttgggtcgcgaaaggccttgcgcctgaaaagctgcaggtgcttgcgagtgccccgggaggtctcgtagaccgtgcacccgactcggaccgatg

SEQ ID NO: 12774 - DNA, 203 bp, Homo sapiens
  source 1..203: mol_type = other DNA
ggcgcgccagtcctaacactacgccgggatgaccgggtcctttcttggattaacccgctcaatgcccggaaatttgggcgtgcccccgcaagactgctagccgagtagtgttgggtcgcgaaaggccttgcggtactgcctgatagggtgcttgcgagtgaaggacattaaaaagtagaccgtgcacccgactcggaccgatg

SEQ ID NO: 12775 - DNA, 203 bp, Homo sapiens
  source 1..203: mol_type = other DNA
ggcgcgccagtcctcaattgtggccgggatgaccgggtcctttcttggattaacccgctcaatgcccggaaatttgggcgtgcccccgcaagactgctagccgagtagtgttgggtcggtgtttctacccacgtactgcctgatagggtgcttgcgagtgccccgggaggtctcgtagaccgtgcacccgactcggaccgatg

SEQ ID NO: 12776 - DNA, 203 bp, Homo sapiens
  source 1..203: mol_type = other DNA
ggcgcgccagtcctatacatgagccgggatgaccgggtcctttcttggattaacccgctcaatgcccggaaatttgggcgtgcccccgcagttggtaactttttgtagtgttgggtcgcgaaaggccttgcggtactgcctgatagggtgcttgcgagtgccccgggaggtctcgtagaccgtgcacccgactcggaccgatg

SEQ ID NO: 12777 - DNA, 203 bp, Homo sapiens
  source 1..203: mol_type = other DNA
ggcgcgccagtcctcgtgcagtgccgggatgaccgggtcctttcttggtggctgataggggttgcccggaaatttgggcgtgcccccgcaagactgctagccgagtagtgttgggtcgcgaaaggccttgcggtactgcctgatagggtgcttgcgagtgccccgggaggtctcgtagaccgtgcacccgactcggaccgatg

SEQ ID NO: 12778 - DNA, 203 bp, Homo sapiens
  source 1..203: mol_type = other DNA
ggcgcgccagtccttgcgttaggccgggatgaccttaatagacacgatataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcacccgactcggaccgatg

SEQ ID NO: 12779 - DNA, 203 bp, Homo sapiens
  source 1..203: mol_type = other DNA
ggcgcgccagtcctcgaggtatgccgggccccggatcgcccttttgatctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 12780 - DNA, 203 bp, Homo sapiens
  source 1..203: mol_type = other DNA
ggcgcgccagtccttagggcaagccgggccccggccgctgtccagccgctccgtgccccgcgcgtcctgcgccgccgccaccgcctcctggggagacgcagccaaggtatgctgtgctatactcccagggtcctgctctcggccgtcttcctcatcagttttctgtgggatttgcccggtttccagcacgactcggaccgatg

SEQ ID NO: 12781 - DNA, 203 bp, Homo sapiens
  source 1..203: mol_type = other DNA
ggcgcgccagtcctcctcaaacgccgggccccggccgctgtccagccgctccgtgccccgcgcgtcctgcgccgccgccaccgcctcctggggagacgcagccacttgcccgccatggatactcccagggtcctgctctcggccgtcttcctcatcagttcctgaaattgcccccccggtttccagcacgactcggaccgatg

SEQ ID NO: 12782 - DNA, 203 bp, Homo sapiens
  source 1..203: mol_type = other DNA
ggcgcgccagtcctatcacgctgccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 12783 - DNA, 203 bp, Homo sapiens
  source 1..203: mol_type = other DNA
ggcgcgccagtcctttatttatgccgggccccggccgctgtccagccgctccgtgccccgcgcgtcctgcgccgccgccaccgcctcctggggagacgcagccacttgcccgccatggatactcccagggtcctgctctcggccgtgcatgcatcactcattctgtgggatttgcccggtttccagcacgactcggaccgatg

SEQ ID NO: 12784 - DNA, 203 bp, Homo sapiens
  source 1..203: mol_type = other DNA
ggcgcgccagtcctcattgactgccgggccccggccgctgtccagccgctccgtgccccgcgcgtcctgcgccgccgccaccgcctcctggggagacgcagccacttgcccgccatggatactcccagggtcggtaatgtaataaacttcctcatcagttttctgtgggatttgcccggtttccagcacgactcggaccgatg

SEQ ID NO: 12785 - DNA, 203 bp, Homo sapiens
  source 1..203: mol_type = other DNA
ggcgcgccagtcctctaatgatgccgggccccggccgctgtccagccgtgatcccgaggcttcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 12786 - DNA, 203 bp, Homo sapiens
  source 1..203: mol_type = other DNA
ggcgcgccagtcctagcgacctgccgggggacgggtaaggggggggtgaagaaggggccggccttcaagcaagagccgttgtcctgttgcgccaccacgggctcgggagtaaaagtccctcgcaatttccgactgttggaagaactcgaagaaggccagaaaggagtaggagatggcacagttagctgcgactcggaccgatg

SEQ ID NO: 12787 - DNA, 203 bp, Homo sapiens
  source 1..203: mol_type = other DNA
ggcgcgccagtccttttagctagccgggggacgggtaaggggggggtgaagaaggggccggccttcaagcaagagcgacgcaagatggcagccaccacgggctcgggagtaaaagtccaataggccgcgaatctgttggaagaactcgaagaaggccagaaaggagtaggagatggcacagttagctgcgactcggaccgatg

SEQ ID NO: 12788 - DNA, 203 bp, Homo sapiens
  source 1..203: mol_type = other DNA
ggcgcgccagtcctgccgcggggccgggggacgggtaaggggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctgcgactcggaccgatg

SEQ ID NO: 12789 - DNA, 203 bp, Homo sapiens
  source 1..203: mol_type = other DNA
ggcgcgccagtcctagatcggggccgggggacgggtaaggggggggtgaagaaggggccggccttcaagcaagagcgacgcaagatggcagccaccacgggctcgggagtaaaagtccctcgcaatttccgactgttggaagaactcgaagaaggccagattctcaatatgtcgggcacagttagctgcgactcggaccgatg

SEQ ID NO: 12790 - DNA, 203 bp, Homo sapiens
  source 1..203: mol_type = other DNA
ggcgcgccagtccttcgccaatgccgtattctgtgtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccgactcggaccgatg

SEQ ID NO: 12791 - DNA, 203 bp, Homo sapiens
  source 1..203: mol_type = other DNA
ggcgcgccagtccttcacccgcgcctacgattcccgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagcgactcggaccgatg

SEQ ID NO: 12792 - DNA, 203 bp, Homo sapiens
  source 1..203: mol_type = other DNA
ggcgcgccagtcctgagctagtgcctccccgtatataagacttcgccgagcgctctcactcgcacaagtggaccggggtgttgggtgctagtcggcaccagaggcaagggtgcgaggaccacggccggctcgataaccctgagtgacctagggggtggcagcgggcagtgcggggcggcaaggcgacccgactcggaccgatg

SEQ ID NO: 12793 - DNA, 203 bp, Homo sapiens
  source 1..203: mol_type = other DNA
ggcgcgccagtcctaatacccggcctccccgtatataagacttcgccggcaagcaattagatcacaagtggaccggggtgttgggtgctagtcggcaccagaggcaagggtgcgaggaccacggccggctcggacgtgtgaccgcgcctagggggtggcagcgggcagtgcggggcggcaaggcgacccgactcggaccgatg

SEQ ID NO: 12794 - DNA, 203 bp, Homo sapiens
  source 1..203: mol_type = other DNA
ggcgcgccagtcctgtgatctcgcctccctgctgagctcgcggctcacgctgagagggacacgcagtgacgagcggccgaagcagctttgcggtgagagcacgctgggccgggggccgccgaatcagtctagggcgggtaacgccggactcgagggttttgtagtgcatccctgagcatgagcacagacgactcggaccgatg

SEQ ID NO: 12795 - DNA, 203 bp, Homo sapiens
  source 1..203: mol_type = other DNA
ggcgcgccagtcctaaacatacgcctccctgctgagctcgcggctcacgctgagagggacacgcagtgacgagcggccgaagcagctttgcggtgagagcacgctgggccgggggccgggcgggagcctggtggcgggtaacgccggactcgagggttttgtagtgcatccctggcgcactcactgaccgactcggaccgatg

SEQ ID NO: 12796 - DNA, 203 bp, Homo sapiens
  source 1..203: mol_type = other DNA
ggcgcgccagtcctgcgtgtaagcctccctgctgagctcgcggctcacgctgagagggacacgcagtgacgagcggtgttcaatctgggccggtgagagcacgctgggccgggggccgggcgggagcctggtggcgggtaacgccggactcgagggttttgtagtgcatccctgagcatgagcacagacgactcggaccgatg

SEQ ID NO: 12797 - DNA, 203 bp, Homo sapiens
  source 1..203: mol_type = other DNA
ggcgcgccagtcctgacaaaccgcctccctgctggctatattaggtcggctgagagggacacgcagtgacgagcggccgaagcagctttgcggtgagagcacgctgggccgggggccgggcgggagcctggtggcgggtaacgccggactcgagggttttgtagtgcatccctgagcatgagcacagacgactcggaccgatg

SEQ ID NO: 12798 - DNA, 203 bp, Homo sapiens
  source 1..203: mol_type = other DNA
ggcgcgccagtcctctcgttgtgcctcctgacgacgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactaccgactcggaccgatg

SEQ ID NO: 12799 - DNA, 203 bp, Homo sapiens
  source 1..203: mol_type = other DNA
ggcgcgccagtcctgtttccaagcctgacagccaggaccccaggcagcagcgagtgacaggacgtctggacccgcgcgccgctagcagctctgccgggccgcggcggtgatcgatgggactgattcactcatgacccagcgagtgagggcgcacagccgggacgccgaggcggcgggcgggagacccgcgactcggaccgatg

SEQ ID NO: 12800 - DNA, 203 bp, Homo sapiens
  source 1..203: mol_type = other DNA
ggcgcgccagtcctttgctttagcctgacagccaggaccccaggcagcagcgagtgacaggacgtctggacccgcgcgccgctagcagctctgccgggccgcggcggtgatcgatggggagcggctggagcggacccagcgagtgagggcgcacagccggatttttttatttttgggcgggagacccgcgactcggaccgatg

SEQ ID NO: 12801 - DNA, 203 bp, Homo sapiens
  source 1..203: mol_type = other DNA
ggcgcgccagtccttactaccagcctgacagccaggaccccaggcagcagcgagtgacaggacgtctggacccgcgcgccgctagcagctctgccgggccgcggcggtgatcgatggggagcggctggagcggacccagcgagtgagggcgcacagccgggacgccgaggcggcaaattaatcgattacgactcggaccgatg

SEQ ID NO: 12802 - DNA, 203 bp, Homo sapiens
  source 1..203: mol_type = other DNA
ggcgcgccagtcctaactatcggcctggcaggcgcacgcgcccagcaccctgcctccggcgatgccgccccagcccctctgatggccctcctctctgctgccaccgcccatttcctgagaggcatgagcccggaacgcgcttgcttttaggagacagccactttctgtgtggtacgctggattcaaggcgactcggaccgatg

SEQ ID NO: 12803 - DNA, 203 bp, Homo sapiens
  source 1..203: mol_type = other DNA
ggcgcgccagtcctccatgtttgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12804 - DNA, 203 bp, Homo sapiens
  source 1..203: mol_type = other DNA
ggcgcgccagtcctaagtctgagcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtagcagaccgagctcacgactcggaccgatg

SEQ ID NO: 12805 - DNA, 203 bp, Homo sapiens
  source 1..203: mol_type = other DNA
ggcgcgccagtcctctcagagagcctggcaggcgcacgcgcccagcaccctgcctccggcgatgccgccccagcccctctgatggccctcctctctgctgccactcattccagaacaggaggcatgagcccggaacgcgcttgcttttaggagacagccagcaagatatgtaagcgctggattcaaggcgactcggaccgatg

SEQ ID NO: 12806 - DNA, 203 bp, Homo sapiens
  source 1..203: mol_type = other DNA
ggcgcgccagtcctagcagcttgcctggcaggcgcacgcgcccagcacgacagacgaataattgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 12807 - DNA, 203 bp, Homo sapiens
  source 1..203: mol_type = other DNA
ggcgcgccagtcctgtcattctgcctgtgtgagctgacaaacttagtagtgtttgtgaggattaacaacaattaacacagtgcgagctgtttcttagcacgaagatctcgatgtctaagaaaccaggagggcccggcaagagccggcgaccaggccctgcaaaacgcggaatgccccgcgtgttgtcccgactcggaccgatg

SEQ ID NO: 12808 - DNA, 203 bp, Homo sapiens
  source 1..203: mol_type = other DNA
ggcgcgccagtcctctgcaatagcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgcaaatgagccatctgcgactcggaccgatg

SEQ ID NO: 12809 - DNA, 203 bp, Homo sapiens
  source 1..203: mol_type = other DNA
ggcgcgccagtcctacttcgaagcctgtgtgagctgacaaacttagtagtgtttgtgaggattaacaacaattaacacagtgcgagctgtttcttagcacgaagatctcgatgtctaagaaaccaggagggcttccgcctttgattgctgtcaatatgctaaaacgcggaatgccccgcgtgttgtcccgactcggaccgatg

SEQ ID NO: 12810 - DNA, 203 bp, Homo sapiens
  source 1..203: mol_type = other DNA
ggcgcgccagtcctctctgatcgcctgtgtgagctgacaaacttagtagtgtttgtgaggattaacaacaattaacacagtgcgagctgtttcttagcacgaagatctcgatgtctaattcttatcctactgccggcaagagccgggctgtcaatatgctaaaacgcggaatgccccgcgtgttgtcccgactcggaccgatg

SEQ ID NO: 12811 - DNA, 203 bp, Homo sapiens
  source 1..203: mol_type = other DNA
ggcgcgccagtcctcaatgggtgccttacactccagagcaaatgtacggtgtcactctcgcagctgccacccgaccatgaccatcctgcaggccccgaccccggccccctccaccatcccgggaccccggcggggctccggtcctgagatcttcaccttcgaccctctcccggagcccgcagcggccccgactcggaccgatg

SEQ ID NO: 12812 - DNA, 203 bp, Homo sapiens
  source 1..203: mol_type = other DNA
ggcgcgccagtcctgattcgccgccttacactccgctcggctcaccatgtgtcactctcgcacgacaattgtccgaatgaccatcctgcaggccccgaccccggccccctccaccatcccgggaccccggcggggctccggtcctgagatcttcaccttcgaccctctcccggagcccgcagcggccccgactcggaccgatg

SEQ ID NO: 12813 - DNA, 203 bp, Homo sapiens
  source 1..203: mol_type = other DNA
ggcgcgccagtcctggatgggagccttacactccgctcggctcaccatgtgtcactctcgcagctgccacccgaccatgaccatcctgcaggccccgaccccggatgggcgacgttcaccgggaccccggcggggctccggtcctgagatcttcaccttcgaccctctcccggagcccgcagcggccccgactcggaccgatg

SEQ ID NO: 12814 - DNA, 203 bp, Homo sapiens
  source 1..203: mol_type = other DNA
ggcgcgccagtcctcgatagatgccttacactccgctcggctcaccatgtgtcactctcgcagctgccacccgaccatgaccatcctgcaggccccgaccccggccccctccaccatcagttcctattcatcgggctccggtcctgagatcttcaccttcgaccctctcccggagcccgcagcggccccgactcggaccgatg

SEQ ID NO: 12815 - DNA, 203 bp, Homo sapiens
  source 1..203: mol_type = other DNA
ggcgcgccagtcctttcatcgcgccttacactccgctcggctcaccatgtgtcactctcgcagctgccacccgaccatgaccatcctgcaggccccgaccccggccccctccaccatcccgggaccccggcggggctccggtcctgagatcttcaccttcattgacgggggtctgcccgcagcggccccgactcggaccgatg

SEQ ID NO: 12816 - DNA, 203 bp, Homo sapiens
  source 1..203: mol_type = other DNA
ggcgcgccagtcctaccaactggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggccccgactcggaccgatg

SEQ ID NO: 12817 - DNA, 203 bp, Homo sapiens
  source 1..203: mol_type = other DNA
ggcgcgccagtcctaatcacttgcgaaccacgtctccggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 12818 - DNA, 203 bp, Homo sapiens
  source 1..203: mol_type = other DNA
ggcgcgccagtccttgtttaacgcgacatgaagtgcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatccgactcggaccgatg

SEQ ID NO: 12819 - DNA, 203 bp, Homo sapiens
  source 1..203: mol_type = other DNA
ggcgcgccagtcctagttcctcgcgactagcctcccaagccagccacccagggcgagtcatcgacccaaaaggtcagaccgtctcacacaaacaatcccaagtactccgcgatggtgatccccctttttttaggaactgaaaccacggccctgacgtccctcccccctaggaacaggaacagctctcccgactcggaccgatg

SEQ ID NO: 12820 - DNA, 203 bp, Homo sapiens
  source 1..203: mol_type = other DNA
ggcgcgccagtcctcctggacagcgactagcctcccaagccagccacccagggcgagtcatcgacccaaaaggtcagaccgtctcacacatcagccttggtcccaaggctctgacgtctccccctttttttaggaactgaaaccacggccctgacgtccctcccccctaggaacaggaacagctctcccgactcggaccgatg

SEQ ID NO: 12821 - DNA, 203 bp, Homo sapiens
  source 1..203: mol_type = other DNA
ggcgcgccagtcctaactgattgcgagttggactgtgaagaaacatggcggccgcgacgttgacttcgaaattgtactccctgctgttccagtatcggattgtattcgccctcaccatcatcgtgggcgtcatgttcttcgagcgcgccttcgatcaaggcgcggacgctatctacgaccacatcaaccgactcggaccgatg

SEQ ID NO: 12822 - DNA, 203 bp, Homo sapiens
  source 1..203: mol_type = other DNA
ggcgcgccagtcctttacctacgcgagttggactgtgaagaaacatggcggccgcgacgttgacttcgaaattgtactccctgctgttccgcaggacctccaccgctcaagattagggcatcgtgggcgtcatgttcttcgagcgcgccttcgatcaaggcgcggacgctatctacgaccacatcaaccgactcggaccgatg

SEQ ID NO: 12823 - DNA, 203 bp, Homo sapiens
  source 1..203: mol_type = other DNA
ggcgcgccagtcctaacgcggcgcgagttggactgtgaagaaacatggcggccgcgacgttgacttcgaaattgtactccctgctgttccgcaggacctccaccttcgccctcaccattcaacgttctaatgtgttcttcgagcgcgccttcgatcaaggcgcggacgctatctacgaccacatcaaccgactcggaccgatg

SEQ ID NO: 12824 - DNA, 203 bp, Homo sapiens
  source 1..203: mol_type = other DNA
ggcgcgccagtcctgatccagagcgagttggactgtgaagaaacatggcggccgcgacgttggtcgaagttcgtgcctccctgctgttccgcaggacctccaccttcgccctcaccatcatcgtgggcgtcatgttcttcgagcgcgccttcgatcaaggcgcggacgctatctacgaccacatcaaccgactcggaccgatg

SEQ ID NO: 12825 - DNA, 203 bp, Homo sapiens
  source 1..203: mol_type = other DNA
ggcgcgccagtcctcccatttggcgagttggacttaatctggtgggtacggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaaccgactcggaccgatg

SEQ ID NO: 12826 - DNA, 203 bp, Homo sapiens
  source 1..203: mol_type = other DNA
ggcgcgccagtcctgtcgtcaagcgcccgggggccatgcgggtgagccgcggctgcagaggcctgagcgcctgatcgccgcggacccgagccgagcccacccccctccccagccccccgttgatatgtactaggcggcgcgctcgatctacgcgtccggggccccgcggggccgggcccggagtcggccgactcggaccgatg

SEQ ID NO: 12827 - DNA, 203 bp, Homo sapiens
  source 1..203: mol_type = other DNA
ggcgcgccagtcctctactgcggcgccggtaagtaagtacttgattttggtacctcgcgaggcaaatcatcctggtgagtggcgggacgctgccgggaagctccacctccgctcagcaggggacgccctggtctgagctctgtggtatctgattgttgttgaaccgtctctaagacggtgatactatacgactcggaccgatg

SEQ ID NO: 12828 - DNA, 203 bp, Homo sapiens
  source 1..203: mol_type = other DNA
ggcgcgccagtccttacataacgcgccggtaagtaagtacttgattttggtacctcgcgagggtttgggaggatcgcctcccgctttacgtgccgggaagctccacctccgctcagcaggggacgccctggtctgagctctgtggtatctgattgttgttgaaccgtctctaagacggtgatactatacgactcggaccgatg

SEQ ID NO: 12829 - DNA, 203 bp, Homo sapiens
  source 1..203: mol_type = other DNA
ggcgcgccagtcctaatggtcggcgccggtaagtaagtacttgattttggtacctcgcgagggtttgggaggatcggagtggcgggacgctgccgggaagctccacctccgctcagcaggggacgccctggtctgagctctgtggtatctgattgttgttgaaccgtctctaagacggtgatactatacgactcggaccgatg

SEQ ID NO: 12830 - DNA, 203 bp, Homo sapiens
  source 1..203: mol_type = other DNA
ggcgcgccagtcctgaatgttagcgccggtaagtaagtacttgattttggtacctcgcgagggtttgggaggatcggagtggcgggacgctgccgggaagctccacctccgctcagcaggggacgccctggtctgagctctgtggtatctgattgttgttgaaccgtctctaagtaaagctccggcctcgactcggaccgatg

SEQ ID NO: 12831 - DNA, 203 bp, Homo sapiens
  source 1..203: mol_type = other DNA
ggcgcgccagtccttggtgtccgcgcctgctgctgagcagatgcagtagccgaaactgcgcggaggcacagaggccggggagagcgttctgggtccgagggtccaggtaggggttgagccaccatctgaccgatgcgattcgaaaatcgccggttctgcaggcaccatgagccaggacaccgaggtggcgactcggaccgatg

SEQ ID NO: 12832 - DNA, 203 bp, Homo sapiens
  source 1..203: mol_type = other DNA
ggcgcgccagtccttaaggaacgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggcgactcggaccgatg

SEQ ID NO: 12833 - DNA, 203 bp, Homo sapiens
  source 1..203: mol_type = other DNA
ggcgcgccagtcctgtttaaaggcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccattcggttcgatacacgactcggaccgatg

SEQ ID NO: 12834 - DNA, 203 bp, Homo sapiens
  source 1..203: mol_type = other DNA
ggcgcgccagtcctatcccgtggcgcctgctgctgagcagatgcagtagccgaaactgcgcggaggcacagaggccggggagagcgttctgggtccgagggtccaggtaggggttgaggactttctaatggacaagctgcgtcgtgtcgccggttctgcaggcaccatgagccaggacaccgaggtggcgactcggaccgatg

SEQ ID NO: 12835 - DNA, 203 bp, Homo sapiens
  source 1..203: mol_type = other DNA
ggcgcgccagtcctatgttccagcgcctgctgcttgcgcagacgcaccgccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggcgactcggaccgatg

SEQ ID NO: 12836 - DNA, 203 bp, Homo sapiens
  source 1..203: mol_type = other DNA
ggcgcgccagtcctaatgctatgcgcgcccgacctccatcttcccggggccgcgccgcgcgcgcgcgcgggctttgggcgggaccctgcagaggcggcggggctccagtgggggctcctcctcggcctccccttcgggcgctctcgcgctaactgtgctcctccggggccctccgccacacgagagcccgactcggaccgatg

SEQ ID NO: 12837 - DNA, 203 bp, Homo sapiens
  source 1..203: mol_type = other DNA
ggcgcgccagtccttactctatgcgctgcaaggacaaccggctggggtccttgcgcgccgcgcgaagtcccaatcaaccgactgcgccgcgtaagtgccgcctgccctgcgtgggtcgtgccagctcagcgggacaggtcctcgcctcggtccctcggacttagggagcgcggggcagaccctgagagcgactcggaccgatg

SEQ ID NO: 12838 - DNA, 203 bp, Homo sapiens
  source 1..203: mol_type = other DNA
ggcgcgccagtccttagttgaggcgctgcaaggacaaccggctggggtccttgcgcgccgcggctcagggaggagcaccgactgcgccgcgtaagtgccgcctgccctgcgtgggtcgtgccagctcagcggccacctaaagaaaatcggtccctcggacttagggagcgcggggcagaccctgagagcgactcggaccgatg

SEQ ID NO: 12839 - DNA, 203 bp, Homo sapiens
  source 1..203: mol_type = other DNA
ggcgcgccagtcctccacccttgcgctgcaaggacaaccggctggggttgcgctattggtttgctcagggaggagcaccgactgcgccgcgtaagtgccgcctgccctgcgtgggtcgtgccagctcagcgggacaggtcctcgcctcggtccctcggacttagggagcgcggggcagaccctgagagcgactcggaccgatg

SEQ ID NO: 12840 - DNA, 203 bp, Homo sapiens
  source 1..203: mol_type = other DNA
ggcgcgccagtcctgccaagatgcgctggcctgctgccccggcgggtccgccggccggaggcgggagtcacaggaatgaatacgtgatgcaggaggcctcggcggatcaggacagctgcaggcttctgccaggtgggtgtgcagactggtgagctgccagcaggggcccagacgcgccaggcctggagcgactcggaccgatg

SEQ ID NO: 12841 - DNA, 203 bp, Homo sapiens
  source 1..203: mol_type = other DNA
ggcgcgccagtccttccaaacggcgcttaagaggagggtcgggctcggccggggagtcccagtggcggaggctacgaaacttgggggagtgcacagaagaacttcgggagcgcacgcgggaccagggaccaggctgagactcggggcgccagtccgggcacccaggaatcagtacggccggagatgcccgactcggaccgatg

SEQ ID NO: 12842 - DNA, 203 bp, Homo sapiens
  source 1..203: mol_type = other DNA
ggcgcgccagtcctaggaggtggcgcttaagaggagggtcgggctcggccggggagtcccagtggcggaggctacgtgtgcaatcatccggcacagaagaacttcgggagcgcacgcgggaccagggaccaggctgagactcggggcgccagtccgggcaggggcagcgggagccggccggagatgcccgactcggaccgatg

SEQ ID NO: 12843 - DNA, 203 bp, Homo sapiens
  source 1..203: mol_type = other DNA
ggcgcgccagtcctgggcatcagcggaagcggcggcggcggcgaaggcaatcaagaaatctcctggagggccgggcaccgcggccatggagggtcaacgctggctgccgctggaggccaatcccgaggtcaccaaccagtttcttaaacaattaggtctacatcctaactggcaattcgttgatgtatcgactcggaccgatg

SEQ ID NO: 12844 - DNA, 203 bp, Homo sapiens
  source 1..203: mol_type = other DNA
ggcgcgccagtccttaccgcaggcggaagcggcggcggcggcgaaggcggcggctgtcagagacctgtaatgctcgaccgcggccatggagggtcaacgctggctgccgctggaggccaatcccgaggtcaccaaccagtttcttaaacaattaggtctacatcctaactggcaattcgttgatgtatcgactcggaccgatg

SEQ ID NO: 12845 - DNA, 203 bp, Homo sapiens
  source 1..203: mol_type = other DNA
ggcgcgccagtcctacttgggtgcggaagcggcggcggcggcgaaggcggcggctgtcagagctggagggccgggcaccgcggccatggagggtcaacgctggctgccgctggaggccaatcccgaggtcacgtcatgccacaactaacaattaggtctacatcctaactggcaattcgttgatgtatcgactcggaccgatg

SEQ ID NO: 12846 - DNA, 203 bp, Homo sapiens
  source 1..203: mol_type = other DNA
ggcgcgccagtcctggttagtcgcggcactaaaacagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgcgactcggaccgatg

SEQ ID NO: 12847 - DNA, 203 bp, Homo sapiens
  source 1..203: mol_type = other DNA
ggcgcgccagtccttcaccgctgcggcggcgggaccggcagcagcagcagcagcagcagcagcaaccactagcctcctgccccgcggcgcccttcgtatgcggtcacgagccgctcaccccgccgttctcagcgctgcccgaccccgctcgcgcgccctcccgccgccagtcccggcagcgccctcagcgactcggaccgatg

SEQ ID NO: 12848 - DNA, 203 bp, Homo sapiens
  source 1..203: mol_type = other DNA
ggcgcgccagtcctgatgccaggcggcggcgggaccggcagcagcagcagcagcagcagcagcaaccactagcctcctgccccgcggcgctgccgcacgagccccacgagccgctcaccccgccgttctcaggatgctgtcggtgagctcgcgcgccctcccgccgccagtcccggcagcgccctcagcgactcggaccgatg

SEQ ID NO: 12849 - DNA, 203 bp, Homo sapiens
  source 1..203: mol_type = other DNA
ggcgcgccagtcctccagaaccgcggcggtggtggtggtggcggcggcggcggcgaagggggcggagaggaaggagcgcggcgggaccgggccgggacagcgcgcggccctcctggtaggattcgctccgcgcccgcggttgtagcagctgccgctgcagccatagcagcaggtcagtcattggcacccgactcggaccgatg

SEQ ID NO: 12850 - DNA, 203 bp, Homo sapiens
  source 1..203: mol_type = other DNA
ggcgcgccagtcctagaaccgagcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagtatcgctttagtcacagtcattggcacccgactcggaccgatg

SEQ ID NO: 12851 - DNA, 203 bp, Homo sapiens
  source 1..203: mol_type = other DNA
ggcgcgccagtcctagcctggggcggcggtggtggtggtggcggcggcggcggcgaagggggcggagaggaaggagcgcggcgggaccgggccgggacagcgcgtactttgggctccgggattcgctccgcgttatattgccagtgagctgccgctgcagccatagcagcaggtcagtcattggcacccgactcggaccgatg

SEQ ID NO: 12852 - DNA, 203 bp, Homo sapiens
  source 1..203: mol_type = other DNA
ggcgcgccagtcctggtccgtggcggctggagcggacccagcgagtgagggcgcacagccgggacgccgaggcggcgggcgggagacccgagaagtgcaccatcgccctcggcgggacgtgacgcagcgcccggggcgcgggtgtatttgatatagtgtttgcaacaaattcgacccaggtgatcaaacgactcggaccgatg

SEQ ID NO: 12853 - DNA, 203 bp, Homo sapiens
  source 1..203: mol_type = other DNA
ggcgcgccagtcctccgctgccgcggctggagcggacccagcgagtgatcctatcagtaatagacgccgaggcggcgggcgggagacccgcaccagcgcagccggccctcggcgggacgtgacgcagcgcccggggcgcgggtgtatttgatatagtgtttgcaacaaattcgacccaggtgatcaaacgactcggaccgatg

SEQ ID NO: 12854 - DNA, 203 bp, Homo sapiens
  source 1..203: mol_type = other DNA
ggcgcgccagtcctgtggaccagcgggcgacactctcgggctcgcgcaagatagagcatgatcggcgcccgaggcctcgcgcgcccggagttgctggttctgtgaggtagcggcggcaacgaccatggaggccacgtcccgggaggcggcgccagcgaagagctcggcctcgggccccaacgctcccccgactcggaccgatg

SEQ ID NO: 12855 - DNA, 203 bp, Homo sapiens
  source 1..203: mol_type = other DNA
ggcgcgccagtcctgcacctcagcgggcgacactctcgggctcgcgcacctccccaagatggcggcgcccgaggcctcgcgcgcccggagttgctggttctgtgaggtagcggcggcatgcggttatagcaacacgtcccgggaggcggcgccagcgaagagctcggcctcgggccccaacgctcccccgactcggaccgatg

SEQ ID NO: 12856 - DNA, 203 bp, Homo sapiens
  source 1..203: mol_type = other DNA
ggcgcgccagtcctattcccatgcgggcgcggggctgaaggcggaaccacgacgggcagagagcacggagccgggaagcccctgggcgcccgtcggagggctatggagcagcggccgcggggctgcgcggcgagatgccacaatagcctcctggtgctgctgggggcccgggcccagggcggcactcgcgactcggaccgatg

SEQ ID NO: 12857 - DNA, 203 bp, Homo sapiens
  source 1..203: mol_type = other DNA
ggcgcgccagtcctattgtcttgcgggcgggccccgtccatcctcagcgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtggcgactcggaccgatg

SEQ ID NO: 12858 - DNA, 203 bp, Homo sapiens
  source 1..203: mol_type = other DNA
ggcgcgccagtcctgttgtaacgcgggcgggcccgcagtcctgcagttgcagtcgtgttctccgagttcctgtctctctgccaacgccgcccggatggcttcccaaaaccgcgacccacagcaacaacttcacgccgccgcccgtaaaggagctgagccgagcgggggcgccgcccggggtccggtggcgactcggaccgatg

SEQ ID NO: 12859 - DNA, 203 bp, Homo sapiens
  source 1..203: mol_type = other DNA
ggcgcgccagtcctgcgcatgcgcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtggcgactcggaccgatg

SEQ ID NO: 12860 - DNA, 203 bp, Homo sapiens
  source 1..203: mol_type = other DNA
ggcgcgccagtcctccagctacgcgggcgggcccgcagtcctgcagttgcagtcgtgttctccgagttcctgtctctctgccaacgccgcgtaatgataacttgaaaaccgcgacccagccgccactagcgtcgccgccgcccgtaaaggagctgagccgagcgggggcgccgcccggggtccggtggcgactcggaccgatg

SEQ ID NO: 12861 - DNA, 203 bp, Homo sapiens
  source 1..203: mol_type = other DNA
ggcgcgccagtcctaccagttagcggggctgggaagtagtcgggcggggttgtgagacgccgcgctcagcttccatcgctgggcggtcaacaagtgcgggcctgctcagcaagctttaggcgcggagaccgcgaggcgaccgggagcggctgggttcccggctgcgcgcccttcggccaggccgggagcgactcggaccgatg

SEQ ID NO: 12862 - DNA, 203 bp, Homo sapiens
  source 1..203: mol_type = other DNA
ggcgcgccagtcctgtgtttaggcggggctgggaagtagtcgggcggggttgtgagacgccgcgctcagcttccatcgctgggcggtcaacaagtgcgggcctggctcagcgcgggggggcgcggagaccgcatcttctaataagtcggctgggttcccggctgcgcgcccttcggccaggccgggagcgactcggaccgatg

SEQ ID NO: 12863 - DNA, 203 bp, Homo sapiens
  source 1..203: mol_type = other DNA
ggcgcgccagtcctatgggctggcggggctgggaagtagtcgggcggggttgtgagacgccgcgctcagcttccatgttgtccgtcaacgcaagtgcgggcctggctcagcgcgggggggcgcggagaccgcgaggcgaccgggagcggctgggttcccggctgcgcgcccttcggccaggccgggagcgactcggaccgatg

SEQ ID NO: 12864 - DNA, 203 bp, Homo sapiens
  source 1..203: mol_type = other DNA
ggcgcgccagtccttgcttgtggcggggctgggatcacaagttcgacagttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagcgactcggaccgatg

SEQ ID NO: 12865 - DNA, 203 bp, Homo sapiens
  source 1..203: mol_type = other DNA
ggcgcgccagtcctaggcgtacgcgggtggacgctttttggagatctagatcattactatatgtgtctcctataatcacatcataggagtgaaccataatacacatctttgggtaggggaaggaaagtattgttgacgtactgattgatctgcttgagtcaaataatcagtcataacaattcaagaaacgactcggaccgatg

SEQ ID NO: 12866 - DNA, 203 bp, Homo sapiens
  source 1..203: mol_type = other DNA
ggcgcgccagtcctaaccgacggcgggtgtaggattagtgtcatgaattagtgtttcaaatcagttgcatatcaattaagaaaaacttaggagacaggtatagaacctctctttcagataactggtcaattaaggacagaaattctgtttctcaaatccgctagcctttgtcaaagaggacacaagcacgactcggaccgatg

SEQ ID NO: 12867 - DNA, 203 bp, Homo sapiens
  source 1..203: mol_type = other DNA
ggcgcgccagtcctcgagatgcgcggtccctgaggggcgggcggggcccgaccggcgctctgtgtggccgaggccacatcaagaactttacccggctaggccccgggcggctctagcccagggcggcccgcggggcgctgggcctggctcccggctccggtttccgggccggcgggtggccgctcacccgactcggaccgatg

SEQ ID NO: 12868 - DNA, 203 bp, Homo sapiens
  source 1..203: mol_type = other DNA
ggcgcgccagtcctcaagttgagcgtagccgagacacacgcatggtgctccggaggcggcggcgggtgagctcaacttcgcacagcccttcccagctccagccccggctggcccggcacttctcggagggtcccggcagccgggaccagtgagtgcctctacggaccagcgccccggcgggcgggaagcgactcggaccgatg

SEQ ID NO: 12869 - DNA, 203 bp, Homo sapiens
  source 1..203: mol_type = other DNA
ggcgcgccagtcctgtctgagtgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgcccatagctataatttacgactcggaccgatg

SEQ ID NO: 12870 - DNA, 203 bp, Homo sapiens
  source 1..203: mol_type = other DNA
ggcgcgccagtccttattaagtgcgtattcaacaaggggctgaaggatgcccagaaggtaccaggaaccgaatttactgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 12871 - DNA, 203 bp, Homo sapiens
  source 1..203: mol_type = other DNA
ggcgcgccagtcctaggctcttgcgtattcaacaaggggctgaaggatgcccagaaggtaccccattgtatgggatctgatctggggcctacaattcagcaggatacatgtgtttagtcgaggttaaaaaacgtctaggccccccgaaccacggggacgtggttttcctttgaaaaacacgatgataacgactcggaccgatg

SEQ ID NO: 12872 - DNA, 203 bp, Homo sapiens
  source 1..203: mol_type = other DNA
ggcgcgccagtcctatgcgcaagcgtccggaaagctcagccgtgattgcacaagagagctacaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 12873 - DNA, 203 bp, Homo sapiens
  source 1..203: mol_type = other DNA
ggcgcgccagtccttgttcgcagcgtccggaaagtcagtagaattcatcacaagagagctacaagagcctggaagaagctgaagactgctaccctccatccttactcaccctggacctcctcactgagggatatcaggtggagcaaggccctctcctgtcctgccccaaggctggcacagacttgagccgactcggaccgatg

SEQ ID NO: 12874 - DNA, 203 bp, Homo sapiens
  source 1..203: mol_type = other DNA
ggcgcgccagtcctgctacggtgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 12875 - DNA, 203 bp, Homo sapiens
  source 1..203: mol_type = other DNA
ggcgcgccagtcctcatttaaagcgtccggaaagtcagtagaattcatcacaagagagctacaagagcctggaagaagctgaagactgctaccctccatccttactcaccctggacctgagagacctcttcaatcaggtggagcaatcatactcaactgactgccccaaggctggcacagacttgagccgactcggaccgatg

SEQ ID NO: 12876 - DNA, 203 bp, Homo sapiens
  source 1..203: mol_type = other DNA
ggcgcgccagtcctaatcgaacgcgtccggaaagtcagtagaattcatcacaagagagctacaagagcctggaagaagctgaagactgctcttgagacgagccgctcaccctggacctgagagacctcttcaatcaggtggagcaaggccctctcctgtcctgccccaaggctggcacagacttgagccgactcggaccgatg

SEQ ID NO: 12877 - DNA, 203 bp, Homo sapiens
  source 1..203: mol_type = other DNA
ggcgcgccagtccttaaatggtgcgtccggaaagtcagtagaattcatggttgatctcagcaaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 12878 - DNA, 203 bp, Homo sapiens
  source 1..203: mol_type = other DNA
ggcgcgccagtcctgggaaatcgcgtgcttaggcttttgaagatggcttcattttggtgggattctcagattggccgcaactggagcccatcctgtttgtctttatttttattttctactccctaactctctttggcaacaccatcatcatcgctctctcctggctagaccttcggctgcacacacctcgactcggaccgatg

SEQ ID NO: 12879 - DNA, 203 bp, Homo sapiens
  source 1..203: mol_type = other DNA
ggcgcgccagtccttcctcttagcgttactcgacagaggagagcaagaaatggagccagtagatcctagactagagccctggaagcatccaggaagtcagcctaaaactgcttgtaccaattgctattgtaacgctctactgcgctattgccaagtttgtttcataacaaaagccttaggcatctcctcgactcggaccgatg

SEQ ID NO: 12880 - DNA, 203 bp, Homo sapiens
  source 1..203: mol_type = other DNA
ggcgcgccagtcctgcccagtggctatcggacctcgcttaggactcccattcccatggagaaactcctagatgaggcatcatgagtgcaagggccttataacttaaccgtcggcagttgggtaagagaccacgtccgatcaattgtcgagggcgcgtgggaagtgcgcgatgttgttaccgctgcccacgactcggaccgatg

SEQ ID NO: 12881 - DNA, 203 bp, Homo sapiens
  source 1..203: mol_type = other DNA
ggcgcgccagtcctttcggcacgctatcggacctcgcttaggactcccattcccatggagaaactcctagatgaggttcttgcccccggtgggccttataacttaaccgtcggcagttattgctctcgtagggtccgatcaattgtcgagggcgcgtgggaagtgcgcgatgttgttaccgctgcccacgactcggaccgatg

SEQ ID NO: 12882 - DNA, 203 bp, Homo sapiens
  source 1..203: mol_type = other DNA
ggcgcgccagtcctcattctcagctatcggacctcgcttaggactcccattcccatggagaaactcctagatgaggttcttgcccccggtgggccttataacttaaccgtcggcagttgggtaagagaccacgtccgatcaattgtcgagggcgcgtgggaagtgcgcgatgttagactgcaacgggtcgactcggaccgatg

SEQ ID NO: 12883 - DNA, 203 bp, Homo sapiens
  source 1..203: mol_type = other DNA
ggcgcgccagtcctcggaacaagctatcggacctcgcttaggactcccattcccatggagaaactcctagatgaggttcttgcccccggtgggccttataacttaaccgtcggcagttgggtaagagaccacgtccgatcaattgtttttctgcacacaaaagtgcgcgatgttgttaccgctgcccacgactcggaccgatg

SEQ ID NO: 12884 - DNA, 203 bp, Homo sapiens
  source 1..203: mol_type = other DNA
ggcgcgccagtcctggatcaaggctatcggacctcgcttaggactcccattcccatggagaaactcctagatgaggttcttgcccccggtgggccttataacttcttaagactggaccgggtaagagaccacgtccgatcaattgtcgagggcgcgtgggaagtgcgcgatgttgttaccgctgcccacgactcggaccgatg

SEQ ID NO: 12885 - DNA, 203 bp, Homo sapiens
  source 1..203: mol_type = other DNA
ggcgcgccagtcctatgcttgggctatcggacctcgcttaggactcccattcccatggagaaggcgtggacgacccttcttgcccccggtgggccttataacttaaccgtcggcagttgggtaagagaccacgtccgatcaattgtcgagggcgcgtgggaagtgcgcgatgttgttaccgctgcccacgactcggaccgatg

SEQ ID NO: 12886 - DNA, 203 bp, Homo sapiens
  source 1..203: mol_type = other DNA
ggcgcgccagtcctaagaatgcgctatcggacctcgcttaggactccctccgtagcctccttactcctagatgaggttcttgcccccggtgggccttataacttaaccgtcggcagttgggtaagagaccacgtccgatcaattgtcgagggcgcgtgggaagtgcgcgatgttgttaccgctgcccacgactcggaccgatg

SEQ ID NO: 12887 - DNA, 203 bp, Homo sapiens
  source 1..203: mol_type = other DNA
ggcgcgccagtcctgtgttcgtgctattttgcttccctattcagtctcccgtggcaaggaggtgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12888 - DNA, 203 bp, Homo sapiens
  source 1..203: mol_type = other DNA
ggcgcgccagtcctcgcagaatgctattttgctttaaccgatgacagaccgtggcaaggagggacgtgttggctcatttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12889 - DNA, 203 bp, Homo sapiens
  source 1..203: mol_type = other DNA
ggcgcgccagtcctgggcgcgtgctattttgctttaaccgatgacagaccgtggcaaggaggtgtacagccctgaccgcgtagaggaaccaggagaaggtcttggtggccgacaagtctggagacgtctactccttttcggtgctggagccacacgggtgtggccgtctagagctggggcacctgtctcgactcggaccgatg

SEQ ID NO: 12890 - DNA, 203 bp, Homo sapiens
  source 1..203: mol_type = other DNA
ggcgcgccagtccttaacgcccgctattttgctttaaccgatgacagaccgtggcaaggaggtgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12891 - DNA, 203 bp, Homo sapiens
  source 1..203: mol_type = other DNA
ggcgcgccagtcctcgtacgatgctattttgctttaaccgatgacagaccgtggcaaggaggtgtacagccctgactttcatagcctcgggaagcccacagcgcgtggccgacaagtctggagacgtctactccttttcggtgctggagccacacgggtgtggccgtctagagctggggcacctgtctcgactcggaccgatg

SEQ ID NO: 12892 - DNA, 203 bp, Homo sapiens
  source 1..203: mol_type = other DNA
ggcgcgccagtcctgcgggtgggctattttgctttaaccgatgacagaggtcccagtcatcatgtacagccctgactttcatagcctcggaggagaaggtcttggtggccgacaagtctggagacgtctactccttttcggtgctggagccacacgggtgtggccgtctagagctggggcacctgtctcgactcggaccgatg

SEQ ID NO: 12893 - DNA, 203 bp, Homo sapiens
  source 1..203: mol_type = other DNA
ggcgcgccagtcctgaggcaccgctcagcgcgggaatataaacgagatgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgcgactcggaccgatg

SEQ ID NO: 12894 - DNA, 203 bp, Homo sapiens
  source 1..203: mol_type = other DNA
ggcgcgccagtccttcctttgcgctcagcgcgggggggcgcggagaccgcgaggcgaccgggagcggctgggttcctcttcctatttttctcggccaggccgggagccgcgccagtcggagcccccggcccagcgtggtccgcctccctctgggcgtccacctgcccggagtactgccagcgggcatgcgactcggaccgatg

SEQ ID NO: 12895 - DNA, 203 bp, Homo sapiens
  source 1..203: mol_type = other DNA
ggcgcgccagtcctttaggttcgctcatctttgcggggttagctagccaaatctgtagccggtccttggcaagacagtagcttagagaaacgagatcgaatgcacccggaaggtggccaatttgtgcctcaactccttggccatctcctggctaccaaactcaagcgtttcctccttagcaaaggcggcgactcggaccgatg

SEQ ID NO: 12896 - DNA, 203 bp, Homo sapiens
  source 1..203: mol_type = other DNA
ggcgcgccagtcctggttccctgctcatctttgcggggttagctagccgttgagtccaagtcggacaccaggaacagtagcttagagaaacgagatcgaatgcacccggaaggtggccaatttgtgcctcaactccttggccatctcctggctaccaaactcaagcgtttccgttgggaattgggcggcgactcggaccgatg

SEQ ID NO: 12897 - DNA, 203 bp, Homo sapiens
  source 1..203: mol_type = other DNA
ggcgcgccagtccttgctgctagctcatctttgcggggttagctagccgttgagtccaagtctccttggcaagacagtagcttagagaaacgagatcgaatgcaaggactccccaaagaatttgtgcctcaactccttggccatctcctggctaccaaactcaagcgtttcctccttagcaaaggcggcgactcggaccgatg

SEQ ID NO: 12898 - DNA, 203 bp, Homo sapiens
  source 1..203: mol_type = other DNA
ggcgcgccagtcctcactgcatgctcatctttgcggggttagctagccgttgagtccaagtctccttggcaagacagtagcttagagaaacgagatcgaatgcacccggaaggtggccaatttgtgcctcaactccttggccatctcctggctaccaaactcaagcgtttcctcagagctgttctttccgactcggaccgatg

SEQ ID NO: 12899 - DNA, 203 bp, Homo sapiens
  source 1..203: mol_type = other DNA
ggcgcgccagtcctaagggcgtgctcatctttgcggggttagctagccgttgagtccaagtctccttggcaagacagtagcttagagaaacgagatcgaatgcacccggaaggtggccaatttgtgcctcaactccttggccatcttaattgggtagctgtcaagcgtttcctccttagcaaaggcggcgactcggaccgatg

SEQ ID NO: 12900 - DNA, 203 bp, Homo sapiens
  source 1..203: mol_type = other DNA
ggcgcgccagtcctagatatcagctcatctttgcggggttagctagccgttgagtccaagtctccttggcaagacagtagcttagagaaacgagatcgaatgcacccggaaggtggccaatttgtgcctcaagcagcataggtgtccctggctaccaaactcaagcgtttcctccttagcaaaggcggcgactcggaccgatg

SEQ ID NO: 12901 - DNA, 203 bp, Homo sapiens
  source 1..203: mol_type = other DNA
ggcgcgccagtcctttgctaacgctccgcggcggctgcgaaggcggcggctcctgccctctcgctttccctctcgcgtctctggctgcagaaagaagcttccgggcagtcaccttacaaggtgccatttccctctctgttgaagcaaaggccggggcagacctcctagtgaaaggaaagcaagccaggcgactcggaccgatg

SEQ ID NO: 12902 - DNA, 203 bp, Homo sapiens
  source 1..203: mol_type = other DNA
ggcgcgccagtcctttcaaagtgctccgcggcggctgcgaaggcggcggctcctgccctctcgctttccctctcgcgtctctggctgcagaaagaagcttccggttctgaggtcctggaggtgccatttcccagggatggttgtgcaaggccggggcagacctcctagtgaaaggaaagcaagccaggcgactcggaccgatg

SEQ ID NO: 12903 - DNA, 203 bp, Homo sapiens
  source 1..203: mol_type = other DNA
ggcgcgccagtcctgtttctgggctcgtctccgccggggacgtgctgcagcaacggctgcagggccgctaggccgactggcgccagacgcggcgcgtggccacgttggtggtgaccttccacgccaacttcatgatgtcacctagaggcctgctggagcgcgcgctcccgggccgagcgccgcgcgcccgactcggaccgatg

SEQ ID NO: 12904 - DNA, 203 bp, Homo sapiens
  source 1..203: mol_type = other DNA
ggcgcgccagtccttttctgcagctcgtctccgccggggacgtgctgcagcaacggctgcagggccgctaggccgactggcgccagacgcggcgcgtggccacgttggtggtgaccttggtaagacggaaagactacgtgtggctgggcctgctggagcgcgcgctcccgggccgagcgccgcgcgcccgactcggaccgatg

SEQ ID NO: 12905 - DNA, 203 bp, Homo sapiens
  source 1..203: mol_type = other DNA
ggcgcgccagtcctcctacgcagctcgttatctcccagcagtctcctctttacagaaaagagtaagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 12906 - DNA, 203 bp, Homo sapiens
  source 1..203: mol_type = other DNA
ggcgcgccagtcctccctcaaggctctcgggcaccctcacctgccggcgcccggccgcttacccggcagggcgtgcgcagggtagggtgcgggaccggggggacctggaggcagaggggagaaccggccgtccgcgccgcagcacactgcactatccttgctcagaccccgcgcggggcgccggctcccgactcggaccgatg

SEQ ID NO: 12907 - DNA, 203 bp, Homo sapiens
  source 1..203: mol_type = other DNA
ggcgcgccagtcctaaactagggctctcgggcaccctcacctgccggcgcccggccgcttacccggcagggcgtgcgcagggtagggtgcgggaccggggggacctggaggcagaggggagaaccggccgtcgttagtcgcctgttgccgctgggagcgcctcagaccccgcgcggggcgccggctcccgactcggaccgatg

SEQ ID NO: 12908 - DNA, 203 bp, Homo sapiens
  source 1..203: mol_type = other DNA
ggcgcgccagtcctgtacgtaagctgcgagccctgggccacgctggccgtgctggcagtgggccgcctcgatccctaaaacacgacatggttgaggctccaagaccagcaggtgaggcctcgcggcgctgaaaccgtgaggcccggaccacaggctccagatggaccctgggaaggacaaagagggggcgactcggaccgatg

SEQ ID NO: 12909 - DNA, 203 bp, Homo sapiens
  source 1..203: mol_type = other DNA
ggcgcgccagtcctcaaccaccgctgcgagccctgggccacgctggccgtgctggcagtgggccgcctcgatccctctgcagtctttcccttgaggctccaagaatgcactcctttttctcgcggcgctgaaaccgtgaggcccggaccacaggctccagatggaccctgggaaggacaaagagggggcgactcggaccgatg

SEQ ID NO: 12910 - DNA, 203 bp, Homo sapiens
  source 1..203: mol_type = other DNA
ggcgcgccagtccttcgtatgtgctgcgagccctgggccacgctggccgtgctggcagtggggactaaacggtttcctgcagtctttcccttgaggctccaagaccagcaggtgaggcctcgcggcgctgaaaccgtgaggcccggaccacaggctccagatggaccctgggaaggacaaagagggggcgactcggaccgatg

SEQ ID NO: 12911 - DNA, 203 bp, Homo sapiens
  source 1..203: mol_type = other DNA
ggcgcgccagtcctatcgaggagctggagcgagtgagcagcgatacctagggcggaagtgctctcggcggaagtgatcgctgtgtgaatccacctctttgatctcgcgggccgcctctttctaagtcggcttcgagcacccttcagttccatggccaagagcccactcgagggcgtttcctcctccagcgactcggaccgatg

SEQ ID NO: 12912 - DNA, 203 bp, Homo sapiens
  source 1..203: mol_type = other DNA
ggcgcgccagtcctactaacatgctggagcgagtgagcagcgatacctagggcggaagtgctctcggcggaagtgatcgctgtgtgaatcgtgggtgggatggccgcgggccgcctctaaaattaaattgcacgagcacccttcagttccatggccaagagcccactcgagggcgtttcctcctccagcgactcggaccgatg

SEQ ID NO: 12913 - DNA, 203 bp, Homo sapiens
  source 1..203: mol_type = other DNA
ggcgcgccagtcctgacccaacgctggagcgagtgagcagcgatacctagggcggaagtgctctcggcggaagtgatcgctgtgtgaatcgtgggtgggatggccgcgggccgcctctttctaagtcggcttatttgcattagtgcttccatggccaagagcccactcgagggcgtttcctcctccagcgactcggaccgatg

SEQ ID NO: 12914 - DNA, 203 bp, Homo sapiens
  source 1..203: mol_type = other DNA
ggcgcgccagtcctacgatatggctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggccaaaagattgaggacgactcggaccgatg

SEQ ID NO: 12915 - DNA, 203 bp, Homo sapiens
  source 1..203: mol_type = other DNA
ggcgcgccagtcctggcctatggctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctctagcgggcgtggcacgactcggaccgatg

SEQ ID NO: 12916 - DNA, 203 bp, Homo sapiens
  source 1..203: mol_type = other DNA
ggcgcgccagtccttttgagtggctggggtgaccgggtcctttcttggttgccagtcagtgttacccagaaatttgggcgtgcccccgcgagatcactagccgagtagtgttgggtcgcgaaaggccttgtggtactgcctgatagggtgcttgcgagtgccccgggaggtctcgtagaccgtgcaaccgactcggaccgatg

SEQ ID NO: 12917 - DNA, 203 bp, Homo sapiens
  source 1..203: mol_type = other DNA
ggcgcgccagtcctagaggtccgctggggtttggtgattcggaggcctggggtgcagacgcggcgtggctgtgagggtgaacgtcatcgccgggtgtgagggccggactcacactgggccgccgcggggctgtttccatcggtcactggattttctcctcttccggttcgggcctcagggtggccgaccgactcggaccgatg

SEQ ID NO: 12918 - DNA, 203 bp, Homo sapiens
  source 1..203: mol_type = other DNA
ggcgcgccagtcctggcgcattgcttaatgattgagagctcccttctgataaagggagcctgggaggctgggtggaggagggagcagaaaaaacccaactcagcagatctgggaactgtgagagcggcaagcaggaactgtggtcagaggctgtgcgtcttggctggtagggcctgctcttttctacccgactcggaccgatg

SEQ ID NO: 12919 - DNA, 203 bp, Homo sapiens
  source 1..203: mol_type = other DNA
ggcgcgccagtccttcggcccagcttaatgattgtccagaaggcggctataaagggagcctgggaggctgggtggaggagggagcagaaaaaacccaactcagcagatctgggaactgtgagagcggcaagcaggaactgtggtcagaggctgtgcgtctaaaacttcgcatggtgctcttttctacccgactcggaccgatg

SEQ ID NO: 12920 - DNA, 203 bp, Homo sapiens
  source 1..203: mol_type = other DNA
ggcgcgccagtcctttgcacgggcttaatgattgtccagaaggcggctataaagggagcctgggaggctgggtggaggagggagcagaaaaaacccaactcagcagatctgggaactgtgagagcggcaagctattcggtactcgggaggctgtgcgtcttggctggtagggcctgctcttttctacccgactcggaccgatg

SEQ ID NO: 12921 - DNA, 203 bp, Homo sapiens
  source 1..203: mol_type = other DNA
ggcgcgccagtcctcatgatccgcttaatgattgtccagaaggcggctataaagggagcctgggaggctgggtggaggagggagcagaaatctggggggcggcgagatctgggaactgtgagagcggcaagcaggaactgtggtcagaggctgtgcgtcttggctggtagggcctgctcttttctacccgactcggaccgatg

SEQ ID NO: 12922 - DNA, 203 bp, Homo sapiens
  source 1..203: mol_type = other DNA
ggcgcgccagtcctgcgggatcgcttaatgattgtccagaaggcggctataaagggagcctgggaggctgggtggatatattcattcctcaaacccaactcagcagatctgggaactgtgagagcggcaagcaggaactgtggtcagaggctgtgcgtcttggctggtagggcctgctcttttctacccgactcggaccgatg

SEQ ID NO: 12923 - DNA, 203 bp, Homo sapiens
  source 1..203: mol_type = other DNA
ggcgcgccagtcctccgtccgcgcttaatgattgtccagaaggcggctcgcttttccatgctggaggctgggtggaggagggagcagaaaaaacccaactcagcagatctgggaactgtgagagcggcaagcaggaactgtggtcagaggctgtgcgtcttggctggtagggcctgctcttttctacccgactcggaccgatg

SEQ ID NO: 12924 - DNA, 203 bp, Homo sapiens
  source 1..203: mol_type = other DNA
ggcgcgccagtcctcttagtttgcttcatcctacagcgggcgccaggccggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccgactcggaccgatg

SEQ ID NO: 12925 - DNA, 203 bp, Homo sapiens
  source 1..203: mol_type = other DNA
ggcgcgccagtcctaacgttcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagcgactcggaccgatg

SEQ ID NO: 12926 - DNA, 203 bp, Homo sapiens
  source 1..203: mol_type = other DNA
ggcgcgccagtcctgctagtatgcttccccaaggtgcaggcgcggtgaaaccatcgagacggagggccagagagtcacggcggtgagagggctgagtgacgggttaccccaaaccatgtggctggaggcgcgtcacccacaacatttaacaccccagggcctgtaaggtttggtgtttccctttcaagcgactcggaccgatg

SEQ ID NO: 12927 - DNA, 203 bp, Homo sapiens
  source 1..203: mol_type = other DNA
ggcgcgccagtcctagtaaggtgcttccccaaggtgcaggcgcggtgaaaccatcgagacggagggccagagagtcttctgaacccatcagctgagtgacgggttaccccaaaccatgtggctggaggcgcgagctggggttttcgtaacaccccagggcctgtaaggtttggtgtttccctttcaagcgactcggaccgatg

SEQ ID NO: 12928 - DNA, 203 bp, Homo sapiens
  source 1..203: mol_type = other DNA
ggcgcgccagtcctgagacgaagcttcttctgtaacgggagctggttgtgagtcaccaaggaaggcagcggcagctccactcagccagtacccagatacgctgggaaccttccccagccatggcttccctggggcagatcctcttctggagcataattagcatcatcattattctggctggagcaattcgactcggaccgatg

SEQ ID NO: 12929 - DNA, 203 bp, Homo sapiens
  source 1..203: mol_type = other DNA
ggcgcgccagtcctaagcctcggctttcctccaacttgctgcgggtggatctccgctggacacaccgcctccgaggatcccgttgctccacaaggagggactttaagactacttctgatttgcaaagattgtctgtgctctgagcaggctgaagtgactggacgagacgcactgttggagaaataaaacgactcggaccgatg

SEQ ID NO: 12930 - DNA, 203 bp, Homo sapiens
  source 1..203: mol_type = other DNA
ggcgcgccagtcctgttggcatgctttcctccaacttgctgcgggtggatctccgctggacacaccgcctccgaggcagtttgaaaattgcaaggagggactttaagactacttctgatttgcaaagattgtctgtgctctgagcaggctgaagtgactgtgaactttcggagtttggagaaataaaacgactcggaccgatg

SEQ ID NO: 12931 - DNA, 203 bp, Homo sapiens
  source 1..203: mol_type = other DNA
ggcgcgccagtcctgtaagacagctttcctccaacttgctgcgggtggatctccgctggacacaccgcctccgaggcagtttgaaaattgcaaggagggactttcgaggcgtgcggactttgcaaagattgtctgtgctctgagcaggctgaagtgactggacgagacgcactgttggagaaataaaacgactcggaccgatg

SEQ ID NO: 12932 - DNA, 203 bp, Homo sapiens
  source 1..203: mol_type = other DNA
ggcgcgccagtcctacacgaccgctttcctccaacttgctgcgggtggatctccgctggacacaccgcctccgaggcagtttgaaaattgtgcacgcactgaaaaagactacttctgatttgcaaagattgtctgtgctctgagcaggctgaagtgactggacgagacgcactgttggagaaataaaacgactcggaccgatg

SEQ ID NO: 12933 - DNA, 203 bp, Homo sapiens
  source 1..203: mol_type = other DNA
ggcgcgccagtccttccgcgaagctttcctccaacttgctgcgggtggcaggtatggccgtgcaccgcctccgaggcagtttgaaaattgcaaggagggactttaagactacttctgatttgcaaagattgtctgtgctctgagcaggctgaagtgactggacgagacgcactgttggagaaataaaacgactcggaccgatg

SEQ ID NO: 12934 - DNA, 203 bp, Homo sapiens
  source 1..203: mol_type = other DNA
ggcgcgccagtcctcctttcacggaaaactgcaccagggtaaaagaatttattttccttggcctgacccagaatcgggaagtgagcttagtcttatttcttttcctactcttggtgtaatatgattgggccatgggaaacctcctcatcatggtcactgttacctgtgaatctcgccttcacacgccccgactcggaccgatg

SEQ ID NO: 12935 - DNA, 203 bp, Homo sapiens
  source 1..203: mol_type = other DNA
ggcgcgccagtccttgagtgatggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctcgccttcacacgccccgactcggaccgatg

SEQ ID NO: 12936 - DNA, 203 bp, Homo sapiens
  source 1..203: mol_type = other DNA
ggcgcgccagtcctaccatcaaggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctctttgaacgctcttacgactcggaccgatg

SEQ ID NO: 12937 - DNA, 203 bp, Homo sapiens
  source 1..203: mol_type = other DNA
ggcgcgccagtcctggagactaggaaaactgcacgccttattgctctgttattttccttggcctgacccagaatcgggaagtgagcttagtcttatttcttttcctactcttggtgtatgtgacaactttgctgggaaacctcctcatcatggtcactgttacctgtgaatctcgccttcacacgccccgactcggaccgatg

SEQ ID NO: 12938 - DNA, 203 bp, Homo sapiens
  source 1..203: mol_type = other DNA
ggcgcgccagtcctaacttgtcggaaattatccgtactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaaccccgactcggaccgatg

SEQ ID NO: 12939 - DNA, 203 bp, Homo sapiens
  source 1..203: mol_type = other DNA
ggcgcgccagtcctgaaaccctggacaatgaaataccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 12940 - DNA, 203 bp, Homo sapiens
  source 1..203: mol_type = other DNA
ggcgcgccagtcctaatttcatggacagattcggattagcagagagcctgttggagtcaaaacgctccgtaaccccaattcttacagttttagatccaatggtaccgacaggttcagaaaatttaaaaagtctttttaatactgtctgcgtcatttggtgcatacacgcagaagagaaagtgaaagatcgactcggaccgatg

SEQ ID NO: 12941 - DNA, 203 bp, Homo sapiens
  source 1..203: mol_type = other DNA
ggcgcgccagtccttcactaaaggacagattcggattagcagagagcctgttggagtcaaaagagggttgtcaaaaaattcttacagttttagatccaatggtaccgacaggttcagaaaatttaaaaagtctttttaatactgtctgcgtcatttggtgcatacacgcagaagctccgcaaggtttccgactcggaccgatg

SEQ ID NO: 12942 - DNA, 203 bp, Homo sapiens
  source 1..203: mol_type = other DNA
ggcgcgccagtcctctactagaggacatccctcaccggtgacggtggtccaggctgcgttggcggcctacctatggctaacgccatgggaatgcgcaatctgtgaaggtgtgaagagcctattgagctacataagaatcctccggcccctgaatgcggctaatcccaacctcggagcaggtggtcacacgactcggaccgatg

SEQ ID NO: 12943 - DNA, 203 bp, Homo sapiens
  source 1..203: mol_type = other DNA
ggcgcgccagtcctcgtagcctggacatccctcaccggtgacggtggtccaggctgcgttggcggcctacctatggctaacgccatgggacgctagttgtgaacaaggtgtgaagagcagccgtcaagcgggaagaatcctccggcccctgaatgcggctaatcccaacctcggagcaggtggtcacacgactcggaccgatg

SEQ ID NO: 12944 - DNA, 203 bp, Homo sapiens
  source 1..203: mol_type = other DNA
ggcgcgccagtcctaccggcagggacatccctcaccggtgacggtggtccaggctgcgttggcggcctacctatggctaacgccatgggacgctagttgtgaacaaggtgtgaagagcctattgagctacataagaatcctccggcccctgaatgcggctaatcccaacctcgggaggttcaactcttcgactcggaccgatg

SEQ ID NO: 12945 - DNA, 203 bp, Homo sapiens
  source 1..203: mol_type = other DNA
ggcgcgccagtcctagatcaccggacatccctcaccggtgacggtggtccaggctgcgttggcggcctacctatggctaacgccatgggacgctagttgtgaacaaggtgtgaagagcctattgagctacataagaatcctccggcccctgaatgcggctcccagaccgagacaagcaggtggtcacacgactcggaccgatg

SEQ ID NO: 12946 - DNA, 203 bp, Homo sapiens
  source 1..203: mol_type = other DNA
ggcgcgccagtcctacaagaatggacatcgaccattcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcatacgactcggaccgatg

SEQ ID NO: 12947 - DNA, 203 bp, Homo sapiens
  source 1..203: mol_type = other DNA
ggcgcgccagtcctgactagggggacccgtagtgaacataggaaattgtcgttgaactacatgttgtaaggctttagagaaataagggagtgtcctatttaggatgaggtgctccggtggcagccccaccaaaacctctagcgactaggaacagctatatcgggttgctatagcagtcaggatgtcatcgactcggaccgatg

SEQ ID NO: 12948 - DNA, 203 bp, Homo sapiens
  source 1..203: mol_type = other DNA
ggcgcgccagtcctcagggtgcggacctcgagcgaaagacgcccgcccgccgcccagccctcgcctccctgcccaccgggcccaccgcgccgccaccccgacccaagctatacaccagtgtccgctgcacaccagcttgttggcgtcttcgtcgccgcgctcgccccgggctactcctgcgcgccacacgactcggaccgatg

SEQ ID NO: 12949 - DNA, 203 bp, Homo sapiens
  source 1..203: mol_type = other DNA
ggcgcgccagtcctttgtatcgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgcatagttaacctcggtcctgcgcgccacacgactcggaccgatg

SEQ ID NO: 12950 - DNA, 203 bp, Homo sapiens
  source 1..203: mol_type = other DNA
ggcgcgccagtcctagtatctgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctaccatgcatgttgtttcgactcggaccgatg

SEQ ID NO: 12951 - DNA, 203 bp, Homo sapiens
  source 1..203: mol_type = other DNA
ggcgcgccagtcctcttgcgttggacctcgagcgtcgtggtgggctgagccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacacgactcggaccgatg

SEQ ID NO: 12952 - DNA, 203 bp, Homo sapiens
  source 1..203: mol_type = other DNA
ggcgcgccagtcctccgaacttggactctgtcttcagctggacactccctccctgcaccatgctaacttcgaactccctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12953 - DNA, 203 bp, Homo sapiens
  source 1..203: mol_type = other DNA
ggcgcgccagtcctttagttcaggactctgtcttcagctggacactccctccctgcaccatgtcttacagttgtggcctgcccagcctgacggatttgcaactttgctcctcccggccctgtgtgccccccagctgccacggctgcaccctgcccggggcctgcaacatccccgccaatgtgagcaaccgactcggaccgatg

SEQ ID NO: 12954 - DNA, 203 bp, Homo sapiens
  source 1..203: mol_type = other DNA
ggcgcgccagtcctaatgagaaggactctgtcttcagctggacactccctccctgcaccatgtcttacagttgtggcctgcccagcctgagctgccgcaccagctgcattaatgggccctgtgtgccccccagctgccacggctgcaccctgcccggggcctgcaacatccccgccaatgtgagcaaccgactcggaccgatg

SEQ ID NO: 12955 - DNA, 203 bp, Homo sapiens
  source 1..203: mol_type = other DNA
ggcgcgccagtcctcacgctggggactctgtcttcagctggacactccctccctgcaccatgtcttacagttgtggcctgcccagcctgagctgccgcaccagctgctcctcccggccctgtgtgccccccagctgccacggctgcaccctgcccggggcaccttcgcagtgtaccaatgtgagcaaccgactcggaccgatg

SEQ ID NO: 12956 - DNA, 203 bp, Homo sapiens
  source 1..203: mol_type = other DNA
ggcgcgccagtcctgatgaatcggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccggtctccctttttcacgactcggaccgatg

SEQ ID NO: 12957 - DNA, 203 bp, Homo sapiens
  source 1..203: mol_type = other DNA
ggcgcgccagtcctttgggactggactctgtcttcagctggacactccctccctgcaccatgtcttacagttgtggttgtttagagacccgctgccgcaccagctgctcctcccggccctgtgtgccccccagctgccacggctgcaccctgcccggggcctgcaacatccccgccaatgtgagcaaccgactcggaccgatg

SEQ ID NO: 12958 - DNA, 203 bp, Homo sapiens
  source 1..203: mol_type = other DNA
ggcgcgccagtcctcatcccacggactctgtcttcagctggacactcctagaacagtttcaatcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12959 - DNA, 203 bp, Homo sapiens
  source 1..203: mol_type = other DNA
ggcgcgccagtcctgtattcacggactctgtcttcagctggatctcaggtccctgcaccatgtcttacagttgtggcctgcccagcctgagctgccgcaccagctgcattaatgggccctgtgtgccccccagctgccacggctgcaccctgcccggggcctgcaacatccccgccaatgtgagcaaccgactcggaccgatg

SEQ ID NO: 12960 - DNA, 203 bp, Homo sapiens
  source 1..203: mol_type = other DNA
ggcgcgccagtcctgggtagaaggactctgtcttcagctggatctcaggtccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12961 - DNA, 203 bp, Homo sapiens
  source 1..203: mol_type = other DNA
ggcgcgccagtcctgaggttcgggactctgtctttgctaccctcacaactccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 12962 - DNA, 203 bp, Homo sapiens
  source 1..203: mol_type = other DNA
ggcgcgccagtcctagttaagaggagagtagagcggagagaggaagtaagaagacgcctccgggtaagggacgcccctaacatccacggtaccaatgcgcgtactgtaaggaggagggacattggaagaagaactgtccaaaactcgtaagcggggcaaccccagtgttggtagaagaattacaatagcgactcggaccgatg

SEQ ID NO: 12963 - DNA, 203 bp, Homo sapiens
  source 1..203: mol_type = other DNA
ggcgcgccagtcctagaccctgggagagtagagcggagagaggaagtaagaagacgcctccgggtaagggacgcccgcctttggggaaaaaccaatgcgcgtacaccctaacatctctacattggaagaagaactgtccaaaactcgtaagcggggcaaccccagtgttggtagaagaattacaatagcgactcggaccgatg

SEQ ID NO: 12964 - DNA, 203 bp, Homo sapiens
  source 1..203: mol_type = other DNA
ggcgcgccagtccttcggcgtcggagccccgcgtgacgctcctctctcagtccaaaagcggcttttggttcggcgcagagagacccgggggtctagcttttcctcgaaaagcgccgccctgcccttggccccgagaacagacaaagagcaccgcagggccccgggtcgaacacccgctgaggccggcccgactcggaccgatg

SEQ ID NO: 12965 - DNA, 203 bp, Homo sapiens
  source 1..203: mol_type = other DNA
ggcgcgccagtcctggatgcttggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggatgatgaaattcgacgactcggaccgatg

SEQ ID NO: 12966 - DNA, 203 bp, Homo sapiens
  source 1..203: mol_type = other DNA
ggcgcgccagtcctatatgaacggagccccgcgtgacgctcctctctcagtccaaaagcggcttttggttcggcgcagagagacccgggggtctagcttttcctcgaaaagcgccgccctgcccttggccccgagaacagacaaaggttggttttattgagatcacgctgggggcgctgaggccggcccgactcggaccgatg

SEQ ID NO: 12967 - DNA, 203 bp, Homo sapiens
  source 1..203: mol_type = other DNA
ggcgcgccagtcctcgtgacgaggagccccgcgtgacgctcctctctcagtccaaaagcggcttttggttcggcgcagagagacccgggggtctagcttttcctcgaaaagcgccgccctgcccttggcccctcctgtgactgtccagcaccgcagggccgatcacgctgggggcgctgaggccggcccgactcggaccgatg

SEQ ID NO: 12968 - DNA, 203 bp, Homo sapiens
  source 1..203: mol_type = other DNA
ggcgcgccagtcctatgttgttggagccccgcgtgacgctcctctctcctataggtgcacatttttggttcggcgcagagagacccgggggtctagcttttcctcgaaaagcgccgccctgcccttggccccgagaacagacaaagagcaccgcagggccgatcacgctgggggcgctgaggccggcccgactcggaccgatg

SEQ ID NO: 12969 - DNA, 203 bp, Homo sapiens
  source 1..203: mol_type = other DNA
ggcgcgccagtccttccacgtgggagccgcgcagccctcggagcacgaatatatacagccctgctctgggacacacctccattggatttaaaagacagtcctcgtcagcactgactttcagctatggaatcgacggttgatgatgagcgttgtaggaatgaaatgaagatcgggtgaggagcaggacgcgactcggaccgatg

SEQ ID NO: 12970 - DNA, 203 bp, Homo sapiens
  source 1..203: mol_type = other DNA
ggcgcgccagtcctcccttcgtggagccgcgcagccctcggagcacgaatatatacagccctgctctgggacacactgttggactcgaagaaagacagtcctcgtcagcactgactttcagctatggaatcgacggttgatgatgaagcgccggccgtgtaaatgaagatcgggtgaggagcaggacgcgactcggaccgatg

SEQ ID NO: 12971 - DNA, 203 bp, Homo sapiens
  source 1..203: mol_type = other DNA
ggcgcgccagtcctcaagtcccggataggaggaatttaacaggatactgaacgtcgtatgttcagatcaaaagtaagaaaaacttagggtgaatgacaattcacagatcagctcaaccagacaccaccagcatacacgaaaccaaccttcacagtggatacctcagcatccaaaactctccttcccgacgactcggaccgatg

SEQ ID NO: 12972 - DNA, 203 bp, Homo sapiens
  source 1..203: mol_type = other DNA
ggcgcgccagtcctgcgatgcaggataggaggaatttaacaggatacttggacaatagaagccagatcaaaagtaaagctttgagcaaaggaatgacaattcacagatcagctcaaccagacaccaccagcatacacgaaaccaaccttcacagtggatacctcagcatccaaaactctccttcccgacgactcggaccgatg

SEQ ID NO: 12973 - DNA, 203 bp, Homo sapiens
  source 1..203: mol_type = other DNA
ggcgcgccagtcctccaaccagggataggaggaatttaacaggatacttggacaatagaagccagatcaaaagtaagaaaaacttagggtgaatgacaattcacagatcagctcaaccagacaccaccagcatacacgaaaccaaccttcacagtggatacctcagcatccaaaactctccttcccgacgactcggaccgatg

SEQ ID NO: 12974 - DNA, 203 bp, Homo sapiens
  source 1..203: mol_type = other DNA
ggcgcgccagtcctgtctacttggatcacttgagatttcactcgattcgctgcagtgagccctgtttttgccaccacactccagcttgggattgattcctaaagactcatgttacgtgaggaagcagctcagaagaggaaaggaaaggagccaggcatggctcttcctcagatatctcttccaaatgccgactcggaccgatg

SEQ ID NO: 12975 - DNA, 203 bp, Homo sapiens
  source 1..203: mol_type = other DNA
ggcgcgccagtcctaagaggatggatcacttgagccagggagttgaaggctgcagtgagcccgcaaaggattggaccactccagcttgggattgattcctaaagactcatgttacgtgaggaagcagctcagaagaggaaaggaaaggagccaggcatggctcttcctcagatatctcttccaaatgccgactcggaccgatg

SEQ ID NO: 12976 - DNA, 203 bp, Homo sapiens
  source 1..203: mol_type = other DNA
ggcgcgccagtcctacactctaggatcacttgagccagggagttgaaggctgcagtgagccctgtttttgccaccacactccagcttgggattgattcctaaagactcatgttacgtgaggaagcagctcagaagaggaaaggaaaggagccaggcatggagtcggagagctattctcttccaaatgccgactcggaccgatg

SEQ ID NO: 12977 - DNA, 203 bp, Homo sapiens
  source 1..203: mol_type = other DNA
ggcgcgccagtcctgttatccaggatcacttgagccagggagttgaaggctgcagtgagccctgtttttgccaccacactccagcttgggattgattcctaaagttaagatcaggccaaggaagcagctcagaagaggaaaggaaaggagccaggcatggctcttcctcagatatctcttccaaatgccgactcggaccgatg

SEQ ID NO: 12978 - DNA, 203 bp, Homo sapiens
  source 1..203: mol_type = other DNA
ggcgcgccagtccttagcctttggatcctaggcaaattgtctacctttactggtcagcaagtcttttccacaatgagcaactcaaaggaaatccccagcttcagatggactcaatccctgagaagagggctcagtgagttcacaacaccggtgaagaccgatgttctgagggattgggtttgccagaccgactcggaccgatg

SEQ ID NO: 12979 - DNA, 203 bp, Homo sapiens
  source 1..203: mol_type = other DNA
ggcgcgccagtcctgagtaaacggatcctaggcaaattgtctacctttcgatcatttacgaccttttccacaatgagcaactcaaaggaaatccccagcttcagatggactcaatccctgagaagagggctcagtgagttcacaacaccggtgaagaccgatgttctgagggatgccaaaatgatactcgactcggaccgatg

SEQ ID NO: 12980 - DNA, 203 bp, Homo sapiens
  source 1..203: mol_type = other DNA
ggcgcgccagtcctctgatattggatcctaggcaatttggttgtctttaacgacctaaaatcgcgctgtacttctccaaatgggaaacaagcaagccaaagccccagaatcaaaagacagtccgagagccagcctgatcccagatgccacacatctagggccacagttctgtaagagctgctggttcgcgactcggaccgatg

SEQ ID NO: 12981 - DNA, 203 bp, Homo sapiens
  source 1..203: mol_type = other DNA
ggcgcgccagtccttgacttctggatcctaggcaatttggttgtctttttttgaggccttgtgcgctgtacttctccaaatgggaaacaacttcattcgttagtcagaatcaaaagacagtccgagagccagcctgatcccagatgccacacatctagggccacagttctgtaagagctgctggttcgcgactcggaccgatg

SEQ ID NO: 12982 - DNA, 203 bp, Homo sapiens
  source 1..203: mol_type = other DNA
ggcgcgccagtcctgtagcaaaggatcctaggcaatttggttgtctttttttgaggccttgtgcgctgtacttctccaaatgggaaacaagcaagccaaagccccagaatcaaaagactcatgagtcctacacctgatcccagatgccacacatctagggccacagttctgtaagagctgctggttcgcgactcggaccgatg

SEQ ID NO: 12983 - DNA, 203 bp, Homo sapiens
  source 1..203: mol_type = other DNA
ggcgcgccagtcctgtaccgttggatcctaggcaatttggttgtctttttttgaggccttgtgcgctgtacttctcggcgccttgccggggcaagccaaagccccagaatcaaaagacagtccgagagccagcctgatcccagatgccacacatctagggccacagttctgtaagagctgctggttcgcgactcggaccgatg

SEQ ID NO: 12984 - DNA, 203 bp, Homo sapiens
  source 1..203: mol_type = other DNA
ggcgcgccagtcctacaactctggatcctaggcaccaccagctctgacttcactgagcaactctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 12985 - DNA, 203 bp, Homo sapiens
  source 1..203: mol_type = other DNA
ggcgcgccagtccttcgtagccggatcctaggcatagtgtctaacactccgcgaattatgggctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 12986 - DNA, 203 bp, Homo sapiens
  source 1..203: mol_type = other DNA
ggcgcgccagtcctccgcgagcggatcctaggcatagtgtctaacactttcactgagcaactctattctagatcaaaatcaccagaacttctggcatggcacacgagttccttcaataaagctttagatggactcagtccttaaggagaggtttgagccaattcactcagactgtcaagtcagatgttcgactcggaccgatg

SEQ ID NO: 12987 - DNA, 203 bp, Homo sapiens
  source 1..203: mol_type = other DNA
ggcgcgccagtcctgtagaggcggatcctaggcatagtgtctaacactttcactgagcaactctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 12988 - DNA, 203 bp, Homo sapiens
  source 1..203: mol_type = other DNA
ggcgcgccagtcctgctattggggatcctaggcatagtgtctaacactttcactgagcaactctattctagatcaaaatcaccagaacttctggcatggcacactccaaggaggttccaagctttagatggactcagtccttaaggtctccaccaccgtgattcactcagactgtcaagtcagatgttcgactcggaccgatg

SEQ ID NO: 12989 - DNA, 203 bp, Homo sapiens
  source 1..203: mol_type = other DNA
ggcgcgccagtcctcttggtacggatcctaggcattaaggctatcttatttaattgtctttaattgcctcttgtgtcttctgtgcccctacgggaccctatcccgcgtaagcaatagactctagcagaccacatgttctgagggttctgaacatcatacctgcagctaaacatggaggaagacatagccgactcggaccgatg

SEQ ID NO: 12990 - DNA, 203 bp, Homo sapiens
  source 1..203: mol_type = other DNA
ggcgcgccagtcctccgcaggtggatcctaggcattaaggctatcttatttaattgtctttataacgtcgcatcagcttctgtgcccctacgggaccctatcccatagcgaactgttgctctagcagaccacatgttctgagggttctgaacatcatacctgcagctaaacatggaggaagacatagccgactcggaccgatg

SEQ ID NO: 12991 - DNA, 203 bp, Homo sapiens
  source 1..203: mol_type = other DNA
ggcgcgccagtcctatatctaaggatcctaggccgtcgttaagtttggatgtgctgtggtgaaggcgtgtaaaacgacggccagtgcgcacagtggatcctaggcgacacttggccatactctttagcacataagagttgaaagggcttattagaaagcacattcctgagaggtgcgagtttggacatcgactcggaccgatg

SEQ ID NO: 12992 - DNA, 203 bp, Homo sapiens
  source 1..203: mol_type = other DNA
ggcgcgccagtccttacaggcaggatcctaggccgtcgttaagtttggatgtgctgtggtgaaggcgtgtaaaacgacggccagtgcgcacagtggatcctaggcgacacttggccatggatgaatatgtccaagagttgaaagggcttattagaaagcaatcgaaaagctatagcgagtttggacatcgactcggaccgatg

SEQ ID NO: 12993 - DNA, 203 bp, Homo sapiens
  source 1..203: mol_type = other DNA
ggcgcgccagtcctttactgtcggatcctaggcgaaatttgacaatggatgaaaaagtctttgttttgaaagattttatcagaagacaagtgcctgacatacctgaactgtcttatcagaaggaggcattactttctcaagtcgaagtaccaatggtcttaacagagggcttcaagctcctatcatgccgactcggaccgatg

SEQ ID NO: 12994 - DNA, 203 bp, Homo sapiens
  source 1..203: mol_type = other DNA
ggcgcgccagtcctattcagggggatcctaggcgaaatttgacaatggatgaaaaagtctttgttttgaaagattttatcagaagacaagtgcctgacatacctgaactgtcttatcagaaggaggcattactttctcaagtcgaatgcttgtactagaaaacagagggcttcaagctcctatcatgccgactcggaccgatg

SEQ ID NO: 12995 - DNA, 203 bp, Homo sapiens
  source 1..203: mol_type = other DNA
ggcgcgccagtcctctgctgaaggatcctaggctattggattgcgctttgcttttgtcatttcctacctgttcgcaagttctttgttgtgtgcatacaacacaacaatctggcgatgagtgcctcaaaggaaataaaatcctttttgtggacacaatctttgaggagggaattatctggttactgctccgactcggaccgatg

SEQ ID NO: 12996 - DNA, 203 bp, Homo sapiens
  source 1..203: mol_type = other DNA
ggcgcgccagtccttcgcttcgggatcctaggctattggattgcgctttgcttttgtcattttggcagatagtctcagttctttgttgtgtgcatacaacacaacaatctggcgatgagtgcctcaaaggaagagtggcatggagggtggacacaatctttgaggagggaattatctggttactgctccgactcggaccgatg

SEQ ID NO: 12997 - DNA, 203 bp, Homo sapiens
  source 1..203: mol_type = other DNA
ggcgcgccagtcctggaaagtgggatcctaggctattggattgcgctttgcttttgtcattttggcagatagtctcttggtgcacggtgatgcatacaacacaacaatctggcgatgagtgcctcaaaggaaataaaatcctttttgtggacacaatctttgaggagggaattatctggttactgctccgactcggaccgatg

SEQ ID NO: 12998 - DNA, 203 bp, Homo sapiens
  source 1..203: mol_type = other DNA
ggcgcgccagtcctgatcgccgggatggcgataggacagctataggctctgcagggccccaggcagctggggtattccttaggggctgagtctcctggtatccctaagactgggcttggcttaggcactgagattccttctggaaccccaacgccttcgagacggattccgacctgccggctggatggcgactcggaccgatg

SEQ ID NO: 12999 - DNA, 203 bp, Homo sapiens
  source 1..203: mol_type = other DNA
ggcgcgccagtcctctttattgggatttggctccatggcttagggcaacatatctatgaaacttatggggatacttgggcaggagtggaagccataataagaattctgcaacaactgctgtttatccattttcagaattgggtgtcacgggtaatagtggggcgttactcgacagaggagagcaagaacgactcggaccgatg

SEQ ID NO: 13000 - DNA, 203 bp, Homo sapiens
  source 1..203: mol_type = other DNA
ggcgcgccagtccttaatccagggatttggctccatggcttagggcaacatatctatgaaacttatggggatactttatgccaccgaaccgccataataagaattctgcaacaactgctgtttatccattttcagaattgggtgtcgacatagcagaataggcgttactcgacagaggagagcaagaacgactcggaccgatg

SEQ ID NO: 13001 - DNA, 203 bp, Homo sapiens
  source 1..203: mol_type = other DNA
ggcgcgccagtccttttcgtccggcaagggggcgaccgatcttataacaagctcggcgttccagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 13002 - DNA, 203 bp, Homo sapiens
  source 1..203: mol_type = other DNA
ggcgcgccagtcctacgccgacggcaagggggcggggccaaaggccctaagctcggcgttccagagagtggggagggggcaagtgtcagtcaggacgggagtccccacccgccggtgcgaggcctaggtggcagacagggggcccgggccgctgcgtgttgtccacccaagatggagttcctcctgggcgactcggaccgatg

SEQ ID NO: 13003 - DNA, 203 bp, Homo sapiens
  source 1..203: mol_type = other DNA
ggcgcgccagtcctaatgtagaggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 13004 - DNA, 203 bp, Homo sapiens
  source 1..203: mol_type = other DNA
ggcgcgccagtcctcctcgcaaggcaagggggcggggccaaaggccctaagctcggcgttccagagagtggggagggggcaagtgtcagtcaggacgggagtccggcgggttacagcggaggcctaggtggcgatgtaactctgaaggccgctgcgtgttgtccacccaagatggagttcctcctgggcgactcggaccgatg

SEQ ID NO: 13005 - DNA, 203 bp, Homo sapiens
  source 1..203: mol_type = other DNA
ggcgcgccagtccttgtgtgggggcaagggggcggggccaaaggccctcgtacttagccataagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 13006 - DNA, 203 bp, Homo sapiens
  source 1..203: mol_type = other DNA
ggcgcgccagtcctagaggagaggcaataacatatatatgtcaaccctgctcattggtttaaggacctcacggagctgttgtgtgatcttgcgcgataaatgctgacgtgaaaacgttgcgtattgctacaacacttggttagctatttagctttactaatcaagacgccgtcgtgcagcccacaaaacgactcggaccgatg

SEQ ID NO: 13007 - DNA, 203 bp, Homo sapiens
  source 1..203: mol_type = other DNA
ggcgcgccagtcctcgagtaacggcaataacatatatatgtcaaccctgctcattggtttaattgagcgcatttagtgttgtgtgatcttgcgcgataaatgctgacgtgaaaacgttgcgtattgctacaacacttggttagctatttagctttactaatcaagacgccgtcgatgcagaacaggtgcgactcggaccgatg

SEQ ID NO: 13008 - DNA, 203 bp, Homo sapiens
  source 1..203: mol_type = other DNA
ggcgcgccagtcctgtcaaatgggcaataacatatatatgtcaaccctgctcattggtttaattgagcgcatttagtgttgtgtgatcttgcgcgataaatgctgacgtgaaaacgttgcgtattgctacaacacttggttagctatttagctttactaatcaagacgccgtcgtgcagcccacaaaacgactcggaccgatg

SEQ ID NO: 13009 - DNA, 203 bp, Homo sapiens
  source 1..203: mol_type = other DNA
ggcgcgccagtcctgacctgaaggcacttgcaccgtgtggacagactcagaacgagataaataatccagtccctgttactccattttggccagaaattcaagacatttcaggtggcagaataaattcaatccttgtttctccatcttatcgagtagtagaagttagttacattctctttgaactcatccgactcggaccgatg

SEQ ID NO: 13010 - DNA, 203 bp, Homo sapiens
  source 1..203: mol_type = other DNA
ggcgcgccagtcctgcgcaacgggcacttgcaccgtgtggacagactctccggttctggggaaatccagtccctgtgctatgtgcactcgcagaaattcaagacatttcaggtggcagaataaattcaatccttgtttctccatcttatcgagtagtagaagttagttacattctctttgaactcatccgactcggaccgatg

SEQ ID NO: 13011 - DNA, 203 bp, Homo sapiens
  source 1..203: mol_type = other DNA
ggcgcgccagtcctaaggcatgggcacttgcaccgtgtggacagactctccggttctggggaaatccagtccctgttactccattttggcatagttgctggcttatttcaggtggcagaataaattcaatccttgtttctccatcttatcgagtagtagaagttagttacattctctttgaactcatccgactcggaccgatg

SEQ ID NO: 13012 - DNA, 203 bp, Homo sapiens
  source 1..203: mol_type = other DNA
ggcgcgccagtcctgtggcttaggcacttgcaccgtgtggacagactctccggttctggggaaatccagtccctgttactccattttggccagaaattcaagacatttcaggtggcagaataaattcaatccttgtttctccatcttatcgagtagtagaagttagttacattctctttgaactcatccgactcggaccgatg

SEQ ID NO: 13013 - DNA, 203 bp, Homo sapiens
  source 1..203: mol_type = other DNA
ggcgcgccagtcctcgcaaagcggcaggcgatccggggctcgcctccgtagatagggggcgccgcaggcgcgagctggccgcctcacacggagtcggcttgttaagtgcgcacgcgcgggagtttctggcagaaagcaggcgagcctgggccggcgcggggccttgtgggagggcttaaggaagtaaacgactcggaccgatg

SEQ ID NO: 13014 - DNA, 203 bp, Homo sapiens
  source 1..203: mol_type = other DNA
ggcgcgccagtccttccttcagggcagtccatggaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 13015 - DNA, 203 bp, Homo sapiens
  source 1..203: mol_type = other DNA
ggcgcgccagtcctcctcaaacggccaaatacagaattttggatctccccccccccacccccctttggatcttgtcgggctttccacgtttcacttaaaaaaaattcttgtaacgtccaaggcaagctccccacgacccgaacacgcccagaggaaccttggggcctctggggacttggctagcaggtcgactcggaccgatg

SEQ ID NO: 13016 - DNA, 203 bp, Homo sapiens
  source 1..203: mol_type = other DNA
ggcgcgccagtcctgtagaactggccaaccagaccctgggtggtgactttttcctgttgggaatcttcagccagatctcacaccctggccgcctctgcttgcttatcttcagtatatttttgatggctgtgtcttggaatattacaggccgctaataaccccacattgactcctctctgcatactccccgactcggaccgatg

SEQ ID NO: 13017 - DNA, 203 bp, Homo sapiens
  source 1..203: mol_type = other DNA
ggcgcgccagtccttgaggcctggccaaccagaccctgggtggtgactttttcctgttgggaatcttcagccagatctcacaccctggccgcctctgcttgctttgggaagagcataatttgatggctgtgtcttggaatattacattgatacttctgatccacattgactcctctctgcatactccccgactcggaccgatg

SEQ ID NO: 13018 - DNA, 203 bp, Homo sapiens
  source 1..203: mol_type = other DNA
ggcgcgccagtcctgccgcgggggccacgaatcatttgccatctcctccgtaccctcgaagcaatgtatggccctggtagtcagctgggaaagtctggcaataacagctgggctaaggaacgtggatgctcaattgcctgccaagggtctcttacttcagcccggctacatgcccccagcattggagacgactcggaccgatg

SEQ ID NO: 13019 - DNA, 203 bp, Homo sapiens
  source 1..203: mol_type = other DNA
ggcgcgccagtcctagatcgggggccacgaatcatttgccatctcctctaccaaagactcaaaatgtatggccctgcactcagcgccctcaagtctggcaataacagctgggctaaggaacgtggatgctcaattgcctgccaagggtctcttacttcagcccggctacatgcccccagcattggagacgactcggaccgatg

SEQ ID NO: 13020 - DNA, 203 bp, Homo sapiens
  source 1..203: mol_type = other DNA
ggcgcgccagtcctagttagcgggccacgaatcatttgccatctcctctaccaaagactcaaaatgtatggccctggtagtcagctgggaaagtctggcaataacagctgggctaaggaacgtggatgctcaattgcctgccaaggacggggactacacacccggctacatgcccccagcattggagacgactcggaccgatg

SEQ ID NO: 13021 - DNA, 203 bp, Homo sapiens
  source 1..203: mol_type = other DNA
ggcgcgccagtccttcacccgcggccacgaatcatttgccatctcctctaccaaagactcaaaatgtatggccctggtagtcagctgggaaagtctggcaataacagctgggctaaggaacgtggatgctcagcgcgacagagtcagtctcttacttcagcccggctacatgcccccagcattggagacgactcggaccgatg

SEQ ID NO: 13022 - DNA, 203 bp, Homo sapiens
  source 1..203: mol_type = other DNA
ggcgcgccagtcctcataaataggccacgaatcatttgccatctcctctaccaaagactcaaaatgtatggccctggtagtcagctgggaaagtctggcaataacagctgggctaagggctaaattcagagtattgcctgccaagggtctcttacttcagcccggctacatgcccccagcattggagacgactcggaccgatg

SEQ ID NO: 13023 - DNA, 203 bp, Homo sapiens
  source 1..203: mol_type = other DNA
ggcgcgccagtcctacgcgcctggccacgaatcatttgccatctcctctaccaaagactcaagggtctgtcggacagtagtcagctgggaaagtctggcaataacagctgggctaaggaacgtggatgctcaattgcctgccaagggtctcttacttcagcccggctacatgcccccagcattggagacgactcggaccgatg

SEQ ID NO: 13024 - DNA, 203 bp, Homo sapiens
  source 1..203: mol_type = other DNA
ggcgcgccagtcctagagtttaggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 13025 - DNA, 203 bp, Homo sapiens
  source 1..203: mol_type = other DNA
ggcgcgccagtcctaatacccgggccatcgctagcggcttgatccgccagaagcggcaggcgcgggagcagcactgggaccggccgtctgccagcaggaggcggagcagccccagcaagaaccgcgggctcttatcttctgcggccgtggatatcttctccaaagtgcgcatcttcggcctcaagaagcgactcggaccgatg

SEQ ID NO: 13026 - DNA, 203 bp, Homo sapiens
  source 1..203: mol_type = other DNA
ggcgcgccagtccttgaaaccaggccatcgctagcggcttgatccgccagaagcggcaggcgcgggagcagcactgggaccggccgtctgccagcaggaggcggcagtttttggtttcgaaccgcgggctctgcaacggcaacctggtggatatcttctccaaagtgcgcatcttcggcctcaagaagcgactcggaccgatg

SEQ ID NO: 13027 - DNA, 203 bp, Homo sapiens
  source 1..203: mol_type = other DNA
ggcgcgccagtcctgcagcctgggccatcgctagcggcttgatccgccagaagcggcaggcgcgggagcagcactgggaccggccgtctgtttagtcatcattcagcagccccagcaagaaccgcgggctctgcaacggcaacctggtggatatcttctccaaagtgcgcatcttcggcctcaagaagcgactcggaccgatg

SEQ ID NO: 13028 - DNA, 203 bp, Homo sapiens
  source 1..203: mol_type = other DNA
ggcgcgccagtccttgttatggggccatcgctagcggcttgatccgccagaagcggcaggcgtcatctacttctaaggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 13029 - DNA, 203 bp, Homo sapiens
  source 1..203: mol_type = other DNA
ggcgcgccagtcctgtgatctcggccatcgctagcggcttgatccgccttggtaattgcatacgggagcagcactgggaccggccgtctgccagcaggaggcggagcagccccagcaagaaccgcgggctctgcaacggcaacctggtggatatcttctccaaagtgcgcatcttcggcctcaagaagcgactcggaccgatg

SEQ ID NO: 13030 - DNA, 203 bp, Homo sapiens
  source 1..203: mol_type = other DNA
ggcgcgccagtccttcctggctggccatgtcttaggacctgctgtccgacttacaggacatcagcgacagcgagaggaagaccagctcggccgagtcctcgtcagcagaatcaggctcaggttctgaggaagaagaggaggaggaggaagaggaggaggaggaagggagcaccagtgaagaatcagagcgactcggaccgatg

SEQ ID NO: 13031 - DNA, 203 bp, Homo sapiens
  source 1..203: mol_type = other DNA
ggcgcgccagtccttttagacgggcccatcagttccaccccttgtagtgcatcactactgctattgagcaggctgctctagcagcggccaactctgcccttgcgaatgctgtggtagttaggccttttctctctcaccagcagattgagatccttattaacctaatgcaacctcgccagcttgttttccgactcggaccgatg

SEQ ID NO: 13032 - DNA, 203 bp, Homo sapiens
  source 1..203: mol_type = other DNA
ggcgcgccagtccttgacgggcggcccatcagtttattaaggctcctggcatcactactgctattgagcaggctgccggcaacctttgggactctgcccttgcgaatgctgtggtagttaggccttttctctctcaccagcagattgagatccttattaacctaatgcaacctcgccagcttgttttccgactcggaccgatg

SEQ ID NO: 13033 - DNA, 203 bp, Homo sapiens
  source 1..203: mol_type = other DNA
ggcgcgccagtcctgcgtgtaaggcccatcagtttattaaggctcctggcatcactactgctattgagcaggctgctctagcagcggccaactctgcccttgcgaatgctgtggtagtatccagcaaatatcctcaccagcagattgagatccttattaacctaatgcaacctcgccagcttgttttccgactcggaccgatg

SEQ ID NO: 13034 - DNA, 203 bp, Homo sapiens
  source 1..203: mol_type = other DNA
ggcgcgccagtccttcagaagaggcccatcagtttattaaggctcctggcatcactactgctattgagcaggctgctctagcagcggccaactctgcccttgcgaatgctgtggtagttaggccttttctctctcaccagcagattttcgatggagaatgcctaatgcaacctcgccagcttgttttccgactcggaccgatg

SEQ ID NO: 13035 - DNA, 203 bp, Homo sapiens
  source 1..203: mol_type = other DNA
ggcgcgccagtcctatcttagcggcccatcagtttattaaggctcctggcatcactactgctattgagcaggctgctctagcagcggccaactctgcccttgcgaatgctgtggtagttaggccttttctcttaactgcatgctcggagatccttattaacctaatgcaacctcgccagcttgttttccgactcggaccgatg

SEQ ID NO: 13036 - DNA, 203 bp, Homo sapiens
  source 1..203: mol_type = other DNA
ggcgcgccagtcctgcaaggttggcccatcagtttattaaggctcctggcatcactactgcttccctcgttcgatgtctagcagcggccaactctgcccttgcgaatgctgtggtagttaggccttttctctctcaccagcagattgagatccttattaacctaatgcaacctcgccagcttgttttccgactcggaccgatg

SEQ ID NO: 13037 - DNA, 203 bp, Homo sapiens
  source 1..203: mol_type = other DNA
ggcgcgccagtccttctaacgaggccccacagccaagatcacacttgtacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 13038 - DNA, 203 bp, Homo sapiens
  source 1..203: mol_type = other DNA
ggcgcgccagtcctacagatagggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 13039 - DNA, 203 bp, Homo sapiens
  source 1..203: mol_type = other DNA
ggcgcgccagtcctgctctataggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttttgtcggaatttcacgactcggaccgatg

SEQ ID NO: 13040 - DNA, 203 bp, Homo sapiens
  source 1..203: mol_type = other DNA
ggcgcgccagtcctggcggtgtggccccacagcccctgctgactcaaaacaactgagttgtaagacgttcatcgccgtgttatccttgagtaaagaatgaactctggaagcccagccagggacaatgcaccttcacagagattctgcactaatctgagtgcttaaaagcctaggggaatctccccctccgactcggaccgatg

SEQ ID NO: 13041 - DNA, 203 bp, Homo sapiens
  source 1..203: mol_type = other DNA
ggcgcgccagtccttgtgaacaggccccagggtgtgcagccactgactacctcgtcttcctcggggtagggatgagggagggaggggcattgtgatgtacagggctgctctgtgagatcaagggtctcttaagggtgggagctggggcagggactacgagagcagccagatgggctgaaagtggaactcgactcggaccgatg

SEQ ID NO: 13042 - DNA, 203 bp, Homo sapiens
  source 1..203: mol_type = other DNA
ggcgcgccagtccttcttacttggccccagggtgtgcagccactgacttggggactgctggtggggtagggatgagggagggaggggcattgtgatgtacagggagtaggccgtcttccaagggtctcttaagggtgggagctggggcagggactacgagagcagccagatgggctgaaagtggaactcgactcggaccgatg

SEQ ID NO: 13043 - DNA, 203 bp, Homo sapiens
  source 1..203: mol_type = other DNA
ggcgcgccagtccttcggatacggccccagggtgtgcagccactgacttggggactgctggtggggtagggatgagggagggaggggcattgtgatgtacagggctgctctgtgagatcaagggtctcttaagggtgggagctggggcagggactacgagagcagccagatggggaatcgcccagctgcgactcggaccgatg

SEQ ID NO: 13044 - DNA, 203 bp, Homo sapiens
  source 1..203: mol_type = other DNA
ggcgcgccagtcctgcgttaccggccccagggtgtgcagccactgacttggggactgctggtggggtagggatgagggagggaggggcattgtgatgtacagggctgctctgtgagatcaagggtctcttaataccaactcgcttcgcagggactacgagagcagccagatgggctgaaagtggaactcgactcggaccgatg

SEQ ID NO: 13045 - DNA, 203 bp, Homo sapiens
  source 1..203: mol_type = other DNA
ggcgcgccagtcctgcctggtcggccccctttccacgcagaagagagagctacagatcgtctgctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13046 - DNA, 203 bp, Homo sapiens
  source 1..203: mol_type = other DNA
ggcgcgccagtcctaagtctgaggccccctttccttaacagtctcctcgctacagatcgtcactaaattcagcctcgcccgagacccacttccccagtctcgcccgggtggaggtcgacgaggaggagacaagagtcacccttcctccaggcggcgccggccccctcattatacctggtgtcctataacgactcggaccgatg

SEQ ID NO: 13047 - DNA, 203 bp, Homo sapiens
  source 1..203: mol_type = other DNA
ggcgcgccagtcctctcagagaggccccctttccttaacagtctcctcgctacagatcgtctgctccctcagcctcaagatcctttaggatccccagtctcgcccgggtggaggtcgacgaggaggagacaagagtcacccttcctccaggcggcgccggccccctcacccgcgggtgtgtcctataacgactcggaccgatg

SEQ ID NO: 13048 - DNA, 203 bp, Homo sapiens
  source 1..203: mol_type = other DNA
ggcgcgccagtcctagtctacaggccccctttccttaacagtctcctcgctacagatcgtctgctccctcagcctcgcccgagacccactgattacccggacatcgggtggaggtcgacgaggaggagacaagagtcacccttcctccaggcggcgccggccccctcacccgcgggtgtgtcctataacgactcggaccgatg

SEQ ID NO: 13049 - DNA, 203 bp, Homo sapiens
  source 1..203: mol_type = other DNA
ggcgcgccagtcctactgccctggccccctttccttaacagtctcctcgctacagatcgtctgctccctcagcctcgcccgagacccacttccccagtctcgccatctatagaaaaaccgaggaggagacaagagtcacccttcctccaggcggcgccggccccctcacccgcgggtgtgtcctataacgactcggaccgatg

SEQ ID NO: 13050 - DNA, 203 bp, Homo sapiens
  source 1..203: mol_type = other DNA
ggcgcgccagtcctagcagcttggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgacgcgtcaaatattcgactcggaccgatg

SEQ ID NO: 13051 - DNA, 203 bp, Homo sapiens
  source 1..203: mol_type = other DNA
ggcgcgccagtcctataaagttggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13052 - DNA, 203 bp, Homo sapiens
  source 1..203: mol_type = other DNA
ggcgcgccagtcctcacgtagcggccccctttccttaacagtctcctcgctacagatcgtctgctccctcagcctcgcccgagacccacttccccagtctcgcccgggtggaggtcgacgaggaggagacaagagtcacccttcctttctatatgtaaatccccctcacccgcgggtgtgtcctataacgactcggaccgatg

SEQ ID NO: 13053 - DNA, 203 bp, Homo sapiens
  source 1..203: mol_type = other DNA
ggcgcgccagtcctgaccactcggccccctttccttaacagtctcctcgctacagatcgtctgctccctcagcctcgcccgagacccacttccccagtctcgcccgggtggaggtcgagttctccccaggtcgagtcacccttcctccaggcggcgccggccccctcacccgcgggtgtgtcctataacgactcggaccgatg

SEQ ID NO: 13054 - DNA, 203 bp, Homo sapiens
  source 1..203: mol_type = other DNA
ggcgcgccagtcctgtcattctggccccctttccttaacagtctcctcgctacagatcgtcttagtatgagaataagcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13055 - DNA, 203 bp, Homo sapiens
  source 1..203: mol_type = other DNA
ggcgcgccagtcctctgcaataggccccctttccttaacagtctcctctggcatttcgcggagctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 13056 - DNA, 203 bp, Homo sapiens
  source 1..203: mol_type = other DNA
ggcgcgccagtcctttcatcgcggccgccatgagttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 13057 - DNA, 203 bp, Homo sapiens
  source 1..203: mol_type = other DNA
ggcgcgccagtcctaggtaactggccgctccgggcgccttctccctgccccgccgcgtctcgcctgcgcgggctccaagcgcagccttaaacttggaacttgtgtgaatcagcgccccgatcccgagagggctcttccttcggccccatcactcccacaatggaagggcggccgcctccggaaggccgcgactcggaccgatg

SEQ ID NO: 13058 - DNA, 203 bp, Homo sapiens
  source 1..203: mol_type = other DNA
ggcgcgccagtcctgcattgtaggccgctccgggcgccttctccctgccccgccgcgtctcgcctgcgcgggctccaagcgcagccttaacaggctccgaaacttgaatcagcgccccacattgcgtccacatcttccttcggccccatcactcccacaatggaagggcggccgcctccggaaggccgcgactcggaccgatg

SEQ ID NO: 13059 - DNA, 203 bp, Homo sapiens
  source 1..203: mol_type = other DNA
ggcgcgccagtcctacaagcgcggccgctccgggcgccttctccctgccccgccgcgtctcgcctgcgcgggctccaagcgcagccttaacaggctccgaaacttgaatcagcgccccgatcccgagagggctcttccttcggccccattcacgttacaatggaagggcggccgcctccggaaggccgcgactcggaccgatg

SEQ ID NO: 13060 - DNA, 203 bp, Homo sapiens
  source 1..203: mol_type = other DNA
ggcgcgccagtcctcttactagggccggaacccttgagaccagaggctcttagcctattgagctaggagggccaggaactgctgacgtgaccactggacagttattcgtgtctcttacaattaccaaacagaatggacaagcttaataaaataaccgtccccgccagtcagaagttgaggcagcttcacgactcggaccgatg

SEQ ID NO: 13061 - DNA, 203 bp, Homo sapiens
  source 1..203: mol_type = other DNA
ggcgcgccagtcctagttcctcggccggaacccttgagaccagaggcttaccatgctgctccctaggagggccaggaactgctgacgtgaaactaaagtgtggcttcgtgtctcttacaattaccaaacagaatggacaagcttaataaaataaccgtccccgccagtcagaagttgaggcagcttcacgactcggaccgatg

SEQ ID NO: 13062 - DNA, 203 bp, Homo sapiens
  source 1..203: mol_type = other DNA
ggcgcgccagtcctcctggacaggccggaacccttgagaccagaggcttaccatgctgctccctaggagggccaggaactgctgacgtgaccactggacagttaagatcacaatgagaaattaccaaacagaatggacaagcttaataaaataaccgtccccgccagtcagaagttgaggcagcttcacgactcggaccgatg

SEQ ID NO: 13063 - DNA, 203 bp, Homo sapiens
  source 1..203: mol_type = other DNA
ggcgcgccagtcctagattcgtggccggaacccttgagaccagaggcttaccatgctgctccctaggagggccaggaactgctgacgtgaccactggacagttattcgtgtctcttacaattaccaaacagaatggacaagcttaagtggcctgataataccgccagtcagaagttgaggcagcttcacgactcggaccgatg

SEQ ID NO: 13064 - DNA, 203 bp, Homo sapiens
  source 1..203: mol_type = other DNA
ggcgcgccagtcctcataagcgggccggaacccttgagaccagaggcttaccatgctgctccctaggagggccaggaactgctgacgtgaccactggacagttattcgtgtctcttacaattaccaaacagaatggacaagcttaataaaataaccgtcctgttttcaagagtcttgaggcagcttcacgactcggaccgatg

SEQ ID NO: 13065 - DNA, 203 bp, Homo sapiens
  source 1..203: mol_type = other DNA
ggcgcgccagtcctcaggtacaggccggaacccttgagaccagaggcttaccatgctgctccctaggagggccaggaactgctgacgtgaccactggacagttattcgtgtctcttacaattaccaaacagacattgatttaaatttaaaataaccgtccccgccagtcagaagttgaggcagcttcacgactcggaccgatg

SEQ ID NO: 13066 - DNA, 203 bp, Homo sapiens
  source 1..203: mol_type = other DNA
ggcgcgccagtcctctatacaaggccggaacccttgagaccagaggcttaccatgctgctccctaggagggccaggcgtcaaaacaagctccactggacagttattcgtgtctcttacaattaccaaacagaatggacaagcttaataaaataaccgtccccgccagtcagaagttgaggcagcttcacgactcggaccgatg

SEQ ID NO: 13067 - DNA, 203 bp, Homo sapiens
  source 1..203: mol_type = other DNA
ggcgcgccagtcctaacgcggcggccggcgggcgcttacgtttacagagagaggcgcggggagccaggcctcggggcctcggagcaaccacccgagcagacggagtacacggagcagcggccccggccccgccaacgctgccgccggctactccctcttgatgccctcccctttgcccctcactcaggcgactcggaccgatg

SEQ ID NO: 13068 - DNA, 203 bp, Homo sapiens
  source 1..203: mol_type = other DNA
ggcgcgccagtccttcgatcgtggccggcgggcgggcggaagagggagagaccaaattataggccaggcctcggggcctcggagcaaccacccgagcagacggagtacacggagcagcggccccggccccgccaacgctgccgccggctactccctcttgatgccctcccctttgcccctcactcaggcgactcggaccgatg

SEQ ID NO: 13069 - DNA, 203 bp, Homo sapiens
  source 1..203: mol_type = other DNA
ggcgcgccagtcctgatccagaggccggcgggcgggcggaagagggaggagaggcgcggggacgggtcgtagattacctcggagcaaccacccgagcagacggagtacacggagcagcggccccggccccgccaacgctgccgccggctactccctcttgatgccctcccctttgcccctcactcaggcgactcggaccgatg

SEQ ID NO: 13070 - DNA, 203 bp, Homo sapiens
  source 1..203: mol_type = other DNA
ggcgcgccagtcctcccatttgggccggcgggcgggcggaagagggaggagaggcgcggggagccaggcctcggggcctcggagcaaccacccgagcagacggagtacacggagcagcccagagcctatgcacaacgctgccgccggctactccctcttgatgccctcccctttgcccctcactcaggcgactcggaccgatg

SEQ ID NO: 13071 - DNA, 203 bp, Homo sapiens
  source 1..203: mol_type = other DNA
ggcgcgccagtcctaatctttaggccggcgggcgggcggaagagggaggagaggcgcggggagccaggcctcggggcctcggagcaaccacccgagcagacggagtacacggagcagcggccccggccccgccaacgctgccgccggcctgaatttcttgatgccctcccctttgcccctcactcaggcgactcggaccgatg

SEQ ID NO: 13072 - DNA, 203 bp, Homo sapiens
  source 1..203: mol_type = other DNA
ggcgcgccagtcctgggccggcggccggcgggcgggcggaagagggaggagaggcgcggggagccaggcctcggggcctcggagcaaccacccgagcagacggagtacacggagcagcggccccggccccgccaacgctgccgccggctactccctcttgatgccctcccctttgcccctcactcaggcgactcggaccgatg

SEQ ID NO: 13073 - DNA, 203 bp, Homo sapiens
  source 1..203: mol_type = other DNA
ggcgcgccagtccttttacgacggccggcgggcgggcggaagagggaggagaggcgcggggagccaggcctcggggcctcggagcaaccatgatctgctctttggtacacggagcagcggccccggccccgccaacgctgccgccggctactccctcttgatgccctcccctttgcccctcactcaggcgactcggaccgatg

SEQ ID NO: 13074 - DNA, 203 bp, Homo sapiens
  source 1..203: mol_type = other DNA
ggcgcgccagtcctgtcgtcaaggcctgctgatgttatggtgacaattgagagattgttaccatatagctattggattggccatccggtgaccaatagagctattatatatctctttgttgggtttataccacttagcttgaaagaggttaaaacattacaattcattgttaagttgaatacagcaaacgactcggaccgatg

SEQ ID NO: 13075 - DNA, 203 bp, Homo sapiens
  source 1..203: mol_type = other DNA
ggcgcgccagtccttacataacggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccaccaccattcttctaagttgccgcggcagcccgactcggaccgatg

SEQ ID NO: 13076 - DNA, 203 bp, Homo sapiens
  source 1..203: mol_type = other DNA
ggcgcgccagtccttcagtgccggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccagaatatcaagtaacgactcggaccgatg

SEQ ID NO: 13077 - DNA, 203 bp, Homo sapiens
  source 1..203: mol_type = other DNA
ggcgcgccagtcctccgccatgggcgagagcgtatggagccgagccgttagcgcgcgccgtcggtgagtcagtccgtccgtccgtccgtccgtcggggcgccgcagctcccgccaggcccagcggccccggctgtcatctctaggacacccggagccacccggtggagcgggccttgccgcggcagcccgactcggaccgatg

SEQ ID NO: 13078 - DNA, 203 bp, Homo sapiens
  source 1..203: mol_type = other DNA
ggcgcgccagtcctatggctccggcgcggccggagagtataattcactgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagcgactcggaccgatg

SEQ ID NO: 13079 - DNA, 203 bp, Homo sapiens
  source 1..203: mol_type = other DNA
ggcgcgccagtcctcatatcttggcgcggccggattccgggcagtgactgacttaatccttacgcggcgcatttccgcctctggcgaatggctcgtctgtagtgcacgccgcgggcccagctgcgaccccggccccgcccccgggaccccggccatggacgaactgttccccctcatcttcccggcagcgactcggaccgatg

SEQ ID NO: 13080 - DNA, 203 bp, Homo sapiens
  source 1..203: mol_type = other DNA
ggcgcgccagtccttttgaaatggcgctggcacctcctcttacagcttgctgatcgccagcttgggaaaaggccggagaaggtgaaattctgtggagcggttccggcgagagactttgtcagctcccgcacagtaacgtggaagtccaagaatccgagtggaggctcaccgaggcgaaggggccaacccgactcggaccgatg

SEQ ID NO: 13081 - DNA, 203 bp, Homo sapiens
  source 1..203: mol_type = other DNA
ggcgcgccagtcctccggctgaggcgctggcacctcctcttacagcttgctgatcgccagcttgggaaaaggccggagaaggtgaaattctgtgtgctccctccggcgagagactttgtcagctcccgcacagtaacgtggaagtccaagaatccgagtggaggctcaccgaggcgaaggggccaacccgactcggaccgatg

SEQ ID NO: 13082 - DNA, 203 bp, Homo sapiens
  source 1..203: mol_type = other DNA
ggcgcgccagtcctaatattctggcgctggcacctcctcttacagctttactcctgccagcttgggaaaaggccggagaaggtgaaattctgtgtgctccctcccttttctagaaaaatcagctcccgcacagtaacgtggaagtccaagaatccgagtggaggctcaccgaggcgaaggggccaacccgactcggaccgatg

SEQ ID NO: 13083 - DNA, 203 bp, Homo sapiens
  source 1..203: mol_type = other DNA
ggcgcgccagtcctgagcattgggcgctggcacctcctcttacagctttactcctgccagcttgggaaaaggccggagaaggtgaaattctgtgtgctccctccggcgagagactttgcggagaggatatatgtaacgtggaagtccaagaatccgagtggaggctcaccgaggcgaaggggccaacccgactcggaccgatg

SEQ ID NO: 13084 - DNA, 203 bp, Homo sapiens
  source 1..203: mol_type = other DNA
ggcgcgccagtccttagttgagggcgctggcacctcctcttacagctttactcctgccagcttgggaaaaggccggagaaggtgaaattctgtgtgctccctccggcgagagactttgtcagctcccgcacatggcatgcactacacaagaatccgagtggaggctcaccgaggcgaaggggccaacccgactcggaccgatg

SEQ ID NO: 13085 - DNA, 203 bp, Homo sapiens
  source 1..203: mol_type = other DNA
ggcgcgccagtcctaacaacgtggcggcgcgcgggcgcctggggcgggacttccggcgcgctggagcgttttccggccgtgcgtttgtggccgtccggcctccctgacatgcagccctctggaccccgaggttggaccctactgtggagactagctgtgccggacactcttcaacctcctctggcttgcgactcggaccgatg

SEQ ID NO: 13086 - DNA, 203 bp, Homo sapiens
  source 1..203: mol_type = other DNA
ggcgcgccagtcctggtgtacgggcggcgcgcgggcgcctggggcgggacttccggcgcgctggagcgttttccggggtaagacagtataccgtccggcctccctgacatgcagccctctggaccccgaggttggaccctactgtgacacacctaccatgcggacactcttcaacctcctctggcttgcgactcggaccgatg

SEQ ID NO: 13087 - DNA, 203 bp, Homo sapiens
  source 1..203: mol_type = other DNA
ggcgcgccagtccttaaacgcgggcggcgcgcggtgcataccacttttacttccggcgcgctggagcgttttccggccgtgcgtttgtggccgtccggcctccctgacatgcagccctctggaccccgaggttggaccctactgtgacacacctaccatgcggacactcttcaacctcctctggcttgcgactcggaccgatg

SEQ ID NO: 13088 - DNA, 203 bp, Homo sapiens
  source 1..203: mol_type = other DNA
ggcgcgccagtcctaggtccatggcggctgcagcaacctgcacagccggagagcgcagagaagcagaggaccaagaggcagaatgccggcgctccaccgcccgagactgtgtttcctgtgagtccagatgtgtgatccagatatgctgcaatggtgacataaactgttgactgagactaggagcgtgccgactcggaccgatg

SEQ ID NO: 13089 - DNA, 203 bp, Homo sapiens
  source 1..203: mol_type = other DNA
ggcgcgccagtccttaacagcaggcggctgcagccgtggctctgcagcgagagcgcagagaagcagaggaccaagaggcagaatgccggcgctccaccgcccgagactgtgtttcctgtgagtccagatgtgcctatagatagctttgcaatggtgacataaactgttgactgagactaggagcgtgccgactcggaccgatg

SEQ ID NO: 13090 - DNA, 203 bp, Homo sapiens
  source 1..203: mol_type = other DNA
ggcgcgccagtcctgttacaatggcgggaggcgcagccgggctgtcggtggacctgcccactaacttaacttataaggaggacgaggaggaggccgtccacgagcaatgccagcatgagagagacaggcagcttcaggcccaggacgaggagggaggcggccatgtccccgagcggccgaagcaggagcgactcggaccgatg

SEQ ID NO: 13091 - DNA, 203 bp, Homo sapiens
  source 1..203: mol_type = other DNA
ggcgcgccagtcctggccacggggcgggaggcgcagccgggctgtcggtggacctgcccactgctcagtggagcgtggaggacgaggaggaggccgtccacgagcaatgccagcatgagagagacaggcagccagtttaatgtcttgaggagggaggcggccatgtccccgagcggccgaagcaggagcgactcggaccgatg

SEQ ID NO: 13092 - DNA, 203 bp, Homo sapiens
  source 1..203: mol_type = other DNA
ggcgcgccagtcctgggcatcaggcgggaggcgcagccgggctgtcggtggacctgcccactgctcagtggagcgtggaggacgaggaggaggccgtccacgagcaatgccagcatgagagagacaggcagcttcaggcccaggacgaggagggaggcggccatgtccccgagcacagttgaagctgccgactcggaccgatg

SEQ ID NO: 13093 - DNA, 203 bp, Homo sapiens
  source 1..203: mol_type = other DNA
ggcgcgccagtcctgcgacagcggcgggaggcgcagccgggctgtcggtggacctgcccactgctcagtggagcgtggaggacgaggaggaggccgtccacgagcaatgccagcatgagagagacaggcagcttcaggcccaggactgtcgcatgtaataccatgtccccgagcggccgaagcaggagcgactcggaccgatg

SEQ ID NO: 13094 - DNA, 203 bp, Homo sapiens
  source 1..203: mol_type = other DNA
ggcgcgccagtccttaagtctaggcgggaggcgcagccgggctgtcggtggacctgcccactgctcagtggagcgtggaggacgaggaggaggccgtccacgagcaatgccagcatgatttgacagccacttttcaggcccaggacgaggagggaggcggccatgtccccgagcggccgaagcaggagcgactcggaccgatg

SEQ ID NO: 13095 - DNA, 203 bp, Homo sapiens
  source 1..203: mol_type = other DNA
ggcgcgccagtccttgcaccggggcgtggccggagctgcggcggcaagcgggctgggactgcaattattaacatctcccggcgagcagctcagaccatgtcgcctgaagaatggacgtatctagtggttcttcttatctccatccccatcggcttcctctttaagaaagccggtcctgggctgaagagcgactcggaccgatg

SEQ ID NO: 13096 - DNA, 203 bp, Homo sapiens
  source 1..203: mol_type = other DNA
ggcgcgccagtcctcgacatttggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagcgactcggaccgatg

SEQ ID NO: 13097 - DNA, 203 bp, Homo sapiens
  source 1..203: mol_type = other DNA
ggcgcgccagtcctggttagtcggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtgtctctggagcccccgactcggaccgatg

SEQ ID NO: 13098 - DNA, 203 bp, Homo sapiens
  source 1..203: mol_type = other DNA
ggcgcgccagtcctcaaagcacggcgtggccggagctgcggcggcaagcgggctgggactgctcggccgcctcctgcccggcgagcagcttgtgtatacctctgtgaagaatggacgtatctagtggttcttcttatctccatccccatcggcttcctctttaagaaagccggtcctgggctgaagagcgactcggaccgatg

SEQ ID NO: 13099 - DNA, 203 bp, Homo sapiens
  source 1..203: mol_type = other DNA
ggcgcgccagtcctcaaagtcgggcgtggccggatggcacctttgctacgggctgggactgctcggccgcctcctgcccggcgagcagctcagaccatgtcgcctgaagaatggacgtatctagtggttcttcttatctccatccccatcggcttcctctttaagaaagccggtcctgggctgaagagcgactcggaccgatg

SEQ ID NO: 13100 - DNA, 203 bp, Homo sapiens
  source 1..203: mol_type = other DNA
ggcgcgccagtcctcaccctctggctcaccgcacgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcgactcggaccgatg

SEQ ID NO: 13101 - DNA, 203 bp, Homo sapiens
  source 1..203: mol_type = other DNA
ggcgcgccagtcctggattatcggctccggccgcatcagtatatgccacgctcagcgccctctcaccgcccggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 13102 - DNA, 203 bp, Homo sapiens
  source 1..203: mol_type = other DNA
ggcgcgccagtcctagattaaaggctccggccgcgcgccccgcccttgcgctcagcgccctctcaccgcccggctctgtgtgctccgggacttcctgatgtgtgagagggtgagaacccagctctgggaccaagtcacttgcttccttacttagcaagactatcgacttgagcaaacttggacctgggcgactcggaccgatg

SEQ ID NO: 13103 - DNA, 203 bp, Homo sapiens
  source 1..203: mol_type = other DNA
ggcgcgccagtcctccagaaccggctccggccgcgcgccccgcccttgcgctcagcgccctctcaccgcccggctctgtgtgctccgggatggagcaggtgtgcagagggtgagaaccacatagccccgagcagtcacttgcttccttacttagcaagactatcgacttgagcaaacttggacctgggcgactcggaccgatg

SEQ ID NO: 13104 - DNA, 203 bp, Homo sapiens
  source 1..203: mol_type = other DNA
ggcgcgccagtcctagaaccgaggctccggccgcgcgccccgcccttgcgctcagcgccctctcaccgcccggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 13105 - DNA, 203 bp, Homo sapiens
  source 1..203: mol_type = other DNA
ggcgcgccagtcctagcctgggggctccggccgcgcgccccgcccttgcgctcagcgccctctcaccgcccggctctgtgtgctccgggatggagcaggtgtgcagagggtgagaacccagctctgggaccatcgtgacgatgaagttacttagcaagactatcgacttgagcaaacttggacctgggcgactcggaccgatg

SEQ ID NO: 13106 - DNA, 203 bp, Homo sapiens
  source 1..203: mol_type = other DNA
ggcgcgccagtccttcccataaggctcggattccaagtcatcctatgctcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13107 - DNA, 203 bp, Homo sapiens
  source 1..203: mol_type = other DNA
ggcgcgccagtcctcccgagctggctcggattccgcccgcgtgcgccaagggtcggcactcgaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13108 - DNA, 203 bp, Homo sapiens
  source 1..203: mol_type = other DNA
ggcgcgccagtcctctccaaccggctcggattccgcccgcgtgcgccatcccctcagctagcaggtgtgagcggctttctgcccgcagtctctacacagctcagcatcctgacgcctcctccccttgcagggaatgtctcgagaaacagactctgctgtgacgacttggccgccaggcaccgatcctccgactcggaccgatg

SEQ ID NO: 13109 - DNA, 203 bp, Homo sapiens
  source 1..203: mol_type = other DNA
ggcgcgccagtccttagagcgcggctcggattccgcccgcgtgcgccatcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13110 - DNA, 203 bp, Homo sapiens
  source 1..203: mol_type = other DNA
ggcgcgccagtcctggtccgtgggctcggattccgcccgcgtgcgccatcccctcagctagcaggtgtgagcggctttctgcccgcagtctctacacagctcagcatcctgacgcctcctccccttgcaggggcgtgaagctacttcagactctgctgtgcaattaacaggaaaaggcaccgatcctccgactcggaccgatg

SEQ ID NO: 13111 - DNA, 203 bp, Homo sapiens
  source 1..203: mol_type = other DNA
ggcgcgccagtcctatgtgagaggctcggattccgcccgcgtgcgccatcccctcagctagcccaaacagcgacagttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 13112 - DNA, 203 bp, Homo sapiens
  source 1..203: mol_type = other DNA
ggcgcgccagtcctggacaaccggctgcagcctgcaccgttgctgcccgctgcccaggacgctcaacccaccgttagagccagagtggtgcctcctacagaccaatctgcggccccaaggtggggggccctacagagatgctccgagagccaaggacatgaagaacaagctggggatcttcagacggccgactcggaccgatg

SEQ ID NO: 13113 - DNA, 203 bp, Homo sapiens
  source 1..203: mol_type = other DNA
ggcgcgccagtcctccgctgccggctgcagtggcattcgtgctcctccagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatcgactcggaccgatg

SEQ ID NO: 13114 - DNA, 203 bp, Homo sapiens
  source 1..203: mol_type = other DNA
ggcgcgccagtcctagtattaaggctgcagtggcgacgagcggaacggagtgcgggttcccggggagggggcgtgcaggatcgggttgtggggggtgcgctgtagggctaaggagaagatgagctttggggggccctgaggaggagtctgcagcaaccacaccgaggacagggtcgcagcgggggcatcgactcggaccgatg

SEQ ID NO: 13115 - DNA, 203 bp, Homo sapiens
  source 1..203: mol_type = other DNA
ggcgcgccagtcctctatagccggctgcagtggcgacgagcggaacggagtgcgggttcccggggagggggcgtgcaggatcgggttgtggggggtgcgctgtatcctctgctcattcatgagctttggggggccctgaggaggaggggagtcaggattaaccgaggacagggtcgcagcgggggcatcgactcggaccgatg

SEQ ID NO: 13116 - DNA, 203 bp, Homo sapiens
  source 1..203: mol_type = other DNA
ggcgcgccagtcctgcacctcaggctgcagtggcgacgagcggaacggagtgcgggttcccgttcgttcaatagtaaggatcgggttgtggggggtgcgctgtagggctaaggagaagatgagctttggggggccctgaggaggaggggagtcaggattaaccgaggacagggtcgcagcgggggcatcgactcggaccgatg

SEQ ID NO: 13117 - DNA, 203 bp, Homo sapiens
  source 1..203: mol_type = other DNA
ggcgcgccagtcctaggaacggggctgcagtggcgacgagcggaacggcagtaaccgaggacgggagggggcgtgcaggatcgggttgtggggggtgcgctgtagggctaaggagaagatgagctttggggggccctgaggaggaggggagtcaggattaaccgaggacagggtcgcagcgggggcatcgactcggaccgatg

SEQ ID NO: 13118 - DNA, 203 bp, Homo sapiens
  source 1..203: mol_type = other DNA
ggcgcgccagtcctatcgggtcggctggtcgatccgccatttcccctggtagacctggcagatgaggctagaaataccccactggcgacagtgttctagcctgcgtggctgcctgcacaccctatgggtgtgaagccaaacaatggacaaggtgtgaagagccccgtgtgctcgctttgagtcctccgcgactcggaccgatg

SEQ ID NO: 13119 - DNA, 203 bp, Homo sapiens
  source 1..203: mol_type = other DNA
ggcgcgccagtcctcctgctcgggctggtcgatccgccatttcccctggtagacctggcagatgaggctagaaataccccactggcgacagtgttctagcctgcgtggctgcctgcacaccctatgggtgtgtttatccgacggtaacaaggtgtgaagagccccgtgtgctcgctttgagtcctccgcgactcggaccgatg

SEQ ID NO: 13120 - DNA, 203 bp, Homo sapiens
  source 1..203: mol_type = other DNA
ggcgcgccagtcctcactgtgaggctggtcgatccgccatttcccctggtagacctggcagatgaggctagaaataccccactggcgacagtgttctagcctgctgttggcgtgaggaaccctatgggtgtgaagccaaacaatggacaaggtgtgaagagccccgtgtgctcgctttgagtcctccgcgactcggaccgatg

SEQ ID NO: 13121 - DNA, 203 bp, Homo sapiens
  source 1..203: mol_type = other DNA
ggcgcgccagtcctcattaggaggctggtcgatccgccatttcccctggtagacctggcagatgaggctagaaataccccactggcgacatatgctgcagtgttgtggctgcctgcacaccctatgggtgtgaagccaaacaatggacaaggtgtgaagagccccgtgtgctcgctttgagtcctccgcgactcggaccgatg

SEQ ID NO: 13122 - DNA, 203 bp, Homo sapiens
  source 1..203: mol_type = other DNA
ggcgcgccagtcctgttgtaacggcttgggtccagactgcgccacagcctctcgggagacgtgggccctcggaacctttttagtgccggactccgggccgcaggcagtcccgcggcagcaggatcacaggtggcagggactcagctcggaattctgtatacgggccaatttgtcatcccagtctttcacgactcggaccgatg

SEQ ID NO: 13123 - DNA, 203 bp, Homo sapiens
  source 1..203: mol_type = other DNA
ggcgcgccagtcctgcgcatgcggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 13124 - DNA, 203 bp, Homo sapiens
  source 1..203: mol_type = other DNA
ggcgcgccagtcctcctgggtcggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggtatgtccatccagtcgactcggaccgatg

SEQ ID NO: 13125 - DNA, 203 bp, Homo sapiens
  source 1..203: mol_type = other DNA
ggcgcgccagtcctatggtgagggcttgggtccagactgcgccacagcctctcgggagacgtgggccctcggaacctttttagtgccggactccgggccgcaggcagtcccgcggcagcaggatcacaggtggcagggactcagcttaatccatctgcctgaaaaagcacctggatcccagtctttcacgactcggaccgatg

SEQ ID NO: 13126 - DNA, 203 bp, Homo sapiens
  source 1..203: mol_type = other DNA
ggcgcgccagtcctattacatgggcttgggtccatttctacttgagcgctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 13127 - DNA, 203 bp, Homo sapiens
  source 1..203: mol_type = other DNA
ggcgcgccagtcctccagctacggctttctgcccgcagtctctacacagctcagcatcctgaaagaaaacagatacgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13128 - DNA, 203 bp, Homo sapiens
  source 1..203: mol_type = other DNA
ggcgcgccagtcctctcccaaaggctttctgcccgcagtctctacacagctcagcatcctgacgcctcctccccttgcaggggcgtgaagctacttcagactctagaaatcgcttgctgccgccaggcaccgatcctccccggtgagaaggtccacgaatcttactgcagacagatttgctcagcgcgcgactcggaccgatg

SEQ ID NO: 13129 - DNA, 203 bp, Homo sapiens
  source 1..203: mol_type = other DNA
ggcgcgccagtcctttgtagtaggctttctgcccgcagtctctacacagctcagcatcctgacgcctcctccccttgcaggggcgtgaagctacttcagactctgctgtgacgacttggccgccaggcaccgatcctccccggtgagaaggtccacgaattactggcggtctgaatttgctcagcgcgcgactcggaccgatg

SEQ ID NO: 13130 - DNA, 203 bp, Homo sapiens
  source 1..203: mol_type = other DNA
ggcgcgccagtcctctcggccaggctttctgcccgcagtctctacacagctcagcatcctgacgcctcctccccttgcaggggcgtgaagctacttcagactctgctgtgacgacttggccgccaggcaccgatcctccccggtgatttaacgtcgattacttactgcagacagatttgctcagcgcgcgactcggaccgatg

SEQ ID NO: 13131 - DNA, 203 bp, Homo sapiens
  source 1..203: mol_type = other DNA
ggcgcgccagtcctatgagcccggctttctgcccgcagtctctacacagctcagcatcctgacgcctcctccccttgcaggggcgtgaagtgctcctcctagtagctgtgacgacttggccgccaggcaccgatcctccccggtgagaaggtccacgaatcttactgcagacagatttgctcagcgcgcgactcggaccgatg

SEQ ID NO: 13132 - DNA, 203 bp, Homo sapiens
  source 1..203: mol_type = other DNA
ggcgcgccagtcctcgtgtcatggctttctgcccgcagtctctacacagctcagcatcctgacgcctcctcccctttatcatagtatgttctacttcagactctgctgtgacgacttggccgccaggcaccgatcctccccggtgagaaggtccacgaatcttactgcagacagatttgctcagcgcgcgactcggaccgatg

SEQ ID NO: 13133 - DNA, 203 bp, Homo sapiens
  source 1..203: mol_type = other DNA
ggcgcgccagtcctatgggctgggctttctgcccgcagtctctacacattaagttgcgtcagcgcctcctccccttgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13134 - DNA, 203 bp, Homo sapiens
  source 1..203: mol_type = other DNA
ggcgcgccagtccttccaccatggctttctgccctacacacgactgatgctcagcatcctgacgcctcctccccttgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13135 - DNA, 203 bp, Homo sapiens
  source 1..203: mol_type = other DNA
ggcgcgccagtcctccgtggtggggaaacgcacctgattttttacttattagtttgttttttctttaacctttcagcatcacagaggaagtagactgatattaacaatacttactaataataacgtgcctcatgaaataaagatccttgctccgggctcctaaaaatttcctgcgtctcatgccaagacgactcggaccgatg

SEQ ID NO: 13136 - DNA, 203 bp, Homo sapiens
  source 1..203: mol_type = other DNA
ggcgcgccagtcctgaatatccgggaaacgcacctgattttttacttattagtttgttttttctttaacctttcagcatcacagaggaagtagactgatattaacaatacttactaatgcctgttactaatgtgaaataaagatccgaaaggaattggaataaaaatttcctgcgtctcatgccaagacgactcggaccgatg

SEQ ID NO: 13137 - DNA, 203 bp, Homo sapiens
  source 1..203: mol_type = other DNA
ggcgcgccagtcctcttcagatgggaaacgcacctgattttttacttattagtttgttttttctttaacctttcagcatcacagaggaagtagactgatattaatgcgctactggtcgaataacgtgcctcatgaaataaagatccgaaaggaattggaataaaaatttcctgcgtctcatgccaagacgactcggaccgatg

SEQ ID NO: 13138 - DNA, 203 bp, Homo sapiens
  source 1..203: mol_type = other DNA
ggcgcgccagtcctgcgtaattgggaatgtgagggtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgcgactcggaccgatg

SEQ ID NO: 13139 - DNA, 203 bp, Homo sapiens
  source 1..203: mol_type = other DNA
ggcgcgccagtccttcaacctagggaccgctgcatgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatcgactcggaccgatg

SEQ ID NO: 13140 - DNA, 203 bp, Homo sapiens
  source 1..203: mol_type = other DNA
ggcgcgccagtcctcttccctggggagagccatacgtagggttaatcgcggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgacgactcggaccgatg

SEQ ID NO: 13141 - DNA, 203 bp, Homo sapiens
  source 1..203: mol_type = other DNA
ggcgcgccagtcctctttaagcgggagagccatagtggtctgcggaaccggtgagtacaccgcgtcgagtttaggtaccgggtcctttcttggataaacccgctcaatgcctggagatttgggcgtgcccccgcaagactgctagccgagtagtgttgggtcgcgaaaggccttgtggtactgcctgacgactcggaccgatg

SEQ ID NO: 13142 - DNA, 203 bp, Homo sapiens
  source 1..203: mol_type = other DNA
ggcgcgccagtcctaaccgacggggagagccatagtggtctgcggaaccggtgagtacaccggaattgccaggacgaccgggtcctttcttggataaacccgctattacttcatcatgttgggcgtgcccccgcaagactgctagccgagtagtgttgggtcgcgaaaggccttgtggtactgcctgacgactcggaccgatg

SEQ ID NO: 13143 - DNA, 203 bp, Homo sapiens
  source 1..203: mol_type = other DNA
ggcgcgccagtcctagacggttgggagatttgagagaaagactccagaagcccgcggggagagcaggggttctggggaagataaagcccttcatccaggatcccatgactcgtcgttcatgagatggaccaaacgcccccggcgcgtcctgaatatctggtctcagggattcgaactccccctgtgagcgactcggaccgatg

SEQ ID NO: 13144 - DNA, 203 bp, Homo sapiens
  source 1..203: mol_type = other DNA
ggcgcgccagtcctcaagttgagggagatttgagagaaagactccagaagcccgcggggagagcaggggttctggggaagataaagcccttcatccaggatccctctgtgaccataagatgagatggaccaaacgcccccggcgcgtcctgaatatctggtctcagggattcgaactccccctgtgagcgactcggaccgatg

SEQ ID NO: 13145 - DNA, 203 bp, Homo sapiens
  source 1..203: mol_type = other DNA
ggcgcgccagtcctttcgcgcggggatcctaggcatttttggttgcgcaattcaagtgtcctatttaaaatgggacaaatagtgacattcttccaggaagtgcctcatgtaatagaagaggtgatgaacattgttctcattgcactgtctgtactagcagctgatccttagacatacaattttgcaaccgactcggaccgatg

SEQ ID NO: 13146 - DNA, 203 bp, Homo sapiens
  source 1..203: mol_type = other DNA
ggcgcgccagtccttattaagtgggatcctaggcatttttggttgcgcaattcaagtgtcctcaccttccaattctaaatagtgacattcttccaggaagtgcctcatgtaatagaagaggtgatgaacattgttctcattgcactgtctgtactagcagtgctgaaaggtctgtacaattttgcaaccgactcggaccgatg

SEQ ID NO: 13147 - DNA, 203 bp, Homo sapiens
  source 1..203: mol_type = other DNA
ggcgcgccagtcctccaacggcgggatcctaggcgttttttagtcacgcttaaatctttgattgcgtcaatcatgggtcaattgttcagcttttttgaagaagttccgaatatcatccatgaggctatcaacatagctctgatagcagtgagcttaattgagatagaagctattatgattaacttgtgcgactcggaccgatg

SEQ ID NO: 13148 - DNA, 203 bp, Homo sapiens
  source 1..203: mol_type = other DNA
ggcgcgccagtcctaacattgggggatcctaggcgttttttagtcacgcttaaatctttgattgcgtcaatcatgggtcaattgttcagcttttttgaagaagttccgaatatcatccatgaggctatcaacatagctctgatagcagtgagcttaattgctgccttgaaagggatgattaacttgtgcgactcggaccgatg

SEQ ID NO: 13149 - DNA, 203 bp, Homo sapiens
  source 1..203: mol_type = other DNA
ggcgcgccagtcctggtttcgggggatcctaggcgttttttagtcacgcttaaatctttgattgcgtcaatcatgggtcaattgttcagcttttttgaagaagttccgaatatcatccatgaggctatcaacatagctctgatagctccaccgcgcgcacctgccttgaaagggatgattaacttgtgcgactcggaccgatg

SEQ ID NO: 13150 - DNA, 203 bp, Homo sapiens
  source 1..203: mol_type = other DNA
ggcgcgccagtccttcattcctgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccagtccaatagtatgagccccgcggcagccgactcggaccgatg

SEQ ID NO: 13151 - DNA, 203 bp, Homo sapiens
  source 1..203: mol_type = other DNA
ggcgcgccagtcctgggaaatcgggcagagagagggacgccccctcctcctccccgcctcttgtgaggcgcgcggagccgcctcccctgggtcaggtctgatgggccggtgggcgcgctagtggtggccgccaccgccgaaaccgtgacggggggtaatgccagttccgcgtccagccccgcggcagccgactcggaccgatg

SEQ ID NO: 13152 - DNA, 203 bp, Homo sapiens
  source 1..203: mol_type = other DNA
ggcgcgccagtccttctcagtcgggcataaaacacgcctccacccctgccctcctcaggccccctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13153 - DNA, 203 bp, Homo sapiens
  source 1..203: mol_type = other DNA
ggcgcgccagtccttgatggcggggcccaagcgtaaccaggctcttctgattggccggtgtacttcagtttccgtccaaggtccgcctcctacctccttctgcttcggtccttaggataagaccatggccttgagagcatgtggctgctgatatgagttgagatgcctcattcccaaagtggacaacacgactcggaccgatg

SEQ ID NO: 13154 - DNA, 203 bp, Homo sapiens
  source 1..203: mol_type = other DNA
ggcgcgccagtcctgagcggcagggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattccacgtcatatattgccgactcggaccgatg

SEQ ID NO: 13155 - DNA, 203 bp, Homo sapiens
  source 1..203: mol_type = other DNA
ggcgcgccagtcctggcatgtcgggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 13156 - DNA, 203 bp, Homo sapiens
  source 1..203: mol_type = other DNA
ggcgcgccagtcctcttcatcagggcccaagcgtaaccaggctcttctgattggccggtgtacttcagtttccgtccaaggtccgcctcctacctccttctgcttcggtccttaggataagaccatggccttttcgcttcaattgatgatcatcttccgaagatgcctcattcccaaagtggacaacacgactcggaccgatg

SEQ ID NO: 13157 - DNA, 203 bp, Homo sapiens
  source 1..203: mol_type = other DNA
ggcgcgccagtcctggagccgcgggcccaagcgtaaccaggctcttctgattggccggtgtatcggttaggtttcgcaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 13158 - DNA, 203 bp, Homo sapiens
  source 1..203: mol_type = other DNA
ggcgcgccagtcctcgcgactggggcccaagcgtaaccaggctcttctttgccataacacctcttcagtttccgtccaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 13159 - DNA, 203 bp, Homo sapiens
  source 1..203: mol_type = other DNA
ggcgcgccagtcctggcccttagggcgggcggccgcagagcagcaccggccgtggctccggtagcagcaagttcgaaccccgctcccgctaatagggccactcggctccttcggcccttgggcctccaaacaccagtccccggcagctcgttgcgcattgcgctctccccgccaccaggatgccggtacgactcggaccgatg

SEQ ID NO: 13160 - DNA, 203 bp, Homo sapiens
  source 1..203: mol_type = other DNA
ggcgcgccagtcctgttctagggggcgggcggccgcagagcagcaccgtatccttaaggcaaagcagcaagttcgaaccccgctcccgctccgcttcggttctcgctccttcggcccttgggcctccaaacaccagtccccggcagctcgttgcgcattgcgctctccccgccaccaggatgccggtacgactcggaccgatg

SEQ ID NO: 13161 - DNA, 203 bp, Homo sapiens
  source 1..203: mol_type = other DNA
ggcgcgccagtcctgcccagtggggcgtggcgttacagagcctctagcgctgggtgttggggacctgacgctatggagctctcggagtttaacctaattgtagcgtgagtggggggttcctgctgcgggatgagaacgtagacgccagtggctcactcgctcctggcaccttccctttcaggctccagcgactcggaccgatg

SEQ ID NO: 13162 - DNA, 203 bp, Homo sapiens
  source 1..203: mol_type = other DNA
ggcgcgccagtcctcattctcagggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagcgactcggaccgatg

SEQ ID NO: 13163 - DNA, 203 bp, Homo sapiens
  source 1..203: mol_type = other DNA
ggcgcgccagtccttgtaattagggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttcctaggaccatagttacgactcggaccgatg

SEQ ID NO: 13164 - DNA, 203 bp, Homo sapiens
  source 1..203: mol_type = other DNA
ggcgcgccagtcctcacagttcgggcgtggcgttacagagcctctagcgctgggtgttggggacctgacgctatggagctctcggagttttgtgggggacggctgtgagtggggggttcctgctgcgggatgagaacgtagacgccgtgctgaagtgtcgtcctggcaccttccctttcaggctccagcgactcggaccgatg

SEQ ID NO: 13165 - DNA, 203 bp, Homo sapiens
  source 1..203: mol_type = other DNA
ggcgcgccagtcctgtgttcgtgggcgtggcgttctcttaatctgctggctgggtgttggggacctgacgctatggagctctcggagttttgtgggggacggctgtgagtggggggttcctgctgcgggatgagaacgtagacgccagtggctcactcgctcctggcaccttccctttcaggctccagcgactcggaccgatg

SEQ ID NO: 13166 - DNA, 203 bp, Homo sapiens
  source 1..203: mol_type = other DNA
ggcgcgccagtcctcgcagaatgggctaaggatgggaactgatggttagcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13167 - DNA, 203 bp, Homo sapiens
  source 1..203: mol_type = other DNA
ggcgcgccagtcctgggcgcgtgggctaaggatgtcctacaggtaccccacaaatgaaaattgagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13168 - DNA, 203 bp, Homo sapiens
  source 1..203: mol_type = other DNA
ggcgcgccagtcctcgtggttagggctaaggatgtcctacaggtacccgcacgtaaccttcaattgtgagctcggcgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13169 - DNA, 203 bp, Homo sapiens
  source 1..203: mol_type = other DNA
ggcgcgccagtccttaacgcccgggctaaggatgtcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctcgactcggaccgatg

SEQ ID NO: 13170 - DNA, 203 bp, Homo sapiens
  source 1..203: mol_type = other DNA
ggcgcgccagtcctgaggcaccgggctccgggatctggtcgttagggtcaggtgagaaagcgagacaggcaggtagggaaatcgtgaggtgagcgtggtcctagctccttgtggcagagcctagagagaaggcgaggacgctgaagaaccaggcggacagctggcagagagagaagttggctagcatgcgactcggaccgatg

SEQ ID NO: 13171 - DNA, 203 bp, Homo sapiens
  source 1..203: mol_type = other DNA
ggcgcgccagtcctccatcacagggctccgggatgaaaggagggaacgcaggtgagaaagcgagacaggcaggtagccggtgttcactcggagcgtggtcctagctccttgtggcagagcctagagagaaggcgaggacgctgaagaaccaggcggacagctggcagagagagaagttggctagcatgcgactcggaccgatg

SEQ ID NO: 13172 - DNA, 203 bp, Homo sapiens
  source 1..203: mol_type = other DNA
ggcgcgccagtcctttgtcaccgggctccgggatgaaaggagggaacgcaggtgagaaagcgagacaggcaggtagggaaatcgtgaggtgagcgtggtcctagctccttgtggcagagcctagagagaaggcgaggacgctgaagaaccaggcggacagtcttatcttgtttcagttggctagcatgcgactcggaccgatg

SEQ ID NO: 13173 - DNA, 203 bp, Homo sapiens
  source 1..203: mol_type = other DNA
ggcgcgccagtcctacgactaggggctccgggatgaaaggagggaacgcaggtgagaaagcgagacaggcaggtagggaaatcgtgaggttccttgctcgtactctccttgtggcagagcctagagagaaggcgaggacgctgaagaaccaggcggacagctggcagagagagaagttggctagcatgcgactcggaccgatg

SEQ ID NO: 13174 - DNA, 203 bp, Homo sapiens
  source 1..203: mol_type = other DNA
ggcgcgccagtccttttcacaagggctccgggatgaaaggagggaacgttacgctacgttaaagacaggcaggtagggaaatcgtgaggtgagcgtggtcctagctccttgtggcagagcctagagagaaggcgaggacgctgaagaaccaggcggacagctggcagagagagaagttggctagcatgcgactcggaccgatg

SEQ ID NO: 13175 - DNA, 203 bp, Homo sapiens
  source 1..203: mol_type = other DNA
ggcgcgccagtcctgagagtttggggaggttggggacgggcctggcagttgtgaactcgaacctgccgctgtcgccgcggcggggcggggagcgagagtgggccgcggaggccggccttcgggctccatggacgggcgccgcgtccagaatggtggacgagcagagcagaggaagaaccgatgctggacgactcggaccgatg

SEQ ID NO: 13176 - DNA, 203 bp, Homo sapiens
  source 1..203: mol_type = other DNA
ggcgcgccagtcctttcagcctggggcagacagcgccggtggtgttcagtacgccacaagcgacacaaatgaacaccgtcataatcatgagccagcacttctaccctagccgggcccagcccccgagcagtgcagcctcccgagtgcagagtgcagcccctgcccgccctggcccagctgcccatgtccgactcggaccgatg

SEQ ID NO: 13177 - DNA, 203 bp, Homo sapiens
  source 1..203: mol_type = other DNA
ggcgcgccagtcctcgcctactggggcagacagcgccggtggtgttcagtacgccacaagcgacacaaatgaacacgccttctcagcccccgtctataggtggtcctagccgggcccagcccccgagcagtgcagcctcccgagtgcagagtgcagcccctgcccgccctggcccagctgcccatgtccgactcggaccgatg

SEQ ID NO: 13178 - DNA, 203 bp, Homo sapiens
  source 1..203: mol_type = other DNA
ggcgcgccagtcctctccatagggggcagacagcgccggtggtgttcagtacgccacaagcgacacaaatgaacacgccttctcagccccgccagcacttctaccctagccgggcccagcccccgagcagtgcagcctcccgagtgcagagtgcagccccattatatgtcaatgcagctgcccatgtccgactcggaccgatg

SEQ ID NO: 13179 - DNA, 203 bp, Homo sapiens
  source 1..203: mol_type = other DNA
ggcgcgccagtcctttgctaacggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtccgactcggaccgatg

SEQ ID NO: 13180 - DNA, 203 bp, Homo sapiens
  source 1..203: mol_type = other DNA
ggcgcgccagtcctggtaacacggggcagacagcgccggtggtgttcagtacgccacaagcgacacaaatgaacacgccttctcagccccgccagcacttctaccctagccgggcccagcccccgagcagtgcagcctcccgagtggcttcctgcaagagtgcccgccctggcccagctgcccatgtccgactcggaccgatg

SEQ ID NO: 13181 - DNA, 203 bp, Homo sapiens
  source 1..203: mol_type = other DNA
ggcgcgccagtcctcgaacttaggggcagacagcgccggtggtgttcagtacgccacaagcgacacaaatgaacacgccttctcagccccgccagcacttctacgagcctgtttgatcgcccccgagcagtgcagcctcccgagtgcagagtgcagcccctgcccgccctggcccagctgcccatgtccgactcggaccgatg

SEQ ID NO: 13182 - DNA, 203 bp, Homo sapiens
  source 1..203: mol_type = other DNA
ggcgcgccagtcctcataatatggggccacagcccgggctggggggagccggggtgcaagagggcaggctggatcaccggattagacgcgggaccgggctccgagtgtcaacgagagctagagacatgaggctgagctggttccgggtcctgacagtactgtccatctgcctgagcgccgtggccacgcgactcggaccgatg

SEQ ID NO: 13183 - DNA, 203 bp, Homo sapiens
  source 1..203: mol_type = other DNA
ggcgcgccagtcctctatcttcggggccacagcccgggctggggggagccggggtgcaagagggcaggctggatcaggccgggcagaaggggaccgggctccgagtgtcaacgagagctagagacatgaggcaatttattgcaaatgtcctgacagtactgtccatctgcctgagcgccgtggccacgcgactcggaccgatg

SEQ ID NO: 13184 - DNA, 203 bp, Homo sapiens
  source 1..203: mol_type = other DNA
ggcgcgccagtcctgtttctggggggccgcgcgtccaggcggcgagcggaagtgggtgtgagagcggaagtggccgataccttgtctttcctgggcggggaccgggcttgtcggtgaagcggcagtggcggcggcggcggcggctcggcaggcgggttcaggcttcgggggccagccgccgccatgatcgactcggaccgatg

SEQ ID NO: 13185 - DNA, 203 bp, Homo sapiens
  source 1..203: mol_type = other DNA
ggcgcgccagtcctctgaggctggggccgcgcgtccaggcggcgagcggaagtgggtgtgagagcggaagtggccggctagagccgggggctgggcggggaccgggcttgtcggtgaagcggcagtggcggcggcggcggcggctctaatacaatccggcggcttcgggggccagccgccgccatgatcgactcggaccgatg

SEQ ID NO: 13186 - DNA, 203 bp, Homo sapiens
  source 1..203: mol_type = other DNA
ggcgcgccagtccttacttcttggggccgcgcgtgttcttcttacttagaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcgactcggaccgatg

SEQ ID NO: 13187 - DNA, 203 bp, Homo sapiens
  source 1..203: mol_type = other DNA
ggcgcgccagtcctcggcagcgggggccgggcggccggcgcccccggctgctcccgccgccgcccggacccgcgccccgccggggcagcggtggtgagagccccgactccccggacgccgcccgccgtgccatggggttcccggccaatcgaaaatcagccgcgctgtgctgcggcctcctggccccgcgactcggaccgatg

SEQ ID NO: 13188 - DNA, 203 bp, Homo sapiens
  source 1..203: mol_type = other DNA
ggcgcgccagtccttcgtatgtggggcgcatcccctggcgactcctcccgttccctcttccgcttgcgctgccgcaaacttgcattagcgctggagcgcaccttcatcgccatcaagccggacggcgtgcagcgcggcctggtgggcgagatcatcaagcgcttcgagcagaagggattccgcctcgtcgactcggaccgatg

SEQ ID NO: 13189 - DNA, 203 bp, Homo sapiens
  source 1..203: mol_type = other DNA
ggcgcgccagtcctagaaagacggggcgcatcccctggcgactcctcccgttccctcttccgcttgcgctgccgcaggaccatggccaacctggagcgcaccttcatcgccatcaagccggacggcgtgcagcgcggcctggtgggcgagatcatcaagctacgttgatcagctggattccgcctcgtcgactcggaccgatg

SEQ ID NO: 13190 - DNA, 203 bp, Homo sapiens
  source 1..203: mol_type = other DNA
ggcgcgccagtcctatcgaggaggggcgcatcccctggcgactcctcccgttccctcttccgcttgcgctgccgcaggaccatggccaacctggagcgcaccttcatcgccatcaagccggacggcgtgcagcgcggcctggtgggttttcgatcattttgcttcgagcagaagggattccgcctcgtcgactcggaccgatg

SEQ ID NO: 13191 - DNA, 203 bp, Homo sapiens
  source 1..203: mol_type = other DNA
ggcgcgccagtcctactaacatggggcgcatcccctggcgactcctcccgttccctcttccgcttgcgctgccgcaggaccatggccaacctggagcgcaccttcatcgccatcaagccggacggcgtgcaggtttaagctaaatccgagatcatcaagcgcttcgagcagaagggattccgcctcgtcgactcggaccgatg

SEQ ID NO: 13192 - DNA, 203 bp, Homo sapiens
  source 1..203: mol_type = other DNA
ggcgcgccagtcctaataggccggggcgcatcccctggcgactcctccttacggtggcctatcttgcgctgccgcaggaccatggccaacctggagcgcaccttcatcgccatcaagccggacggcgtgcagcgcggcctggtgggcgagatcatcaagcgcttcgagcagaagggattccgcctcgtcgactcggaccgatg

SEQ ID NO: 13193 - DNA, 203 bp, Homo sapiens
  source 1..203: mol_type = other DNA
ggcgcgccagtcctgatttctagggggtccgggagtctgctatgtgggcggaggtctagtgattccccgggataagcctcactcgtcccctctcggggggcggaacacccacctgctagccccgctgctctctttgctttcctcctcgcttcggtctcccccaactcctagcatcccctcctatcgctcgactcggaccgatg

SEQ ID NO: 13194 - DNA, 203 bp, Homo sapiens
  source 1..203: mol_type = other DNA
ggcgcgccagtccttcatcatcgggggtccgggagtctgctatgtggggacgataagtcgaggctgaaaactgtcccctcactcgtcccctctcggggggcggaacacccacctgctagccccgctgctctctttgctttcctcctcgcttcggtctcccccaactcctagcatcccctcctatcgctcgactcggaccgatg

SEQ ID NO: 13195 - DNA, 203 bp, Homo sapiens
  source 1..203: mol_type = other DNA
ggcgcgccagtcctccttagaggggggtccgggagtctgctatgtggggacgataagtcgagttccccgggataagcctcactcgtcccccgggaactcagcagacacccacctgctagccccgctgctctctttgctttcctcctcgcttcggtctcccccaactcctagcatcccctcctatcgctcgactcggaccgatg

SEQ ID NO: 13196 - DNA, 203 bp, Homo sapiens
  source 1..203: mol_type = other DNA
ggcgcgccagtcctcgctcgccgggggtccgggagtctgctatgtggggacgataagtcgagttccccgggataagcctcactcgtcccctctcggggggcggaacacccacctgctagccccgctgctctctttgctttcctcctcgcttcggtctcccaatttggagttttgcccctcctatcgctcgactcggaccgatg

SEQ ID NO: 13197 - DNA, 203 bp, Homo sapiens
  source 1..203: mol_type = other DNA
ggcgcgccagtcctggcctatggggggtccgggagtctgctatgtggggacgataagtcgagttccccgggataagcctcactcgtcccctctcggggggcggaacacccacctgctatgagattcaaagaatttgctttcctcctcgcttcggtctcccccaactcctagcatcccctcctatcgctcgactcggaccgatg

SEQ ID NO: 13198 - DNA, 203 bp, Homo sapiens
  source 1..203: mol_type = other DNA
ggcgcgccagtcctaatttaccgggggtccgggatatcctggaccaaagacgataagtcgagttccccgggataagcctcactcgtcccctctcggggggcggaacacccacctgctagccccgctgctctctttgctttcctcctcgcttcggtctcccccaactcctagcatcccctcctatcgctcgactcggaccgatg

SEQ ID NO: 13199 - DNA, 203 bp, Homo sapiens
  source 1..203: mol_type = other DNA
ggcgcgccagtcctgactctgcggggtatactggcaaacttgcacattcggaaaaaatggggcaaataagaatttgataagtgctatttaagtctaaccttttcaatcagaaatggggtgcaattcactgagcatgataaaggttagattacaaaatttatttgacaatgacgaagtagcattgttaacgactcggaccgatg

SEQ ID NO: 13200 - DNA, 203 bp, Homo sapiens
  source 1..203: mol_type = other DNA
ggcgcgccagtcctcgttacccggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcgactcggaccgatg

SEQ ID NO: 13201 - DNA, 203 bp, Homo sapiens
  source 1..203: mol_type = other DNA
ggcgcgccagtcctgcgggatcgggtagcccaagaaccttcgggtgagattttactcttacatcttttcctataccgatcatggcagtccttctgctcctactcgtggtggaggccggggctattttagccccggccacccatgcttgtagcgcgaaagggcaatatttcctcacaaactgttgcgcccgactcggaccgatg

SEQ ID NO: 13202 - DNA, 203 bp, Homo sapiens
  source 1..203: mol_type = other DNA
ggcgcgccagtcctccgtccgcgggtagcccaagaaccttcgggtgagggcgggtggcatttcggacaaggggtttgatcatggcagtccttctgctcctactcgtggtggaggccggggctattttagccccggccacccatgcttgtagcgcgaaagggcaatatttcctcacaaactgttgcgcccgactcggaccgatg

SEQ ID NO: 13203 - DNA, 203 bp, Homo sapiens
  source 1..203: mol_type = other DNA
ggcgcgccagtcctcttagtttgggtagcccaagaaccttcgggtgagggcgggtggcattttcttttcctataccgatcatggcagtccttctgctcctactccgatgaagcagataggctattttagccccggccacccatgcttgtagcgcgaaagggcaatatttcctcacaaactgttgcgcccgactcggaccgatg

SEQ ID NO: 13204 - DNA, 203 bp, Homo sapiens
  source 1..203: mol_type = other DNA
ggcgcgccagtcctgtataagagggtagcccaagaaccttcgggtgagggcgggtggcattttcttttcctataccgatcatggcagtccttctgctcctactcgtggtggaggccggggctattttagcccttcgtgttgtgaggtgtagcgcgaaagggcaatatttcctcacaaactgttgcgcccgactcggaccgatg

SEQ ID NO: 13205 - DNA, 203 bp, Homo sapiens
  source 1..203: mol_type = other DNA
ggcgcgccagtccttggtggttgggtagcccaagaaccttcgggtgagggcgggtggcattttcttttcctataccgatcatggcagtccttctgctcctactcgtggtggaggccggtctgtgaggccgtacggccacccatgcttgtagcgcgaaagggcaatatttcctcacaaactgttgcgcccgactcggaccgatg

SEQ ID NO: 13206 - DNA, 203 bp, Homo sapiens
  source 1..203: mol_type = other DNA
ggcgcgccagtcctcagacgtggggtccgccgcgagaatattcaacttaggtttgtccccgccgccccgacgcttccgccgggtccgtcggcacgtcggccctgcctcccggaccaccctgcggggcgcaccagcgatctggggtgcggggctcggcctccctgcgctcctggctgacggtcttaacccgactcggaccgatg

SEQ ID NO: 13207 - DNA, 203 bp, Homo sapiens
  source 1..203: mol_type = other DNA
ggcgcgccagtcctggcgaagagggtccgccgcggtcgaggatcctggaggtttgtccccgccgccccgacgcttccgccgggtccgtcggcacgtcggccctgcctcccggaccaccctgcggggcgcaccagcgatctggggtgcggggctcggcctccctgcgctcctggctgacggtcttaacccgactcggaccgatg

SEQ ID NO: 13208 - DNA, 203 bp, Homo sapiens
  source 1..203: mol_type = other DNA
ggcgcgccagtcctgattgtaggggtccgccgcggtcgaggatcctggaggtttgtccccgccgccccgacgcttccgccgggtccgtcggcacgtcggccctgcctcccggaccaccctgcggggcgcaccagcgatctggggtgcggggctcggcctctaatatacaggctttgacggtcttaacccgactcggaccgatg

SEQ ID NO: 13209 - DNA, 203 bp, Homo sapiens
  source 1..203: mol_type = other DNA
ggcgcgccagtcctagggagtcgggtccgccgcggtcgaggatcctgggacaaaaggagtcacgccccgacgcttccgccgggtccgtcggcacgtcggccctgcctcccggaccaccctgcggggcgcaccagcgatctggggtgcggggctcggcctccctgcgctcctggctgacggtcttaacccgactcggaccgatg

SEQ ID NO: 13210 - DNA, 203 bp, Homo sapiens
  source 1..203: mol_type = other DNA
ggcgcgccagtcctgttggcatgggtgtaaactagcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13211 - DNA, 203 bp, Homo sapiens
  source 1..203: mol_type = other DNA
ggcgcgccagtcctgtaagacagggttctacttgagatttccctcgtggtgccagggtccggcgagcatcacgccgaggcccattttccagacgaccacgacgacagaatatattgttactctggcgccccttaccagcttccagtctctcgaggtggccagtgtggtgcttggtccttgtttccaggcgactcggaccgatg

SEQ ID NO: 13212 - DNA, 203 bp, Homo sapiens
  source 1..203: mol_type = other DNA
ggcgcgccagtcctacagccaagggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggcgactcggaccgatg

SEQ ID NO: 13213 - DNA, 203 bp, Homo sapiens
  source 1..203: mol_type = other DNA
ggcgcgccagtcctgaagttacgggttctacttgagatttccctcgtggtgccagggtccggcgagcatcacgccgaggcccattttccagacgaccacgacgaggccggggtcacgaactctggcgccccttaccagcttccagtctctcgaggtggccctctgtccatggaatccttgtttccaggcgactcggaccgatg

SEQ ID NO: 13214 - DNA, 203 bp, Homo sapiens
  source 1..203: mol_type = other DNA
ggcgcgccagtcctcccttgcagggttctacttgagatttccctcgtggtgccagggtccggcgagcatcacgccgaggcccattttccagacgaccacgacgaggccggggtcacgaactctggcgccccttaccagcttccagttatatagacccttgagtgtggtgcttggtccttgtttccaggcgactcggaccgatg

SEQ ID NO: 13215 - DNA, 203 bp, Homo sapiens
  source 1..203: mol_type = other DNA
ggcgcgccagtcctcttaccgtgggttctacttgagatttccctcgtggtgccagggtccggcgagcatcacgccgtttatacacgatatgacgaccacgacgaggccggggtcacgaactctggcgccccttaccagcttccagtctctcgaggtggccagtgtggtgcttggtccttgtttccaggcgactcggaccgatg

SEQ ID NO: 13216 - DNA, 203 bp, Homo sapiens
  source 1..203: mol_type = other DNA
ggcgcgccagtccttgagataagggttctacttgttgcgatatgatgagtgccagggtccggcgagcatcacgccgaggcccattttccagacgaccacgacgaggccggggtcacgaactctggcgccccttaccagcttccagtctctcgaggtggccagtgtggtgcttggtccttgtttccaggcgactcggaccgatg

SEQ ID NO: 13217 - DNA, 203 bp, Homo sapiens
  source 1..203: mol_type = other DNA
ggcgcgccagtcctataagttggggttgctgacgaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgcgactcggaccgatg

SEQ ID NO: 13218 - DNA, 203 bp, Homo sapiens
  source 1..203: mol_type = other DNA
ggcgcgccagtccttgagtgatggtaaggagaggaggttacggggaacgacgcgctgctttcatgccctttcttgttctaccttcatcggccgaggtggacacccttaacacctcagaccctccggcccctgaagcatggccagcagcggcatggctgacagcgccaaccacctgcccttctttttcgcgactcggaccgatg

SEQ ID NO: 13219 - DNA, 203 bp, Homo sapiens
  source 1..203: mol_type = other DNA
ggcgcgccagtcctaccatcaaggtaaggagaggaggttacggggaacgacgcgctgctttcatgccctttcttgttctaccttcatcggccgaggtggacacctgcgcaggtgtgtgattctttctatgctaagcatggccagcagcggcatggctgacagcgccaaccacctgcccttctttttcgcgactcggaccgatg

SEQ ID NO: 13220 - DNA, 203 bp, Homo sapiens
  source 1..203: mol_type = other DNA
ggcgcgccagtcctgaatcctcggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 13221 - DNA, 203 bp, Homo sapiens
  source 1..203: mol_type = other DNA
ggcgcgccagtcctggagactaggtaaggagaggaggttacggggaacgacgcgctgctttcatgccctttcttgttctaccttcatcggccgaggtggacacctgcgcaggtgtgtgccctccggcccctgaagcatggccagcagcggcatggctgacttgtatcggactaagcccttctttttcgcgactcggaccgatg

SEQ ID NO: 13222 - DNA, 203 bp, Homo sapiens
  source 1..203: mol_type = other DNA
ggcgcgccagtcctagctgcggggtaaggagaggaggttacggggaacgacgcgctgctttcatgccctttcttgttctaccttcatcggccgaggtggacacctgcgcaggtgtgtgccctccggcccctgaagcatggccagcattaattgccaccctagcgccaaccacctgcccttctttttcgcgactcggaccgatg

SEQ ID NO: 13223 - DNA, 203 bp, Homo sapiens
  source 1..203: mol_type = other DNA
ggcgcgccagtcctcttatgtgggtaaggagaggaggttacggggaacgacgcgctgctttcatgccctttcttgttctaccttcatcggccgaggtggacacctgcgcaggtgtgtgccctccggcccctggtttggtcgacattgcggcatggctgacagcgccaaccacctgcccttctttttcgcgactcggaccgatg

SEQ ID NO: 13224 - DNA, 203 bp, Homo sapiens
  source 1..203: mol_type = other DNA
ggcgcgccagtccttaaacaatggtaaggagaggaggttacggggaacgacgcgctgctttctgctggacgtaatctctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 13225 - DNA, 203 bp, Homo sapiens
  source 1..203: mol_type = other DNA
ggcgcgccagtccttcccgttcggtacggggcgtctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 13226 - DNA, 203 bp, Homo sapiens
  source 1..203: mol_type = other DNA
ggcgcgccagtcctggagtagtggtagattttgtgctacattcactctttatggtaaatccaaacattatgataaaccaggctcccgccaaaatggtttcacagcattcgctaatactgtagaggatgctgttaacaaactggttttcttagctgttgactttattacctggcgcagacaggagttaacgactcggaccgatg

SEQ ID NO: 13227 - DNA, 203 bp, Homo sapiens
  source 1..203: mol_type = other DNA
ggcgcgccagtcctcttccactggtagattttgtgctacattcactctttatggtaaatccatcggccggagacggtattttggagtaataaatggtttcacagcattcgctaatactgtagaggatgctgttaacaaactggttttcttagctgttgactttattacctggcgcagacaggagttaacgactcggaccgatg

SEQ ID NO: 13228 - DNA, 203 bp, Homo sapiens
  source 1..203: mol_type = other DNA
ggcgcgccagtcctaggtattgggtagcaacagtggtgagttcgttggatggcttaagccctccagcggttaggtacgtcagtggttcgacgccttggaataaaggtctcgagatgccacgtggacgagggcatgcccaaagcacatcttaacctgagcgggggtcgcccaggtaaaagcagttttaacgactcggaccgatg

SEQ ID NO: 13229 - DNA, 203 bp, Homo sapiens
  source 1..203: mol_type = other DNA
ggcgcgccagtcctgaaaccctggtagcaacagtggtgagttcgttggatggcttaagccctgagtacagggtagtcgtcagtggttcgacgccttggaataaaggtctcgagatgccacgtggacgagggcatgcccaaagcacatcttaacctgagcgggggtcgcccaggtggctaatacagccccgactcggaccgatg

SEQ ID NO: 13230 - DNA, 203 bp, Homo sapiens
  source 1..203: mol_type = other DNA
ggcgcgccagtcctacggattaggtagcaacagtggtgagttcgttggcatctcgtttaagagagtacagggtagtcgtcagtggttcgacgccttggaataaaggtctcgagatgccacgtggacgagggcatgcccaaagcacatcttaacctgagcgggggtcgcccaggtaaaagcagttttaacgactcggaccgatg

SEQ ID NO: 13231 - DNA, 203 bp, Homo sapiens
  source 1..203: mol_type = other DNA
ggcgcgccagtcctgtgagtacggtatcgattcgcctcgcagagttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccgcgactcggaccgatg

SEQ ID NO: 13232 - DNA, 203 bp, Homo sapiens
  source 1..203: mol_type = other DNA
ggcgcgccagtcctttgaagatggtcaagtgttcggtctaatatagtctgtgtgacctgcaggcattttgtgaaaagggtaaagtatgaaagctactctcagaaaagtacttatgtattgatgagagccttaaaatgactttatattcacaaaactgctggaagacaatgatctggggtatcacattccgactcggaccgatg

SEQ ID NO: 13233 - DNA, 203 bp, Homo sapiens
  source 1..203: mol_type = other DNA
ggcgcgccagtcctggcagtaaggtccttttgtgcctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccgactcggaccgatg

SEQ ID NO: 13234 - DNA, 203 bp, Homo sapiens
  source 1..203: mol_type = other DNA
ggcgcgccagtcctaccggcagggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagcgactcggaccgatg

SEQ ID NO: 13235 - DNA, 203 bp, Homo sapiens
  source 1..203: mol_type = other DNA
ggcgcgccagtcctagtgggacggtctggcatctacaaagcctcttggccgtgttctgaacttgaagcctggaggagttctctgctcagcacagccaaggaacagaattagaagaaaaggaaccctggcctgaggcaggtgacaaacattaccaccccaggacacacgacccatgcagatgcaaccagcgactcggaccgatg

SEQ ID NO: 13236 - DNA, 203 bp, Homo sapiens
  source 1..203: mol_type = other DNA
ggcgcgccagtccttcccacctggtctggcatctacaaagcctcttggccgtgttctgaacttgaagcctggaggagttctctgctcagcacagccaaggaacagaattagaagaaaaggaaccctggcctggcttccaactatcgcattaccaccccagctgtgcacgatgcagcagatgcaaccagcgactcggaccgatg

SEQ ID NO: 13237 - DNA, 203 bp, Homo sapiens
  source 1..203: mol_type = other DNA
ggcgcgccagtccttatacgtaggtctggcatctacaaagcctcttggccgtgttctgaacttgaagcctggaggagttctctgctcagcacagccaaggaacagaattagaagaaaatccggtagtagtgcaggcaggtgacaaacattaccaccccagctgtgcacgatgcagcagatgcaaccagcgactcggaccgatg

SEQ ID NO: 13238 - DNA, 203 bp, Homo sapiens
  source 1..203: mol_type = other DNA
ggcgcgccagtcctacaagaatggtctggcatctacaaagcctcttggccgtgttctgaacttgaagcctggaggagttctctgctcagcgacaaaggttcctggaattagaagaaaaggaaccctggcctgaggcaggtgacaaacattaccaccccagctgtgcacgatgcagcagatgcaaccagcgactcggaccgatg

SEQ ID NO: 13239 - DNA, 203 bp, Homo sapiens
  source 1..203: mol_type = other DNA
ggcgcgccagtcctcggcgtgaggtgataattcaggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 13240 - DNA, 203 bp, Homo sapiens
  source 1..203: mol_type = other DNA
ggcgcgccagtcctactatgacggtgcaagtactttgtacctataaacgtgcctttttagataagttagatgttaatagtggttttgctgtttttgttaagtctaaagttggtaactatcgtttaccgtctagtaaacctagtggtatggatactgccttgttaagagcttaaactcctcactccgcacgactcggaccgatg

SEQ ID NO: 13241 - DNA, 203 bp, Homo sapiens
  source 1..203: mol_type = other DNA
ggcgcgccagtccttggtacgcggtgctggtcctagggaagctcaagtcactttgtaaccgagtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 13242 - DNA, 203 bp, Homo sapiens
  source 1..203: mol_type = other DNA
ggcgcgccagtcctaatgagaaggtgctggtcctagggaagctcaagtgggacctggctgctgtgattgcacatgaccctagaaggcagcttctgcaccggctctctctgccccgtgaccgacaggccttggtcaaaaagcatgcccagacctttttggccctctgtgctacagattatacctttgcccgactcggaccgatg

SEQ ID NO: 13243 - DNA, 203 bp, Homo sapiens
  source 1..203: mol_type = other DNA
ggcgcgccagtcctgttcaattggtgctggtcctagggaagctcaagtgggacctggctgctgtgattgcacatgatttcctggccttcagcggatcaatcacgtctctgccccgtgaccgacaggccttggtcaaaaagcatgcccagacctttttggccctctgtgctacagattatacctttgcccgactcggaccgatg

SEQ ID NO: 13244 - DNA, 203 bp, Homo sapiens
  source 1..203: mol_type = other DNA
ggcgcgccagtcctcacgctggggtgctggtcctagggaagctcaagtgggacctggctgctgtgattgcacatgatttcctggccttcattctgcaccggctcgggggagtggaccgccgacaggccttggtcaaaaagcatgcccagacctttttggccctctgtgctacagattatacctttgcccgactcggaccgatg

SEQ ID NO: 13245 - DNA, 203 bp, Homo sapiens
  source 1..203: mol_type = other DNA
ggcgcgccagtcctgatgaatcggtgctggtcctagggaagctcaagtgggacctggctgctgtgattgcacatgatttcctggccttcattctgcaccggctctctctgccccgtgaccgacaggccttggattggcgcgcgtagcagacctttttggccctctgtgctacagattatacctttgcccgactcggaccgatg

SEQ ID NO: 13246 - DNA, 203 bp, Homo sapiens
  source 1..203: mol_type = other DNA
ggcgcgccagtcctttaaggagggtgctggtcctagggaagctcaagtgggacctggctgctgtgattgcacatgatttcctggccttcattctgcaccggctctctctgccccgtgaccgacaggccttggtcaaaaagcatgccacacgggccggcttcctctgtgctacagattatacctttgcccgactcggaccgatg

SEQ ID NO: 13247 - DNA, 203 bp, Homo sapiens
  source 1..203: mol_type = other DNA
ggcgcgccagtcctcgggtttgggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 13248 - DNA, 203 bp, Homo sapiens
  source 1..203: mol_type = other DNA
ggcgcgccagtcctttgggactggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagcgctccgaagatatcgactcggaccgatg

SEQ ID NO: 13249 - DNA, 203 bp, Homo sapiens
  source 1..203: mol_type = other DNA
ggcgcgccagtcctgggtagaaggtgctggtcctccctcgagaaggtggggacctggctgctgtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 13250 - DNA, 203 bp, Homo sapiens
  source 1..203: mol_type = other DNA
ggcgcgccagtcctgaggttcgggtgcttagccgcgttttactgtcagctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgaccgactcggaccgatg

SEQ ID NO: 13251 - DNA, 203 bp, Homo sapiens
  source 1..203: mol_type = other DNA
ggcgcgccagtcctagttaagaggtgcttagccggcgccagaccgaccctcgacttcggagaggcagcgcggttcctctgggtgcttccgaagattaagaagaggcttctccagcctcttcggcctcctcgcccgccgcgggaacccgagaccccagtgtatgccccacccctgaccccgctcgcgaccgactcggaccgatg

SEQ ID NO: 13252 - DNA, 203 bp, Homo sapiens
  source 1..203: mol_type = other DNA
ggcgcgccagtcctagaccctgggtgcttagccggcgccagaccgaccctcgacttcggagaggcagcgcggttcctctgggtgcttccgcctccccttctcctcggggcagtatactttcggcctcctcgcccgccgcgggaacccgagaccccagtgtatgccccacccctgaccccgctcgcgaccgactcggaccgatg

SEQ ID NO: 13253 - DNA, 203 bp, Homo sapiens
  source 1..203: mol_type = other DNA
ggcgcgccagtccttttgtataggtgcttagccggcgccagaccgaccctcgacttcggagaggcagcgcggttcctctgggtgcttccgcctccccttctcctgcttctccagcctccggtatggtgcactccgccgcgggaacccgagaccccagtgtatgccccacccctgaccccgctcgcgaccgactcggaccgatg

SEQ ID NO: 13254 - DNA, 203 bp, Homo sapiens
  source 1..203: mol_type = other DNA
ggcgcgccagtcctgcaattccggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtgcatattggtaggcaccccgctcgcgaccgactcggaccgatg

SEQ ID NO: 13255 - DNA, 203 bp, Homo sapiens
  source 1..203: mol_type = other DNA
ggcgcgccagtccttgaccattggtgcttagccggcgccagaccgaccctcgacttcggagaggcagcgcggttcctctgggtgcttccgcctccccttctcctgcttctccagcctcttcggcctcctcgcccgccgcgggaaccgtgtgtatgtcgtaatgccccacccctgaccccgctcgcgaccgactcggaccgatg

SEQ ID NO: 13256 - DNA, 203 bp, Homo sapiens
  source 1..203: mol_type = other DNA
ggcgcgccagtcctatatccttggtgcttagccggcgccagaccgaccctcgacttcggagatctttactctactgtctgggtgcttccgcctccccttctcctgcttctccagcctcttcggcctcctcgcccgccgcgggaacccgagaccccagtgtatgccccacccctgaccccgctcgcgaccgactcggaccgatg

SEQ ID NO: 13257 - DNA, 203 bp, Homo sapiens
  source 1..203: mol_type = other DNA
ggcgcgccagtcctctcgaattggtggagttctccttcccactcgcctcagatagattctgtctgacgggcagtggcgagctgtggtggcaggcggagagggcttcctcctccaagtcttggatcacctttgacctgaagaacaaggaagtgtctgtaaaacgggttacccaggaccctaagctccagcgactcggaccgatg

SEQ ID NO: 13258 - DNA, 203 bp, Homo sapiens
  source 1..203: mol_type = other DNA
ggcgcgccagtcctttgcgtgtggtggagttctccttcccactcgcctttacagttgaaaagctgacgggcagtggatgatcccccatctaggcggagagggcttcctcctccaagtcttggatcacctttgacctgaagaacaaggaagtgtctgtaaaacgggttacccaggaccctaagctccagcgactcggaccgatg

SEQ ID NO: 13259 - DNA, 203 bp, Homo sapiens
  source 1..203: mol_type = other DNA
ggcgcgccagtcctggatgcttggtggagttctccttcccactcgcctttacagttgaaaagctgacgggcagtggcgagctgtggtggcaggcggagagggcttcctcctccaagtcttggatcacctttgacctgaagaacaagacttgaataccttcacgggttacccaggaccctaagctccagcgactcggaccgatg

SEQ ID NO: 13260 - DNA, 203 bp, Homo sapiens
  source 1..203: mol_type = other DNA
ggcgcgccagtcctatatgaacggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccagggtagcgctagggcacgactcggaccgatg

SEQ ID NO: 13261 - DNA, 203 bp, Homo sapiens
  source 1..203: mol_type = other DNA
ggcgcgccagtcctactgtcgcggtggagttctccttcccactcgcctttacagttgaaaagctgacgggcagtggcgagctgtggtggcgtaacatcccactatcctcctccaagtcttggatcacctttgacctgaagaacaaggaagtgtctgtaaaacgggttacccaggaccctaagctccagcgactcggaccgatg

SEQ ID NO: 13262 - DNA, 203 bp, Homo sapiens
  source 1..203: mol_type = other DNA
ggcgcgccagtcctcgagcccgggtggcggctcggctactgctcgtggaggggaatacaggccaatatcttgttttaatgcagggttgctggggctgggcccagaagcagcagcaccagggaagaggattcgaaaaccctctctcttgtatgagggctttgagagccccacaatggcttcggtgcctgcgactcggaccgatg

SEQ ID NO: 13263 - DNA, 203 bp, Homo sapiens
  source 1..203: mol_type = other DNA
ggcgcgccagtcctgccgtcctggtggcggctcggctactgctcgtggaggggaatacaggctccctggggaagggaatgcagggttgctacttggcaagaagaaagcagcagcaccagggaagaggattcgaaaaccctctctcttgtatgagggctttgagagccccacaatggcttcggtgcctgcgactcggaccgatg

SEQ ID NO: 13264 - DNA, 203 bp, Homo sapiens
  source 1..203: mol_type = other DNA
ggcgcgccagtcctcaagcgatggtggcggctcggctactgctcgtggaggggaatacaggctccctggggaagggaatgcagggttgctggggctgggcccagaagcagcagcaccaactgctgctggagtaaaaccctctctcttgtatgagggctttgagagccccacaatggcttcggtgcctgcgactcggaccgatg

SEQ ID NO: 13265 - DNA, 203 bp, Homo sapiens
  source 1..203: mol_type = other DNA
ggcgcgccagtcctcagtacagggtggcggctcggctactgctcgtggaggggaatacaggctccctggggaagggaatgcagggttgctggggctgggcccagaagcagcagcaccagggaagaggattcgaaaaccctctctctacctacgactggcagagagccccacaatggcttcggtgcctgcgactcggaccgatg

SEQ ID NO: 13266 - DNA, 203 bp, Homo sapiens
  source 1..203: mol_type = other DNA
ggcgcgccagtccttgctcaaaggtgtacagttcggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagacgactcggaccgatg

SEQ ID NO: 13267 - DNA, 203 bp, Homo sapiens
  source 1..203: mol_type = other DNA
ggcgcgccagtccttgaatacgggtgtatgtcgtacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaaccgactcggaccgatg

SEQ ID NO: 13268 - DNA, 203 bp, Homo sapiens
  source 1..203: mol_type = other DNA
ggcgcgccagtcctataaatccggtgtgcaaatcacgcctggcagcccctgcccacagtacccgaagatggcaggccttgttcccttcacctaaattcataaacgcttagacgcatctttctgatgctgatttgtttctcttttcagtaagtgtggacctttgtgtaccagagagaacatcatggtggcgactcggaccgatg

SEQ ID NO: 13269 - DNA, 203 bp, Homo sapiens
  source 1..203: mol_type = other DNA
ggcgcgccagtcctcgttctacggtgtgcaaatcacgcctggcagcccctgcccacagtacccgaagatggcaggccttgttcccttcactggccgcacccgcgctgggtgtagtggcttctgatgctgatttgtttctcttttcagtaagtgtggacctttgtgtaccagagagaacatcatggtggcgactcggaccgatg

SEQ ID NO: 13270 - DNA, 203 bp, Homo sapiens
  source 1..203: mol_type = other DNA
ggcgcgccagtcctacgaagaaggtgtgcaaatcacgcctggcagcccctgcccacagtacccgaagatggcaggcggacgcgaaggggtctaaattcataaacctgggtgtagtggcttctgatgctgatttgtttctcttttcagtaagtgtggacctttgtgtaccagagagaacatcatggtggcgactcggaccgatg

SEQ ID NO: 13271 - DNA, 203 bp, Homo sapiens
  source 1..203: mol_type = other DNA
ggcgcgccagtcctgcgttctgggtgtgcaaatcacgcctggcagcccctgcccacagtaccgtgcacatcagccacttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 13272 - DNA, 203 bp, Homo sapiens
  source 1..203: mol_type = other DNA
ggcgcgccagtcctttcgctttggttacccatagtccatccgttgaagcaataaactcagtattaaggcttgttgtgttggacaaggtgccctatttagggtgaggagccttactggcagccccagtgaatcctccattggataggaacagctatattgggtagttgtagcagttgtattcaaatgaacgactcggaccgatg

SEQ ID NO: 13273 - DNA, 203 bp, Homo sapiens
  source 1..203: mol_type = other DNA
ggcgcgccagtcctccaggctaggttacccatcattagaggaaatttccaataaactctggtcctgatacatctaggatggtcgaggtgccctatttagggtgaggagcctcggtggcagccccaccaaatcctctattggataggaacagctgtactgggcagttacagcagtcgtatggtaacacacgactcggaccgatg

SEQ ID NO: 13274 - DNA, 203 bp, Homo sapiens
  source 1..203: mol_type = other DNA
ggcgcgccagtcctgctgggcgggttacccatcattagaggaaatttccaataaactctggtgtaaggcttagagtgatggtcgaggtgccctatttagggtgaggagcctcggtggcagccccaccaaatcctctattggataggaacagctgtactggattaagtgcaaccccgtatggtaacacacgactcggaccgatg

SEQ ID NO: 13275 - DNA, 203 bp, Homo sapiens
  source 1..203: mol_type = other DNA
ggcgcgccagtcctacctatgaggttacccatcattagaggaaatttccaataaactctggtgtaaggcttagagtgatggtcgaggtgccctatttagggtgaggagcctcggtggcagccccaccaaatcctctattggataggcttttgcacctatcgcagttacagcagtcgtatggtaacacacgactcggaccgatg

SEQ ID NO: 13276 - DNA, 203 bp, Homo sapiens
  source 1..203: mol_type = other DNA
ggcgcgccagtcctgagtaaacggttacccatcattagaggaaatttcggtccccaaagcaagtaaggcttagagtgatggtcgaggtgccctatttagggtgaggagcctcggtggcagccccaccaaatcctctattggataggaacagctgtactgggcagttacagcagtcgtatggtaacacacgactcggaccgatg

SEQ ID NO: 13277 - DNA, 203 bp, Homo sapiens
  source 1..203: mol_type = other DNA
ggcgcgccagtcctgagaccggggttcgaagtaaagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacacgactcggaccgatg

SEQ ID NO: 13278 - DNA, 203 bp, Homo sapiens
  source 1..203: mol_type = other DNA
ggcgcgccagtcctattcgtagggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggcgactcggaccgatg

SEQ ID NO: 13279 - DNA, 203 bp, Homo sapiens
  source 1..203: mol_type = other DNA
ggcgcgccagtcctacaactctggttctccgcccctgccactgggccatggagactgtggcacagtagactgtagtgtgaggctcgcgggggcagtggccatggccttatccacccgagagctggtgtctgtggaggacctgctgaagtttgaaaagaaatttcagtctgagaaggcagcaggctcggcgactcggaccgatg

SEQ ID NO: 13280 - DNA, 203 bp, Homo sapiens
  source 1..203: mol_type = other DNA
ggcgcgccagtcctgtaatggaggttctccgcccgatagctgataagttggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggcgactcggaccgatg

SEQ ID NO: 13281 - DNA, 203 bp, Homo sapiens
  source 1..203: mol_type = other DNA
ggcgcgccagtcctaaacagtgggttgatgaaatgatatggactcaaaaagaattaaaagaagctttgtccgatgggatagtgaagtctcacaccaacatttacaattgttatttagatgcaccgttctcagtatatgtcaaggcttacttaagttagtaaaaacacatcagagtgggataagtgacacgactcggaccgatg

SEQ ID NO: 13282 - DNA, 203 bp, Homo sapiens
  source 1..203: mol_type = other DNA
ggcgcgccagtccttagctctgggttgtgcatttatagtcccaaatcttttgtggtgagtatgttgctattatgttgttgttctactggttgctgtggcttctttagttgttttgcatcttctattagaggttgttgtgaatcaactaaacttccttattacgacgttgaaaagatccacatacagtacgactcggaccgatg

SEQ ID NO: 13283 - DNA, 203 bp, Homo sapiens
  source 1..203: mol_type = other DNA
ggcgcgccagtcctcttggtacggttgtgcatttcagtcgtgctcatctttgtggtgagtatgttgctattatgttgttgttctactggttgctgtggcttctttagttgttttgcatcttctattagaggttgttgtgaatcaactaaacttccttattacgacgttgaaaagggtgcaccgattgtcgactcggaccgatg

SEQ ID NO: 13284 - DNA, 203 bp, Homo sapiens
  source 1..203: mol_type = other DNA
ggcgcgccagtcctggaacgccggttgtgcatttcagtcgtgctcatctttgtggtgagtatgttgctattatgtttgataaggcggcactgctgtggcttctttagttgttttgcatcttctattagaggttgttgtgaatcaactaaacttccttattacgacgttgaaaagatccacatacagtacgactcggaccgatg

SEQ ID NO: 13285 - DNA, 203 bp, Homo sapiens
  source 1..203: mol_type = other DNA
ggcgcgccagtccttacaggcagtaaaaaaacagctcaacgcctttttcgacaccagcggcggcttttgctgcaattttgtgaaggggaagatactgttgacgggaaacgcaaaaaaccagaaaggttaactgaaaaaccagaaagttaactggtaagtttagtctttttgtcttttatttcaggtcccgactcggaccgatg

SEQ ID NO: 13286 - DNA, 203 bp, Homo sapiens
  source 1..203: mol_type = other DNA
ggcgcgccagtcctgcacaggagtaaaaaaacagctcaacgcctttttgtgtttgttttagagcttttgctgcaattttgtgaaggggaagatactgttgacggttccgcatgggtgacagaaaggttaactgaaaaaccagaaagttaactggtaagtttagtctttttgtcttttatttcaggtcccgactcggaccgatg

SEQ ID NO: 13287 - DNA, 203 bp, Homo sapiens
  source 1..203: mol_type = other DNA
ggcgcgccagtcctgggtccgagtaacagcactgaaagcggtgtatcaagcatgacggccgtgggaactcctccttggtaacaaggacccacggggccaaaagccacgcccacacgggcccgtcatgtgtgcaaccccagcacggcgactttactgcgaaacccactttaaagtgacattgaaactggcgactcggaccgatg

SEQ ID NO: 13288 - DNA, 203 bp, Homo sapiens
  source 1..203: mol_type = other DNA
ggcgcgccagtcctggtacctagtaacagcactgttgcttcgtagcggagcatgacggccgtatctcaaggcgtcaggtaacaaggacccacggggccaaaagccacgcccacacgggcccgtcatgtgtgcaaccccagcacggcgactttactgcgaaacccactttaaagtgacattgaaactggcgactcggaccgatg

SEQ ID NO: 13289 - DNA, 203 bp, Homo sapiens
  source 1..203: mol_type = other DNA
ggcgcgccagtcctgtccgtcggtaacagcactgttgcttcgtagcggagcatgacggccgtgggaactcctccttctagctggcattttacggggccaaaagccacgcccacacgggcccgtcatgtgtgcaaccccagcacggcgactttactgcgaaacccactttaaagtgacattgaaactggcgactcggaccgatg

SEQ ID NO: 13290 - DNA, 203 bp, Homo sapiens
  source 1..203: mol_type = other DNA
ggcgcgccagtcctggcgggcagtaacagcactgttgcttcgtagcggagcatgacggccgtgggaactcctccttggtaacaaggacccacggggccaaaagccacgcccacacgggcccgtcatgtgtgcaaccccagcacggcccgcccgggaaacgacccactttaaagtgacattgaaactggcgactcggaccgatg

SEQ ID NO: 13291 - DNA, 203 bp, Homo sapiens
  source 1..203: mol_type = other DNA
ggcgcgccagtcctactgtgcagtaacagcactgttgcttcgtagcggagcatgacggccgtgggaactcctccttggtaacaaggacccacggggccaaaagccacgcccacacgggtatcgacatgcgagaaccccagcacggcgactttactgcgaaacccactttaaagtgacattgaaactggcgactcggaccgatg

SEQ ID NO: 13292 - DNA, 203 bp, Homo sapiens
  source 1..203: mol_type = other DNA
ggcgcgccagtcctctgctgaagtaacagcactgttgcttcgtagcggcagcaacgccaaaagggaactcctccttggtaacaaggacccacggggccaaaagccacgcccacacgggcccgtcatgtgtgcaaccccagcacggcgactttactgcgaaacccactttaaagtgacattgaaactggcgactcggaccgatg

SEQ ID NO: 13293 - DNA, 203 bp, Homo sapiens
  source 1..203: mol_type = other DNA
ggcgcgccagtccttcgcttcggtaacgtccaaggcaagctccccacgacccgaacacgcccagaggaaccttggggcctctggggacttggctagcaggtattcatgctagcctggaccatttttcagatttagccttcagaagaggatctgggaaagcctttggattatacttgtcgcagccggcccgactcggaccgatg

SEQ ID NO: 13294 - DNA, 203 bp, Homo sapiens
  source 1..203: mol_type = other DNA
ggcgcgccagtcctggaaagtggtaacgtccaaggcaagctccccacgacccgaacacgcccagaggaaccttggggcctctggggacttggctagcaggtattgccttacagaattcccatttttcagatttagccttcagaagaggatctgggaaagcctttggattatactgaaactcattcaagcgactcggaccgatg

SEQ ID NO: 13295 - DNA, 203 bp, Homo sapiens
  source 1..203: mol_type = other DNA
ggcgcgccagtcctgcctcactgtaacgtccaaggcaagctccccacgacccgaacacgcccagaggaaccttgggtaggtcccccttgcggctagcaggtattcatgctagcctggaccatttttcagatttagccttcagaagaggatctgggaaagcctttggattatactgaaactcattcaagcgactcggaccgatg

SEQ ID NO: 13296 - DNA, 203 bp, Homo sapiens
  source 1..203: mol_type = other DNA
ggcgcgccagtcctccacaccagtaactgagagggtactgtgatctgcccaaagtcctaatgtgcagtcaggtgaatttattgaaaaatttgaggctcctggtggtgcaaatcaaagaactgctcctcagtggatgttgcctttacttctaggcctgtacggaagtgttacttctgctctaaaagcttcgactcggaccgatg

SEQ ID NO: 13297 - DNA, 203 bp, Homo sapiens
  source 1..203: mol_type = other DNA
ggcgcgccagtcctttaaactcgtaactgagaggtgggaagctcaaagccaaagtcctaatgtgcagtcaggtgaaggatacactttccgtgaggctcctggtggtgcaaatcaaagaactgctcctcagtggatgttgcctttacttctaggcctgtacggaagtgttacttctgctctaaaagcttcgactcggaccgatg

SEQ ID NO: 13298 - DNA, 203 bp, Homo sapiens
  source 1..203: mol_type = other DNA
ggcgcgccagtcctgatggtgagtaactgagaggtgggaagctcaaagccaaagtcctaatgtgcagtcaggtgaatttattgaaaaatttgaggctcctggtggtgcaaatcaaagaactgctcctcagtggatgttgcctttacggtccttgtccgtgggaagtgttacttctgctctaaaagcttcgactcggaccgatg

SEQ ID NO: 13299 - DNA, 203 bp, Homo sapiens
  source 1..203: mol_type = other DNA
ggcgcgccagtcctgactaatagtaactgagaggtgggaagctcaaagccaaagtcctaatgtgcagtcaggtgaatttattgaaaaatttgaggctcctggtggtgcaaatcaaagactctggtaggccacgatgttgcctttacttctaggcctgtacggaagtgttacttctgctctaaaagcttcgactcggaccgatg

SEQ ID NO: 13300 - DNA, 203 bp, Homo sapiens
  source 1..203: mol_type = other DNA
ggcgcgccagtcctaccgcacagtaccttccgtgattcagtatggaaagaataaaagaactacggaacctgatgtcgcagtctcgcactcgcgagatactgacaaaaaccacagtggaccatatggccataattaagaagtacacatcggggagacaggaaaagaacccgtcacttaggatgaaatggcgactcggaccgatg

SEQ ID NO: 13301 - DNA, 203 bp, Homo sapiens
  source 1..203: mol_type = other DNA
ggcgcgccagtcctgagatggcgtagacaaagacgttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccacgactcggaccgatg

SEQ ID NO: 13302 - DNA, 203 bp, Homo sapiens
  source 1..203: mol_type = other DNA
ggcgcgccagtcctcccggaacgtagatatagtcaatcaactggtctgacaagtcataccccaaacaatccaaatctggaatcacctgttcgctcagtagtaattatcgaatggggcgtacactaacctcgtctgtactgtctgaaagtggtcaggattgattgacagttattatttatctttaagcacgactcggaccgatg

SEQ ID NO: 13303 - DNA, 203 bp, Homo sapiens
  source 1..203: mol_type = other DNA
ggcgcgccagtcctaaggcatggtagatatagtccccggtacccgtgcacaagtcataccccaaacaatccaaatctggaatcacctgttcgctcagtagtaatatcttggcaaacactacactaacctcgtctgtactgtctgaaagtggtcaggattgattgacagttattatttatctttaagcacgactcggaccgatg

SEQ ID NO: 13304 - DNA, 203 bp, Homo sapiens
  source 1..203: mol_type = other DNA
ggcgcgccagtccttaggatcagtagatgcagctatgttgtaaggctttagagaaataagggagtgtcctatttaggatgaggtgctccggtggcagccccaccaaaacctctagcgactaggaacagctatatcgggttgctatagcagtcaggatgtcattctggcgttccgaaatacccaaacctcgactcggaccgatg

SEQ ID NO: 13305 - DNA, 203 bp, Homo sapiens
  source 1..203: mol_type = other DNA
ggcgcgccagtcctattacggagtagcaagtgaagccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 13306 - DNA, 203 bp, Homo sapiens
  source 1..203: mol_type = other DNA
ggcgcgccagtcctccgtctatgtaggacataccccaaatattgggttccactcgtagagaagaaaattagtggcgaaacgtacggtttaccgtgttccctcctgtgattttaattgcacctgaagcaaccctaggtcttccctttgatgtgagctaataaggagtaaccgattcttacaatgtgatccgactcggaccgatg

SEQ ID NO: 13307 - DNA, 203 bp, Homo sapiens
  source 1..203: mol_type = other DNA
ggcgcgccagtcctaacactacgtaggacataccccaaatattgggttccactcgtagagaagaaaattagtggcgaaacgtacggtttatgtcaaaggagaaggtgattttaattgcacctgaagcaaccctaggtcttccctttgatgtgagctaatattcgtcgttgttcacttacaatgtgatccgactcggaccgatg

SEQ ID NO: 13308 - DNA, 203 bp, Homo sapiens
  source 1..203: mol_type = other DNA
ggcgcgccagtcctcggtcatcgtaggacataccccaaatattgggttccactcgtagagaagaaaattagtggcgccggtgcgaacgagtgtcaaaggagaaggtgattttaattgcacctgaagcaaccctaggtcttccctttgatgtgagctaataaggagtaaccgattcttacaatgtgatccgactcggaccgatg

SEQ ID NO: 13309 - DNA, 203 bp, Homo sapiens
  source 1..203: mol_type = other DNA
ggcgcgccagtcctcaattgtggtaggacatacctattgctaaatacgccactcgtagagaagaaaattagtggcgaaacgtacggtttatgtcaaaggagaaggtgattttaattgcacctgaagcaaccctaggtcttccctttgatgtgagctaataaggagtaaccgattcttacaatgtgatccgactcggaccgatg

SEQ ID NO: 13310 - DNA, 203 bp, Homo sapiens
  source 1..203: mol_type = other DNA
ggcgcgccagtccttccttcaggtatatgcatgtatgtgtatgtgtatatatgtatgtgtgtgtatgtatatgtgtgtgtatgtgtatgtgtgtgtgtatgtgtgtgtgtatgtatgtatgtatgtatatgtcagtgggttggcgccacatattggtttttttaatcatttgagagttagttgaagatcgactcggaccgatg

SEQ ID NO: 13311 - DNA, 203 bp, Homo sapiens
  source 1..203: mol_type = other DNA
ggcgcgccagtccttagggcaagtatatgcatgtatgtgtatgtgtatatatgtatgtgtgtgtatgtatatgtgtgtgtatgtgtatgtgtgtgtgtatgtgtgtgtgtatgtatgtgctaccactatatgattatacacatatacacatattggtttttttaatcatttgagagttagttgaagatcgactcggaccgatg

SEQ ID NO: 13312 - DNA, 203 bp, Homo sapiens
  source 1..203: mol_type = other DNA
ggcgcgccagtcctatcacgctgtatatgcatgtatgtgtatgtgtatatatgtatgtgtgtgtatgtatatgtgttgtatccgtccacagtgtgtgtatgtgtgtgtgtatgtatgtatgtatgtatatgtattatacacatatacacatattggtttttttaatcatttgagagttagttgaagatcgactcggaccgatg

SEQ ID NO: 13313 - DNA, 203 bp, Homo sapiens
  source 1..203: mol_type = other DNA
ggcgcgccagtcctttatttatgtatatgcatgtatgtgtatgtgtatgggccggcagtaaagtatgtatatgtgtgtgtatgtgtatgtgtgtgtgtatgtgtgtgtgtatgtatgtatgtatgtatatgtattatacacatatacacatattggtttttttaatcatttgagagttagttgaagatcgactcggaccgatg

SEQ ID NO: 13314 - DNA, 203 bp, Homo sapiens
  source 1..203: mol_type = other DNA
ggcgcgccagtcctctaatgatgtatcctatgagcgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagcgactcggaccgatg

SEQ ID NO: 13315 - DNA, 203 bp, Homo sapiens
  source 1..203: mol_type = other DNA
ggcgcgccagtccttctcctgagtatgggaatcggcatgaacttactctaggatctctcgtagagggataggtgtgccattcaaatccagggagtactctggctctgacattgggacatttgatgtaaccggacctggttcagtatccgggttgtcctgtattgttacggtgtatccgtcttggcacacgactcggaccgatg

SEQ ID NO: 13316 - DNA, 203 bp, Homo sapiens
  source 1..203: mol_type = other DNA
ggcgcgccagtcctgaccatgtgtatgggaatcgtgtatggggatgattaggatctctcgtagagggataggtgtgccattcaaatccagggagtactctggctctgacattgggacatttgatgtaaccggacctggttcagtatccgggttgtcctgtattgttacggtgtatccgtcttggcacacgactcggaccgatg

SEQ ID NO: 13317 - DNA, 203 bp, Homo sapiens
  source 1..203: mol_type = other DNA
ggcgcgccagtccttacgaaaggtatgggaatcgtgtatggggatgattaggatctctcgtatgtttcgcctccaaccattcaaatccagggagtactctggctctgacattgggacatttgatgtaaccggacctggttcagtatccgggttgtcctgtattgttacggtgtatccgtcttggcacacgactcggaccgatg

SEQ ID NO: 13318 - DNA, 203 bp, Homo sapiens
  source 1..203: mol_type = other DNA
ggcgcgccagtccttgaaaccagtcatcgtaatatagccatagtggcgagctccctgggtggtctaagtcctgagtacaggacagtcgtcagtagttcgacgtgagcagaagcccacctcgagatgctacgtggacgagggcatgccaagacacaccttaaccctagcgggggtcgctagggtgaaatcgactcggaccgatg

SEQ ID NO: 13319 - DNA, 203 bp, Homo sapiens
  source 1..203: mol_type = other DNA
ggcgcgccagtccttcctggctgtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgagtacgatacacaccgactcggaccgatg

SEQ ID NO: 13320 - DNA, 203 bp, Homo sapiens
  source 1..203: mol_type = other DNA
ggcgcgccagtcctaaacatacgtccacgatgcagccccggggccccgccgcgggaccgcgagccttgtgtgagcggaggggtgcccggccccgcgggagccggcgatcctgaggctacgacctttcggaaggttacaagctttaaaccagcgcaagcttttccaacacccctgctccgcccttcttgcgactcggaccgatg

SEQ ID NO: 13321 - DNA, 203 bp, Homo sapiens
  source 1..203: mol_type = other DNA
ggcgcgccagtcctgcgtgtaagtccacgatgcagccccggggccccgccgcgggaccgcgagccttgtgtgagcggaggggtgcccggcgataattcttaatccgatcctgaggctacgacctttcggaagcacctgcctccgtcaccagcgcaagcttttccaacacccctgctccgcccttcttgcgactcggaccgatg

SEQ ID NO: 13322 - DNA, 203 bp, Homo sapiens
  source 1..203: mol_type = other DNA
ggcgcgccagtcctgacaaaccgtccacgatgcagccccggggccccggaatttttgtaaacgccttgtgtgagcggaggggtgcccggccccgcgggagccggcgatcctgaggctacgacctttcggaagcacctgcctccgtcaccagcgcaagcttttccaacacccctgctccgcccttcttgcgactcggaccgatg

SEQ ID NO: 13323 - DNA, 203 bp, Homo sapiens
  source 1..203: mol_type = other DNA
ggcgcgccagtcctctcgttgtgtccactaccttaactagctcgctgacccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacgactcggaccgatg

SEQ ID NO: 13324 - DNA, 203 bp, Homo sapiens
  source 1..203: mol_type = other DNA
ggcgcgccagtccttcagaagagtccactacctttttcgagagtgactcccgttgtcccaaggcttcccagagcgaacctgtgcggctgcaggcaccggcgcgtaataacataataccccggaaggaccgagctcttctcgcggatccagtgttccgtttccagcccccaatctcagagcggagccgacgactcggaccgatg

SEQ ID NO: 13325 - DNA, 203 bp, Homo sapiens
  source 1..203: mol_type = other DNA
ggcgcgccagtcctgcagattcgtccactacctttttcgagagtgactcccgttgtcccaaggcttcccagagcgaacctgtgcggctgcgccttggtaattagcgagtttccggcgtccggaaggaccgagctcttctcgcggatccagtgttccgtttccagcccccaatctcagagcggagccgacgactcggaccgatg

SEQ ID NO: 13326 - DNA, 203 bp, Homo sapiens
  source 1..203: mol_type = other DNA
ggcgcgccagtcctgattagatgtccgcaaagccggtggcgcccggaggctgcacggagagcggtgcccgcgtcagtgaccgaaggaagagaccaagatgaatgatcgttagtcagtcaagtttggcgtggtggtggttggtgttggccgagccggctccgtgcggatgagggacttgcggaatccaccgactcggaccgatg

SEQ ID NO: 13327 - DNA, 203 bp, Homo sapiens
  source 1..203: mol_type = other DNA
ggcgcgccagtcctgacatattgtcctgaagctcgactgcccggaaaggttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 13328 - DNA, 203 bp, Homo sapiens
  source 1..203: mol_type = other DNA
ggcgcgccagtcctgcgttaccgtcctgaagctctcgcagtgcagtgagttcatgcaccttcccaggtctagcacttctttgggatctggggaggccgcctggttttcctccctccttctgcacgtctgctggggtctcttcctctccaggccttgccgtccccctggcctctcttcccagctcacaccgactcggaccgatg

SEQ ID NO: 13329 - DNA, 203 bp, Homo sapiens
  source 1..203: mol_type = other DNA
ggcgcgccagtcctgcctggtcgtcctgaagctctcgcagtgcagtgagttcatgcaccttcttgccaagcctcagtctttgggatctggggaggccgcctggtgggtgaagtcgaggctgcacgtctgctggggtctcttcctctccaggccttgccgtccccctggcctctcttcccagctcacaccgactcggaccgatg

SEQ ID NO: 13330 - DNA, 203 bp, Homo sapiens
  source 1..203: mol_type = other DNA
ggcgcgccagtcctaagtctgagtcctgaagctctcgcagtgcagtgagttcatgcaccttcttgccaagcctcagtctttgggatctggggaggccgcctggttttcctccctccttctgcacgtctgctgcctcggtgattaagccaggccttgccgtccccctggcctctcttcccagctcacaccgactcggaccgatg

SEQ ID NO: 13331 - DNA, 203 bp, Homo sapiens
  source 1..203: mol_type = other DNA
ggcgcgccagtcctagtctacagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctccctgatcggttattcgactcggaccgatg

SEQ ID NO: 13332 - DNA, 203 bp, Homo sapiens
  source 1..203: mol_type = other DNA
ggcgcgccagtcctactgccctgtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 13333 - DNA, 203 bp, Homo sapiens
  source 1..203: mol_type = other DNA
ggcgcgccagtcctatcaagaggtcctgaagctctcgcagtgcagtgagttcatgcaccttcttgccaagcctcagtctttgggatctggggaggccgcctggttttcctccctccttctgcacgtctgctggggtctcttcctctttcacataactatcccccctggcctctcttcccagctcacaccgactcggaccgatg

SEQ ID NO: 13334 - DNA, 203 bp, Homo sapiens
  source 1..203: mol_type = other DNA
ggcgcgccagtcctagcagcttgtcctgaagctctcgcagtgcagtgagttcatgcaccttcttgccaagcctcagtctttgggatctggtcttataaatgttatttcctccctccttctgcacgtctgctggggtctcttcctctccaggccttgccgtccccctggcctctcttcccagctcacaccgactcggaccgatg

SEQ ID NO: 13335 - DNA, 203 bp, Homo sapiens
  source 1..203: mol_type = other DNA
ggcgcgccagtcctggacccatgtcctggcagcagcctctgacctgtccaggtgccctgtccagctgactgcaaggacagagaggagtcctgcccagctcttggatcagtctgctggccgaggagcccggtgataagtccaacagtcctggagcccagcctgccccgaggaggccccggctcagagcccgactcggaccgatg

SEQ ID NO: 13336 - DNA, 203 bp, Homo sapiens
  source 1..203: mol_type = other DNA
ggcgcgccagtcctgaccactcgtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggcaagacactgccaatcgactcggaccgatg

SEQ ID NO: 13337 - DNA, 203 bp, Homo sapiens
  source 1..203: mol_type = other DNA
ggcgcgccagtcctgtcattctgtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagcccgactcggaccgatg

SEQ ID NO: 13338 - DNA, 203 bp, Homo sapiens
  source 1..203: mol_type = other DNA
ggcgcgccagtccttcttcacggtcctggcagcagcctctgacctgtctttcccgggcagttagctgactgcaaggacagagaggagtcctgcccagctcttggatcagtctgctggccgaggagcccggtggagccaggggtgaccctggagcccagcctgccccgaggaggccccggctcagagcccgactcggaccgatg

SEQ ID NO: 13339 - DNA, 203 bp, Homo sapiens
  source 1..203: mol_type = other DNA
ggcgcgccagtcctttcatcgcgtcgagccgcgctcacctcgggctcccgctccgtctccacctccgcctttgccctggcggcgcgaccccgtcccgggcgcggcccccagcagtcgcgcgccgttagcctcgcgcccgccgcgcacaatcattagcatacgatgggggccgccgccggccggagccccgactcggaccgatg

SEQ ID NO: 13340 - DNA, 203 bp, Homo sapiens
  source 1..203: mol_type = other DNA
ggcgcgccagtccttaacgatagtcgccgccgcagtcctcgccgcagtcgccgccgccgccgccgccgccgccgctgctcctccgcctggaagactagtctaagccgcagccatgagcgtgctcggccccggtggagcccgcagtcctctagattagtctccaccgccgtccaggacccacttgcagccgactcggaccgatg

SEQ ID NO: 13341 - DNA, 203 bp, Homo sapiens
  source 1..203: mol_type = other DNA
ggcgcgccagtccttgaaccacgtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccagccggagtaccttttcgactcggaccgatg

SEQ ID NO: 13342 - DNA, 203 bp, Homo sapiens
  source 1..203: mol_type = other DNA
ggcgcgccagtcctcctggacagtcgccgccgcagtcctcgccgcagttattaatattcgtcccgccgccgccgctgctcctccgcctggcctgggccgtctgcccgcagccatgagcgtgctcggccccggtggagcccgcagtcctctagattagtctccaccgccgtccaggacccacttgcagccgactcggaccgatg

SEQ ID NO: 13343 - DNA, 203 bp, Homo sapiens
  source 1..203: mol_type = other DNA
ggcgcgccagtcctagattcgtgtcggagaccgggcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 13344 - DNA, 203 bp, Homo sapiens
  source 1..203: mol_type = other DNA
ggcgcgccagtcctcataagcggtctacgtggacatgtcctctgtaggtctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 13345 - DNA, 203 bp, Homo sapiens
  source 1..203: mol_type = other DNA
ggcgcgccagtccttcgatcgtgtctacgtggaccgacaaagacagattctttgagggagctaagctcaacgtagttctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 13346 - DNA, 203 bp, Homo sapiens
  source 1..203: mol_type = other DNA
ggcgcgccagtcctcggctagggtctacgtggaccgacaaagacagattctttgagggagctaagctcaacgtagttctaacagttttttctaagcccgtttagtctctgatgaataaccaacggaaaaaggcgaaaaacacgcctttcaatatgctgaaacgcgagagaaaccgcgtgtcgactgtgcgactcggaccgatg

SEQ ID NO: 13347 - DNA, 203 bp, Homo sapiens
  source 1..203: mol_type = other DNA
ggcgcgccagtcctaatctttagtctacgtggaccgacaaagacagattctttgagggagctcccgatccgtgctctctaacagttttttaattagagagcagatctctgatgaataaccaacggaaaaaggcgaaaaacacgcctttcaatatgctgaaacgcgagagaaaccgcgtgtcgactgtgcgactcggaccgatg

SEQ ID NO: 13348 - DNA, 203 bp, Homo sapiens
  source 1..203: mol_type = other DNA
ggcgcgccagtcctataatatcgtctacgtggaccgacaagaacagttatacgctacttaaatgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 13349 - DNA, 203 bp, Homo sapiens
  source 1..203: mol_type = other DNA
ggcgcgccagtcctgggccggcgtctacgtggaccgacaagaacagttcttttaaatttaaatgcttaacgtagtgctgacagttttttattagagagcagatctctgatgaacaaccaacggaagaagacgggaaaaccgtctatcaatatgctgaaacgcgtgagaaaccgtgtgtcaactggatccgactcggaccgatg

SEQ ID NO: 13350 - DNA, 203 bp, Homo sapiens
  source 1..203: mol_type = other DNA
ggcgcgccagtcctctactgcggtctacgtggaccgacaagaacagtttcgaatcggaagcttgcttaacgtagtttccgttacccgcctttagagagcagatctctgatgaacaaccaacggaaaaagacgggtcgaccgtctttcaatatgctgaaacgcgcgagaaaccgcgtgtcaactgtttccgactcggaccgatg

SEQ ID NO: 13351 - DNA, 203 bp, Homo sapiens
  source 1..203: mol_type = other DNA
ggcgcgccagtccttcagtgccgtctacgtggaccgacaagaacagtttcgactcggaagcttgcttaacgtagtgctgacagttttttacattgactagccagtctgatgaacaaccaacggaagaagacgggaaaaccgtctatcaatatgctgaaacgcgtgagaaaccgtgtgtcaactggatccgactcggaccgatg

SEQ ID NO: 13352 - DNA, 203 bp, Homo sapiens
  source 1..203: mol_type = other DNA
ggcgcgccagtcctatacgtctgtctacgtggaccgacaagaacagtttcgactcggaagcttgcttaacgtagtgctgacagttttttattagagagcagatctctgatgaacaaccttgttctccgtggtggaaaaccgtctatcaatatgctgaaacgcgtgagaaaccgtgtgtcaactggatccgactcggaccgatg

SEQ ID NO: 13353 - DNA, 203 bp, Homo sapiens
  source 1..203: mol_type = other DNA
ggcgcgccagtccttgggcaacgtctacgtggacgtggcgatgggtaatcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 13354 - DNA, 203 bp, Homo sapiens
  source 1..203: mol_type = other DNA
ggcgcgccagtcctctccgtgcgtctagggctatgtaactttcacgcctataagttgagattttcacaacttgaacccatttacaaacatgggcaattcaaaatctaaatccaacccatccagttcctcagagtctcaaaaaggggcaccaacagtcacagaatttaggaggactgccattcacagtccgactcggaccgatg

SEQ ID NO: 13355 - DNA, 203 bp, Homo sapiens
  source 1..203: mol_type = other DNA
ggcgcgccagtccttggtgtccgtctccctcctcccctaaccaccccccgaagtgggtcaaacccgcagtaataaaggcccctgaacgtgtatgttggtctcccgggagctgcttgctgaagatccgcgcccctgtcgccgtctggtaggagctgtttgcagggtcctaactcaatcggcttgttgtgcgactcggaccgatg

SEQ ID NO: 13356 - DNA, 203 bp, Homo sapiens
  source 1..203: mol_type = other DNA
ggcgcgccagtcctcaccacaagtctgacgccagggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaacgactcggaccgatg

SEQ ID NO: 13357 - DNA, 203 bp, Homo sapiens
  source 1..203: mol_type = other DNA
ggcgcgccagtcctaatgctatgtctgtgtggaccgacaaggacagttaggggctacctcaatgcttaacacagttctaacagtttgtttgaatagagagcagatctctggaaaaatgaaccaacgaaaaaaggtggttagaccacctttcaatatgctgaaacgcgagagaaaccgcgtatcaaccccgactcggaccgatg

SEQ ID NO: 13358 - DNA, 203 bp, Homo sapiens
  source 1..203: mol_type = other DNA
ggcgcgccagtcctaaatggcagtctgtgtggaccgacaaggacagttccaaatcggaagcttgcttaacacagttctaacagtttgtttcttacactgagccttctctggaaaaatgaaccaacgaaaaaaggtggttagaccacctttcaatatgctgaaacgcgagagaaaccgcgtatcaaccccgactcggaccgatg

SEQ ID NO: 13359 - DNA, 203 bp, Homo sapiens
  source 1..203: mol_type = other DNA
ggcgcgccagtccttggcattcgtctgtgtggaccgacaaggacagttccaaatcggaagcttgcttaacacagttctaacagtttgtttgaatagagagcagagtgtacatcctgataaccaacgaaaaaaggtggttagaccacctttcaatatgctgaaacgcgagagaaaccgcgtatcaaccccgactcggaccgatg

SEQ ID NO: 13360 - DNA, 203 bp, Homo sapiens
  source 1..203: mol_type = other DNA
ggcgcgccagtcctgagcattggtctgttctgaactacaccatttactgctgtgaagaatgccctggaggcaagctggttacagccctgaccaggccctgcccgtgactctcgaccggcgcagggtcaaaaaagtatatcttccgtgcaggaacgcgggagcgtttcttttccttttgtactgacatgcgactcggaccgatg

SEQ ID NO: 13361 - DNA, 203 bp, Homo sapiens
  source 1..203: mol_type = other DNA
ggcgcgccagtcctggcacggagtctgttctgaactacaccatttactgctgtgaagaatgccctggaggcaagctggttacagccctgaccaggccctgcccgtgactctcgaccggcgcagggtcaaaaattgtctaagcagcagcaggaacgcgggagcgtttcttttcctacctgcaccgttctcgactcggaccgatg

SEQ ID NO: 13362 - DNA, 203 bp, Homo sapiens
  source 1..203: mol_type = other DNA
ggcgcgccagtcctacgtcgctgtctgttctgaactacaccatttactgctgtgaagaatgccctggaggcaagctggttacagccctgaccaggccctgcccgtgactctcgaccggcgcagggtcaaaaattgtctaagcagcagcaggaacgcgggataagccagccaaactttgtactgacatgcgactcggaccgatg

SEQ ID NO: 13363 - DNA, 203 bp, Homo sapiens
  source 1..203: mol_type = other DNA
ggcgcgccagtccttagttgaggtctgttctgaactacaccatttactgctgtgaagaatgccctggaggcaagctggttacagccctgataccaggagagagttgactctcgaccggcgcagggtcaaaaattgtctaagcagcagcaggaacgcgggagcgtttcttttccttttgtactgacatgcgactcggaccgatg

SEQ ID NO: 13364 - DNA, 203 bp, Homo sapiens
  source 1..203: mol_type = other DNA
ggcgcgccagtccttgtaagaggtctgttctgaactacaccatttactgctgtgaagaatgcgggctgtatggctgggttacagccctgaccaggccctgcccgtgactctcgaccggcgcagggtcaaaaattgtctaagcagcagcaggaacgcgggagcgtttcttttccttttgtactgacatgcgactcggaccgatg

SEQ ID NO: 13365 - DNA, 203 bp, Homo sapiens
  source 1..203: mol_type = other DNA
ggcgcgccagtcctgattgcgtgtctgttctgaactacaccatttacttactcccccctgttcctggaggcaagctggttacagccctgaccaggccctgcccgtgactctcgaccggcgcagggtcaaaaattgtctaagcagcagcaggaacgcgggagcgtttcttttccttttgtactgacatgcgactcggaccgatg

SEQ ID NO: 13366 - DNA, 203 bp, Homo sapiens
  source 1..203: mol_type = other DNA
ggcgcgccagtccttaaacgcggtctgttgtgtgactctggtaactagagatccctcagaccgaccccacggagaaggaaaatctctagcagtggcgcccgaacagggacctgaaagcgaaagggaaaccagaggagctctctcgacgcaggactcggcttgctgaagcgcgcacggcaagaggcgagcgactcggaccgatg

SEQ ID NO: 13367 - DNA, 203 bp, Homo sapiens
  source 1..203: mol_type = other DNA
ggcgcgccagtcctgtcctggcgtgaacttgcctctctcaacaaaaagccaccgacattaagagagagagtattgcactggcccattgctcaggccctatttagggttaccgcccaggatctgcaacagcattcctgtatcatccagggcaccggtggacttggtgaggattgagttgacctcatcatcgactcggaccgatg

SEQ ID NO: 13368 - DNA, 203 bp, Homo sapiens
  source 1..203: mol_type = other DNA
ggcgcgccagtcctagctacaagtgaacttgcctctctcaacaaaaagccaccgacattaagagagagagtattgctgcttagttaactgcaggccctatttagtccccaatttgtctatctgcaacagcattcctgtatcatccagggcaccggtggacttggtgaggattgagttgacctcatcatcgactcggaccgatg

SEQ ID NO: 13369 - DNA, 203 bp, Homo sapiens
  source 1..203: mol_type = other DNA
ggcgcgccagtcctgaaacatagtgaacttgcctgcggatcgtgcgtcccaccgacattaagagagagagtattgctgcttagttaactgcaggccctatttagggttaccgcccaggatctgcaacagcattcctgtatcatccagggcaccggtggacttggtgaggattgagttgacctcatcatcgactcggaccgatg

SEQ ID NO: 13370 - DNA, 203 bp, Homo sapiens
  source 1..203: mol_type = other DNA
ggcgcgccagtccttaacagcagtgaagggtgagatcgggaaacaaagggtatggccccctagttcccaaagggagcagggagatgggaatagaattgaaggtacagacctcctctgatgggaggaggaatatttaggtaattgtggagactttctcctgtgtgatgaaggcggcagacactgtgatccgactcggaccgatg

SEQ ID NO: 13371 - DNA, 203 bp, Homo sapiens
  source 1..203: mol_type = other DNA
ggcgcgccagtcctacaatacagtgaagggtgagatcgggaaacaaagggtatggccccctagttcccaaagggagcagggagatgggaatagaattgaaggtaggttttaggctactattagcttaagtgttttaggtaattgtggagactttctcctgtgtgatgaaggcggcagacactgtgatccgactcggaccgatg

SEQ ID NO: 13372 - DNA, 203 bp, Homo sapiens
  source 1..203: mol_type = other DNA
ggcgcgccagtcctgtaagcgtgtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcgggctggtgaagttagcgactcggaccgatg

SEQ ID NO: 13373 - DNA, 203 bp, Homo sapiens
  source 1..203: mol_type = other DNA
ggcgcgccagtcctgttacaatgtgaagggtgagatcgggaaacaaagtacccccagtgagcgttcccaaagggagcagggagatgggaatagaattgaaggtaggttttaggctacttgggaggaggaatatttaggtaattgtggagactttctcctgtgtgatgaaggcggcagacactgtgatccgactcggaccgatg

SEQ ID NO: 13374 - DNA, 203 bp, Homo sapiens
  source 1..203: mol_type = other DNA
ggcgcgccagtcctggccacgggtgatctgattagaagtaagaaaattcctagttataatatcgacgcgttataatcatttttaagacccttagttatttagctttaccgcccaggatggggtgcagcgttcctgcaatatccagggcacctaggtgcagccttgtagttttagtggactttaggctacgactcggaccgatg

SEQ ID NO: 13375 - DNA, 203 bp, Homo sapiens
  source 1..203: mol_type = other DNA
ggcgcgccagtcctgggcatcagtgatctgattagaagtaagaaaattcctagttataatatttttaatactgctacatttttaagacccttagttatttagctcccggtaagcctggggggtgcagcgttcctgcaatatccagggcacctaggtgcagccttgtagttttagtggactttaggctacgactcggaccgatg

SEQ ID NO: 13376 - DNA, 203 bp, Homo sapiens
  source 1..203: mol_type = other DNA
ggcgcgccagtccttgcaccgggtgatctgattagaagtaagaaaattcctagttataatatttttaatactgctaggagcccttctttgttagttatttagctttaccgcccaggatggggtgcagcgttcctgcaatatccagggcacctaggtgcagccttgtagttttagtggactttaggctacgactcggaccgatg

SEQ ID NO: 13377 - DNA, 203 bp, Homo sapiens
  source 1..203: mol_type = other DNA
ggcgcgccagtcctacttgggtgtgatctgattagaagtaagaaaatttgcctagcattaggttttaatactgctacatttttaagacccttagttatttagctttaccgcccaggatggggtgcagcgttcctgcaatatccagggcacctaggtgcagccttgtagttttagtggactttaggctacgactcggaccgatg

SEQ ID NO: 13378 - DNA, 203 bp, Homo sapiens
  source 1..203: mol_type = other DNA
ggcgcgccagtcctcgacacaggtgatctgattatgttggttgcgcaacctagttataatatttttaatactgctacatttttaagacccttagttatttagctttaccgcccaggatggggtgcagcgttcctgcaatatccagggcacctaggtgcagccttgtagttttagtggactttaggctacgactcggaccgatg

SEQ ID NO: 13379 - DNA, 203 bp, Homo sapiens
  source 1..203: mol_type = other DNA
ggcgcgccagtcctgcgcccaggtgatcttgcttccttatacaattttctaccaccgtacctaaggaagtagtgctatcttaataattaggttaactatttagttttactgttcaggatgcctattggcagccccataatatccaggacaccctctctgcttcttatatgattaggttgtcatttagacgactcggaccgatg

SEQ ID NO: 13380 - DNA, 203 bp, Homo sapiens
  source 1..203: mol_type = other DNA
ggcgcgccagtcctcaaagcacgtgatcttgcttccttatacaattttgagaggttaataagaaggaagtagtgctatcttaataattaggttaactatttagttttactgttcaggagtttggcgatggtacccataatatccaggacaccctctctgcttcttatatgattaggttgtcatttagacgactcggaccgatg

SEQ ID NO: 13381 - DNA, 203 bp, Homo sapiens
  source 1..203: mol_type = other DNA
ggcgcgccagtcctcaaagtcggtgatcttgcttccttatacaattttgagaggttaataagaaggaagtagtgctatcttaataattaggttaactatttagttttactgttcaggatgcctattggcagccccataatatccaggacaccctctctgcttcttatatgattataggaagggcatttcgactcggaccgatg

SEQ ID NO: 13382 - DNA, 203 bp, Homo sapiens
  source 1..203: mol_type = other DNA
ggcgcgccagtcctcgcgtggagtgatcttgcttccttatacaattttgagaggttaataagaaggaagtagtgctatcttaataattaggttaactatttagttttactgttcaggatgcctattggcagccccataatatccagtcgtagggtgggtattcttatatgattaggttgtcatttagacgactcggaccgatg

SEQ ID NO: 13383 - DNA, 203 bp, Homo sapiens
  source 1..203: mol_type = other DNA
ggcgcgccagtcctccagaaccgtgatcttgcttgcggaggcaaaatttgcacagtataaaatctgcaagtagtgctattgttggaatcaccgtacctatttaggtttacgctccaagatcggtggatagcagccctatcaatatcccttcctctgagaatatgtttagaagattaggtagtctctaacgactcggaccgatg

SEQ ID NO: 13384 - DNA, 203 bp, Homo sapiens
  source 1..203: mol_type = other DNA
ggcgcgccagtcctagaaccgagtgatcttgcttgcggaggcaaaatttgcacagtataaaatctgcaagtagtgctattgttggaatcaccgtacctatttaggtttacgctccaagatcggtggatagcagccctatcaatatctaggagaactgtgctatgtttagaagattaggtagtctctaacgactcggaccgatg

SEQ ID NO: 13385 - DNA, 203 bp, Homo sapiens
  source 1..203: mol_type = other DNA
ggcgcgccagtcctaggagtgtgtgatcttgcttgcggaggcaaaatttgcacagtataaaatctgcaagtagtgctattgttggaatcattccgtaacgggttgtttacgctccaagatcggtggatagcagccctatcaatatctaggagaactgtgctatgtttagaagattaggtagtctctaacgactcggaccgatg

SEQ ID NO: 13386 - DNA, 203 bp, Homo sapiens
  source 1..203: mol_type = other DNA
ggcgcgccagtcctctccaaccgtgatgctgggcgagagagagccgccgcgccggagcctccttctttcctgcctctgattccgggctgtcatggcgacccccaacaatctgacccccaccaactgcagctggtggcccatctccgacgaacccgaatgggcggccaagccagcggaggcccccgacgcgactcggaccgatg

SEQ ID NO: 13387 - DNA, 203 bp, Homo sapiens
  source 1..203: mol_type = other DNA
ggcgcgccagtcctgtgcgaatgtgatgctgggcgagagagagccgccgcgccggagcctccttctttcctgcctctgattccgggctgtcatggcgacccccaacaatctgacccccaccaactgcagctggtggcccatctccgcgctggagagcgatagttagtgttgcctggaggcccccgacgcgactcggaccgatg

SEQ ID NO: 13388 - DNA, 203 bp, Homo sapiens
  source 1..203: mol_type = other DNA
ggcgcgccagtccttagagcgcgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgcgactcggaccgatg

SEQ ID NO: 13389 - DNA, 203 bp, Homo sapiens
  source 1..203: mol_type = other DNA
ggcgcgccagtcctggtccgtggtgatgctgggcgagagagagccgccgcgccggagcctccttctttcctgcctctgattccgggctgtcatggcgacccccaacaatctgacccccaccaactgcagctgtctaagtcgtataccgctggagagcgatgcggccaagccagcggaggcccccgacgcgactcggaccgatg

SEQ ID NO: 13390 - DNA, 203 bp, Homo sapiens
  source 1..203: mol_type = other DNA
ggcgcgccagtcctagcgcgaggtgatgctgggcgagagagagccgccgcgccggagcctccttctttcctgcctctgattccgggctgtcatggcgacccccaacaatctgacccccctaggtgctgctacgtggcccatctccgcgctggagagcgatgcggccaagccagcggaggcccccgacgcgactcggaccgatg

SEQ ID NO: 13391 - DNA, 203 bp, Homo sapiens
  source 1..203: mol_type = other DNA
ggcgcgccagtcctcagtatttgtgattagaacggtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttcgactcggaccgatg

SEQ ID NO: 13392 - DNA, 203 bp, Homo sapiens
  source 1..203: mol_type = other DNA
ggcgcgccagtccttccctgtagtgcactattcaacgggagatctattttccccttcgtcgatgttggagtgtcggctctcctgctagcagccggatgctggggacaagtcaccctcaccgttacggtaacagcggcaacactccttttttgccactatgcctacatggttcccggttggcaagctgacgactcggaccgatg

SEQ ID NO: 13393 - DNA, 203 bp, Homo sapiens
  source 1..203: mol_type = other DNA
ggcgcgccagtcctctttggcggtgcactattcacactcgcgcgaggcaggattacttattgtgttggagtgtcggctctcctgctagcagccggatgctggggacaagtcaccctcaccgttacggtaacagcggcaacactccttttttgccactatgcctacatggttcccggttggcaagctgacgactcggaccgatg

SEQ ID NO: 13394 - DNA, 203 bp, Homo sapiens
  source 1..203: mol_type = other DNA
ggcgcgccagtcctggacaaccgtgcactattcacactcgcgcgaggcttccccttcgtcgatgttggagtgtcggctctcctgctagcagccggatgctggggtgccactcttagtcccgttacggtaacagcggcaacactccttttttgccactatgcctacatggttcccggttggcaagctgacgactcggaccgatg

SEQ ID NO: 13395 - DNA, 203 bp, Homo sapiens
  source 1..203: mol_type = other DNA
ggcgcgccagtcctccgctgccgtgcactattcacactcgcgcgaggcttccccttcgtcgatgttggagtgtcggtgtcagctacgtaggccggatgctggggacaagtcaccctcaccgttacggtaacagcggcaacactccttttttgccactatgcctacatggttcccggttggcaagctgacgactcggaccgatg

SEQ ID NO: 13396 - DNA, 203 bp, Homo sapiens
  source 1..203: mol_type = other DNA
ggcgcgccagtcctctatagccgtggcaagacaagctcagaactgagaagctgtcaccacagttctggaggctgggaagttcaagatcaaagtgccagcagattcagtgtcatgtgaggacgtgcttcctgcttcatagataagagtagcttggagctcgatacgttgcgactgaccatctggtcgcgcgactcggaccgatg

SEQ ID NO: 13397 - DNA, 203 bp, Homo sapiens
  source 1..203: mol_type = other DNA
ggcgcgccagtcctggtgtttcgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgcgactcggaccgatg

SEQ ID NO: 13398 - DNA, 203 bp, Homo sapiens
  source 1..203: mol_type = other DNA
ggcgcgccagtccttaagattggtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagctaatcgcaagtatccgactcggaccgatg

SEQ ID NO: 13399 - DNA, 203 bp, Homo sapiens
  source 1..203: mol_type = other DNA
ggcgcgccagtcctaggaacgggtggcaagacaagctcagaactgagaagctgtcaccacagttctggaggctgggaagttcaagatcaagtattggatgatgccagtgtcatgtgaggacgtgcttcctgcttcatagataagagtagcttggagctcggcggcacaaccagcaccatctggtcgcgcgactcggaccgatg

SEQ ID NO: 13400 - DNA, 203 bp, Homo sapiens
  source 1..203: mol_type = other DNA
ggcgcgccagtcctgggagccagtggcaagacaagctcagaactgagaagctgtcaccacagttctggaggctgggctcacttccgaactagtgccagcagattcagtgtcatgtgaggacgtgcttcctgcttcatagataagagtagcttggagctcggcggcacaaccagcaccatctggtcgcgcgactcggaccgatg

SEQ ID NO: 13401 - DNA, 203 bp, Homo sapiens
  source 1..203: mol_type = other DNA
ggcgcgccagtcctagtttggcgtggcaagacaagctcagaactgagatctacgtgtggagtttctggaggctgggaagttcaagatcaaagtgccagcagattcagtgtcatgtgaggacgtgcttcctgcttcatagataagagtagcttggagctcggcggcacaaccagcaccatctggtcgcgcgactcggaccgatg

SEQ ID NO: 13402 - DNA, 203 bp, Homo sapiens
  source 1..203: mol_type = other DNA
ggcgcgccagtcctcactgtgagtggcagggacaaccacaaccacaacggccgggggaggagaaggcggcagcggcgattctaggcggcccaggcggcggggaggaggagaaggaggagggtggcggccgggcttggcttcggctctcgataacaacttgggcggcgcgacccggggaaccggcattgcgactcggaccgatg

SEQ ID NO: 13403 - DNA, 203 bp, Homo sapiens
  source 1..203: mol_type = other DNA
ggcgcgccagtcctgcggatctgtggcagggacaaccacaaccacaacggccgggggaggaggccatacgccatttgattctaggcggcccaggcggcggggaggaggagaaggaggagggtggcggccgggcttggcttcggctccttgaggagttggcggcggcgcgacccggggaaccggcattgcgactcggaccgatg

SEQ ID NO: 13404 - DNA, 203 bp, Homo sapiens
  source 1..203: mol_type = other DNA
ggcgcgccagtcctattgtcttgtggcagggacaggtgagcagtttttggccgggggaggagaaggcggcagcggcgattctaggcggcccaggcggcggggaggaggagaaggaggagggtggcggccgggcttggcttcggctccttgaggagttggcggcggcgcgacccggggaaccggcattgcgactcggaccgatg

SEQ ID NO: 13405 - DNA, 203 bp, Homo sapiens
  source 1..203: mol_type = other DNA
ggcgcgccagtcctctcccaaagtggctgggctgctcgggttagatcgtcaggtgagggaggccacccatcaagaagcgaaggaagtgctggagtcgtgtgttttggctgcgcgtgatcctgcgtgggtcgggaggtgtttctgtgaaaagcctaaagattagactgtaagaaaagaaaatagaagcccgactcggaccgatg

SEQ ID NO: 13406 - DNA, 203 bp, Homo sapiens
  source 1..203: mol_type = other DNA
ggcgcgccagtcctctctccacgtgggcatgggagtcagctgcacagtcactcgggaagatggaaccaatcgcagaggacttctattactaaccgatcacatgatgtcacccagacatcaggcatacccactagtgtgaaatagacatcagaattaagaaaaacgtagggtccaagtggtttcccgttcgactcggaccgatg

SEQ ID NO: 13407 - DNA, 203 bp, Homo sapiens
  source 1..203: mol_type = other DNA
ggcgcgccagtcctttgtagtagtgggcatgggagtcagctgcacagtcactcgggaagatggaaccaatcgcagatagggctgccagtgaaccgatcacatgagtaatgagtttaggcaggcatacccactagtgtgaaatagacatcagaattaagaaaaacgtagggtccaagtggtttcccgttcgactcggaccgatg

SEQ ID NO: 13408 - DNA, 203 bp, Homo sapiens
  source 1..203: mol_type = other DNA
ggcgcgccagtcctgcccgcttgtggtggtggtggaaggggggaggtgctagcagggccagccttgaactcgctggacagagctacagacctatggggcctggaagtgcccgctgagaaagggagaagacagagttttttaatgtcaggtgaggggttgcctccgaggcaacctccaagtcccagatccgactcggaccgatg

SEQ ID NO: 13409 - DNA, 203 bp, Homo sapiens
  source 1..203: mol_type = other DNA
ggcgcgccagtcctggaggcaggtggtggtggtggaaggggggaggtgctagcagggccagccttgaactcgctggacagagctacagacctatggggcctggaagtgcccgctgagaaagggagaagacagcagaggggttgccgaggtgaggggttgcctccgaggcaaccttggtagggagacgacgactcggaccgatg

SEQ ID NO: 13410 - DNA, 203 bp, Homo sapiens
  source 1..203: mol_type = other DNA
ggcgcgccagtcctcggcctccgtggtggtggtggaaggggggaggtgctagcagggccagccttgaactcgctggcacttaggtacagtctatggggcctggaagtgcccgctgagaaagggagaagacagcagaggggttgccgaggtgaggggttgcctccgaggcaacctccaagtcccagatccgactcggaccgatg

SEQ ID NO: 13411 - DNA, 203 bp, Homo sapiens
  source 1..203: mol_type = other DNA
ggcgcgccagtcctcttccctggtgtaaatccaggctcgaaccctactgcgaggtggagagcctcttaaccggatgctacgggtgatgactgggaggaggagaaaaattacctctttatcttgcatgaacatcttaattttcaggaccagaggagcgagagcagcaagaaccacacccagcagcaatgcgactcggaccgatg

SEQ ID NO: 13412 - DNA, 203 bp, Homo sapiens
  source 1..203: mol_type = other DNA
ggcgcgccagtcctctttaagcgtgtaaatccagttagaccaaaatgacgcgttcccctctgctcttaaccggatgctacgggtgatgactgggaggaggagaaaaattacctctttatcttgcatgaacatcttaattttcaggaccagaggagcgagagcagcaagaaccacacccagcagcaatgcgactcggaccgatg

SEQ ID NO: 13413 - DNA, 203 bp, Homo sapiens
  source 1..203: mol_type = other DNA
ggcgcgccagtcctaggcgtacgtgtaaatccagttagaccaaaatgagcgaggtggagagcctcttaaccggatgctacgggtgatgacaatccatcctgcgcaaattacctctttatcttgcatgaacatcttaattttcaggaccagaggagcgagagcagcaagaaccacacccagcagcaatgcgactcggaccgatg

SEQ ID NO: 13414 - DNA, 203 bp, Homo sapiens
  source 1..203: mol_type = other DNA
ggcgcgccagtcctccgggcccgtgtaaatccagttagaccaaaatgagcgaggtggagagcctcttaaccggatgctacgggtgatgactgggaggaggagaaaaattacctctttatcttgcatgaacatcttaattttcaggaccagaggagcgagaatctagtagcttgaacccagcagcaatgcgactcggaccgatg

SEQ ID NO: 13415 - DNA, 203 bp, Homo sapiens
  source 1..203: mol_type = other DNA
ggcgcgccagtccttatcataggtgtgagagggaagcgccgcggcctgcgcagacgaggggtcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 13416 - DNA, 203 bp, Homo sapiens
  source 1..203: mol_type = other DNA
ggcgcgccagtcctgacgtgccgtgtgagagggaagcgccgcggcctgtatttctagacctgcccttcgcctggttcgtggcgccttgtgaccccgggcccctgaacaggcattaaacgaaattgcgctgtgctcctgtgctacggcctgtggctggactgcctgctgctgcccaactggctggcaagcgactcggaccgatg

SEQ ID NO: 13417 - DNA, 203 bp, Homo sapiens
  source 1..203: mol_type = other DNA
ggcgcgccagtcctatgacctagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgccccgtcaatgccttgccgactcggaccgatg

SEQ ID NO: 13418 - DNA, 203 bp, Homo sapiens
  source 1..203: mol_type = other DNA
ggcgcgccagtcctgtctgagtgtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccgctaaaaacattttcgactcggaccgatg

SEQ ID NO: 13419 - DNA, 203 bp, Homo sapiens
  source 1..203: mol_type = other DNA
ggcgcgccagtcctatctaacagtgtgagagggaagcgccgcggcctgtatttctagacctgcccttcgcctggttcgtggcgccttgtgaccccgggcccctgccgcctgcaagtcggaaattgcgctgtgtcgtatctggttaccctgtggctggactgcctgctgctgcccaactggctggcaagcgactcggaccgatg

SEQ ID NO: 13420 - DNA, 203 bp, Homo sapiens
  source 1..203: mol_type = other DNA
ggcgcgccagtcctgtctgcccgtgtgagagggaagcgccgcggcctgtatttctagacctgcccttcgcctggttcgtggcgccttgtgtttattacggggatccgcctgcaagtcggaaattgcgctgtgctcctgtgctacggcctgtggctggactgcctgctgctgcccaactggctggcaagcgactcggaccgatg

SEQ ID NO: 13421 - DNA, 203 bp, Homo sapiens
  source 1..203: mol_type = other DNA
ggcgcgccagtcctaactcctagtgtgagagggaagcgccgcggcctgtatttctagacctgcccttcgcctggttgtcacgagaaaagaaccccgggcccctgccgcctgcaagtcggaaattgcgctgtgctcctgtgctacggcctgtggctggactgcctgctgctgcccaactggctggcaagcgactcggaccgatg

SEQ ID NO: 13422 - DNA, 203 bp, Homo sapiens
  source 1..203: mol_type = other DNA
ggcgcgccagtcctgcacacacgtgtgagagggatatagacgaattcttatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 13423 - DNA, 203 bp, Homo sapiens
  source 1..203: mol_type = other DNA
ggcgcgccagtcctccaacggcgtgtgatcttgcgcgataaatgctgacgtgaaaacgttgcgtattgctacaacacttggttagctatttagctttactaatcaagacgccgtcgtgcagcccacaaaagtctagatacgtcacaggagagcatacgctaggtcgcgttgactgctgaatgtgtcatcgactcggaccgatg

SEQ ID NO: 13424 - DNA, 203 bp, Homo sapiens
  source 1..203: mol_type = other DNA
ggcgcgccagtccttaaatggtgttaagtttcgcactactaggaatttttgcgaaaattcttaattccattcttatggtgtagtgtttgttcttttcaattggggcgtatctctctttcgcagagaccctggcccaaccctgaaatgaataaaattttactggtcgcgcgtctcaatcgaccttctagcgactcggaccgatg

SEQ ID NO: 13425 - DNA, 203 bp, Homo sapiens
  source 1..203: mol_type = other DNA
ggcgcgccagtcctgggaaatcgttaagtttcgcactactaggaatttttgcgaaaattcttaattccattcttatggtgtagtgtttgttcttttcaattggggcgtatctctctttcgcagagaccctggcccaaccctgaaattcgagcggcgagggaaaaattcatcgaaaatcgaccttctagcgactcggaccgatg

SEQ ID NO: 13426 - DNA, 203 bp, Homo sapiens
  source 1..203: mol_type = other DNA
ggcgcgccagtcctcacgtcaggttaccctccttagtttagctgtgagctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 13427 - DNA, 203 bp, Homo sapiens
  source 1..203: mol_type = other DNA
ggcgcgccagtcctggcccttagttaccctccttccggacagcaccccctcccttctccggtagctcctacccctgcctgtgcgggcctcccaaagatttaagaccctcggtgctgcctccgacagcgccgcgctctctcagccgcccccctgcccctcgggcccccctctctgctgcccctggcgcccgactcggaccgatg

SEQ ID NO: 13428 - DNA, 203 bp, Homo sapiens
  source 1..203: mol_type = other DNA
ggcgcgccagtcctgctaagtagttaccctccttccggacagcaccccctcccttctccggtagctcctacccctgcctgtgcgggcctcgtccccgcgcccagattgtaccttacaatccgacagcgccgcgctctctcagccgcccccctgcccctcgggcccccctctctgctgcccctggcgcccgactcggaccgatg

SEQ ID NO: 13429 - DNA, 203 bp, Homo sapiens
  source 1..203: mol_type = other DNA
ggcgcgccagtcctcggtcgaggttaccctccttccggacagcaccccctcccttctccggtagctcctacccctgcctgtgcgggcctcgtccccgcgcccagccctcggtgctgcccttactctgcgatagctctctcagccgcccccctgcccctcgggcccccctctctgctgcccctggcgcccgactcggaccgatg

SEQ ID NO: 13430 - DNA, 203 bp, Homo sapiens
  source 1..203: mol_type = other DNA
ggcgcgccagtcctagtcatctgttaccctccttccggacagcaccccctcccttctccggtagctcctacccctgcctgtgcgggcctcgtccccgcgcccagccctcggtgctgcctccgacagcgccgcatggagcggattctccccctgcccctcgggcccccctctctgctgcccctggcgcccgactcggaccgatg

SEQ ID NO: 13431 - DNA, 203 bp, Homo sapiens
  source 1..203: mol_type = other DNA
ggcgcgccagtcctaaccagatgttaccctccttccggacagcaccccctcccttctccggtagctcctacccctgcctgtgcgggcctcgtccccgcgcccagccctcggtgctgcctccgacagcgccgcgctctctcagccgcccccctgcccctcgctaagtagaaatgcctgcccctggcgcccgactcggaccgatg

SEQ ID NO: 13432 - DNA, 203 bp, Homo sapiens
  source 1..203: mol_type = other DNA
ggcgcgccagtcctgttgcctcgttaccctccttccggacagcaccccctcccttctccggtagctcctacccctgcctgtgcgggcctcgtccccgcgcccagccctcggtgctgcctccgacagcgccgcgctctctcagccgcttagtctgatacgcggcccccctctctgctgcccctggcgcccgactcggaccgatg

SEQ ID NO: 13433 - DNA, 203 bp, Homo sapiens
  source 1..203: mol_type = other DNA
ggcgcgccagtcctcggattcagttaccctccttccggacagcaccccctcccttctccggtagctcctacccctgttaacagcttgaaggtccccgcgcccagccctcggtgctgcctccgacagcgccgcgctctctcagccgcccccctgcccctcgggcccccctctctgctgcccctggcgcccgactcggaccgatg

SEQ ID NO: 13434 - DNA, 203 bp, Homo sapiens
  source 1..203: mol_type = other DNA
ggcgcgccagtccttctctagtgttaccctccttccggacagcaccccctcccttctccggtcatctactttgggtcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 13435 - DNA, 203 bp, Homo sapiens
  source 1..203: mol_type = other DNA
ggcgcgccagtcctgttctagggttaccctccttccggacagcaccccgggttccggtgaacagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 13436 - DNA, 203 bp, Homo sapiens
  source 1..203: mol_type = other DNA
ggcgcgccagtcctcacagttcgttccatgccccgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatccgactcggaccgatg

SEQ ID NO: 13437 - DNA, 203 bp, Homo sapiens
  source 1..203: mol_type = other DNA
ggcgcgccagtcctggatcaaggttccccaacttcctcggcgctccggactcccaagtctccgccggaccctcctttggatattcctcgtgtctccgattctgacgttttttaccggtacggtggggcctccccacctgccccgcagaagatgcagttctttggccgcctggtcaataccttcagtggcgactcggaccgatg

SEQ ID NO: 13438 - DNA, 203 bp, Homo sapiens
  source 1..203: mol_type = other DNA
ggcgcgccagtcctgtgttcgtgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcgtagatacactatacgactcggaccgatg

SEQ ID NO: 13439 - DNA, 203 bp, Homo sapiens
  source 1..203: mol_type = other DNA
ggcgcgccagtcctgggcgcgtgttccccaacttcctcggcgctccggactcccaagtctccgccggaccctcctttggatattcctcgtgtctccgattctgagacagagggggaagacggtggggcctccgggaggatgagcacgaagatgcagttctttggccgcctggtcaataccttcagtggcgactcggaccgatg

SEQ ID NO: 13440 - DNA, 203 bp, Homo sapiens
  source 1..203: mol_type = other DNA
ggcgcgccagtccttgggacaggttccccaacttttaaacaaggtgacactcccaagtctccgccggaccctcctttggatattcctcgtgtctccgattctgagacagagggggaagacggtggggcctccccacctgccccgcagaagatgcagttctttggccgcctggtcaataccttcagtggcgactcggaccgatg

SEQ ID NO: 13441 - DNA, 203 bp, Homo sapiens
  source 1..203: mol_type = other DNA
ggcgcgccagtccttaacgcccgttcttaaacggcgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgcgactcggaccgatg

SEQ ID NO: 13442 - DNA, 203 bp, Homo sapiens
  source 1..203: mol_type = other DNA
ggcgcgccagtcctgaggtcatgttgaagcattacaggccaggtctctgcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagacgactcggaccgatg

SEQ ID NO: 13443 - DNA, 203 bp, Homo sapiens
  source 1..203: mol_type = other DNA
ggcgcgccagtcctaattacgggttgattttttatttactttgcaaaacgcgtccgccattcgagcatctagtttcaacttccttttgcagcaagttctttcctgcactaatcacaattcttggaagaggagaactggacgttgtgaacagagttagctggtaaatgtcctcttaaaagatccaaaaacgactcggaccgatg

SEQ ID NO: 13444 - DNA, 203 bp, Homo sapiens
  source 1..203: mol_type = other DNA
ggcgcgccagtcctattagcgggttgattttttatttactttgcaaaagtttctgataggcgtctttatatagggaaacttccttttgcagcaagttctttcctgcactaatcacaattcttggaagaggagaactggacgttgtgaacagagttagctggtaaatgtcctcttaaaagatccaaaaacgactcggaccgatg

SEQ ID NO: 13445 - DNA, 203 bp, Homo sapiens
  source 1..203: mol_type = other DNA
ggcgcgccagtcctttgctaacgttgcaagcctaatgctcacctgcagagacagaattcctgagtgaacgaacagagcagctcctcttccatctccagaaatgacctccaccttcaacccccgagaatgtaagaaacagctcgtctaagggcaaaactatggcttcttcctgcgaattgagaaggacacgactcggaccgatg

SEQ ID NO: 13446 - DNA, 203 bp, Homo sapiens
  source 1..203: mol_type = other DNA
ggcgcgccagtcctgcgcactagtttcccctggactcgttcataacctgattggcatgctacaggctgttgctgacggcaaggctcatttcactgagtcagtgaagccagtgctcgacctgacaaattcaatgggtgtggttcattaatgaataacatgtcttctgctgcgcccatgggttcgcgacccgactcggaccgatg

SEQ ID NO: 13447 - DNA, 203 bp, Homo sapiens
  source 1..203: mol_type = other DNA
ggcgcgccagtccttacctgcggtttcccctggactcgttcataacctgattggcatgctacaggctgttgctgacggcaaggctcatttcactgagtcagtgaagccagtgctcgactaacagctgatttgcctgtgtcgggtggaatgaataacatgtcttctgctgcgcccatgggttcgcgacccgactcggaccgatg

SEQ ID NO: 13448 - DNA, 203 bp, Homo sapiens
  source 1..203: mol_type = other DNA
ggcgcgccagtcctgatacttggtttcccctggactcgttcataacctgattggcatgctacaggctgttgctgacggcaaggctcattttcaaccagatcattagccagtgctcgacctgacaaattcaatcctgtgtcgggtggaatgaataacatgtcttctgctgcgcccatgggttcgcgacccgactcggaccgatg

SEQ ID NO: 13449 - DNA, 203 bp, Homo sapiens
  source 1..203: mol_type = other DNA
ggcgcgccagtcctgtttctgggtttggtgcgtcgcgcttcaatcaccgcgagtttacgcgggccagttgttgctggtcgcatgggagctgctgctaaataatttctgctcagccatgtcgccggctccagatgcagccccggctcctgcgtcgatctccctgtttgacctcagcgcggatgctccggcgactcggaccgatg

SEQ ID NO: 13450 - DNA, 203 bp, Homo sapiens
  source 1..203: mol_type = other DNA
ggcgcgccagtcctcctctccggtttggtgcgtcttctaagggcgtgggcgagtttacgcgggccagttgttgctggtcgcatgggagctatctagttcctggatctgctcagccatgtcgccggctccagatgcagccccggctcctgcgtcgatctccctgtttgacctcagcgcggatgctccggcgactcggaccgatg

SEQ ID NO: 13451 - DNA, 203 bp, Homo sapiens
  source 1..203: mol_type = other DNA
ggcgcgccagtcctattagaaagtttggtgcgtcttctaagggcgtgggcgagtttacgcgggccagttgttgctggtcgcatgggagctgctgctaaataatttctgctcagccatgtcgccggctccagatgcagccccggctcctgcgtcgatctccctgtttgacctcaggatcatcctcgtctcgactcggaccgatg

SEQ ID NO: 13452 - DNA, 203 bp, Homo sapiens
  source 1..203: mol_type = other DNA
ggcgcgccagtccttacttcttgtttggtgcgtcttctaagggcgtggtgagtgagcaattcgccagttgttgctggtcgcatgggagctgctgctaaataatttctgctcagccatgtcgccggctccagatgcagccccggctcctgcgtcgatctccctgtttgacctcagcgcggatgctccggcgactcggaccgatg

SEQ ID NO: 13453 - DNA, 203 bp, Homo sapiens
  source 1..203: mol_type = other DNA
ggcgcgccagtccttctgcattgttttgaaactgacttccagagctccactgcctccctgcaccatgccctacaacttctgcctgcccagcctgagctgccgcaccagctgcgttagatggccctgtgtgccccccagctgccacggctacaccctgcccggggcctgcaacatccctgccaatgtgacgactcggaccgatg

SEQ ID NO: 13454 - DNA, 203 bp, Homo sapiens
  source 1..203: mol_type = other DNA
ggcgcgccagtccttggcgccggttttgaaactgacttccagagctccactgcctccctgcaccatgccctacaacttctgcctgcccagcctgagctgccgcaccagctgctcctccatcgtgcaaacctaccccagctgccacggctacaccctgcccggggcctgcaacatccctgccaatgtgacgactcggaccgatg

SEQ ID NO: 13455 - DNA, 203 bp, Homo sapiens
  source 1..203: mol_type = other DNA
ggcgcgccagtcctaatccgaggttttgaaactgacttccagagctccactgcctccctgcaccatgccctacaacttctgcctgcccagcctgagctgccgcaccagctgctcctcccggccctgtgtgccccccagctgccacggcactcttttgcccggggcctgcaacatccctgccaatgtgacgactcggaccgatg

SEQ ID NO: 13456 - DNA, 203 bp, Homo sapiens
  source 1..203: mol_type = other DNA
ggcgcgccagtcctgtacgtaagttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacataggaagtttctgtccgactcggaccgatg

SEQ ID NO: 13457 - DNA, 203 bp, Homo sapiens
  source 1..203: mol_type = other DNA
ggcgcgccagtcctgttcatacgttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 13458 - DNA, 203 bp, Homo sapiens
  source 1..203: mol_type = other DNA
ggcgcgccagtcctcagagagtgttttgaaactgacttccagagctccactgcctccctgcaccatgccctacaacttctgcctgcccagcctgagctgccgcagtctactgatacagcggccctgtgtgccccccagctgccacggctacaccctgcccggggcctgcaacatccctgccaatgtgacgactcggaccgatg

SEQ ID NO: 13459 - DNA, 203 bp, Homo sapiens
  source 1..203: mol_type = other DNA
ggcgcgccagtcctggacgttcgttttgaaactgacttccagagctcctgccggagttacatccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 13460 - DNA, 203 bp, Homo sapiens
  source 1..203: mol_type = other DNA
ggcgcgccagtcctcaagacttgttttgaaactggtccatgattagtaactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 13461 - DNA, 203 bp, Homo sapiens
  source 1..203: mol_type = other DNA
ggcgcgccagtccttcgtatgttaaaagctgtccgcgcgggagcccagcaagttcgcttcactgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 13462 - DNA, 203 bp, Homo sapiens
  source 1..203: mol_type = other DNA
ggcgcgccagtcctgacccaactaaaagctgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 13463 - DNA, 203 bp, Homo sapiens
  source 1..203: mol_type = other DNA
ggcgcgccagtcctgaagaaggtaaacaggctctcgcgatcactaccaggccgtggcaggctggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13464 - DNA, 203 bp, Homo sapiens
  source 1..203: mol_type = other DNA
ggcgcgccagtcctgtcgggagtaaacaggctctgtatccgtggcagcggccgtggcaggctggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13465 - DNA, 203 bp, Homo sapiens
  source 1..203: mol_type = other DNA
ggcgcgccagtcctggagatcgtaaacaggctctgtatccgtggcagcggccgtggcaggctggctgggtaccggctgtcgctgacccaggagaagctgcctgtctacatcagcctgggctgcagcgcgctgtgagtatatacgtcgcagagcagaactcctctagggaacctggatgggaaacagcccgactcggaccgatg

SEQ ID NO: 13466 - DNA, 203 bp, Homo sapiens
  source 1..203: mol_type = other DNA
ggcgcgccagtcctcgaaaggataaacaggctctgtatccgtggcagcggccgtggcaggctggctgggtgggttaatgcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13467 - DNA, 203 bp, Homo sapiens
  source 1..203: mol_type = other DNA
ggcgcgccagtccttgtccggttaaacaggctctgtatccgtggcagctttgtgccagctaaggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13468 - DNA, 203 bp, Homo sapiens
  source 1..203: mol_type = other DNA
ggcgcgccagtcctagaggtcctaaacaggctctgtatccgtggccctaagacgggcaggctggctgggtaccggctgtcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13469 - DNA, 203 bp, Homo sapiens
  source 1..203: mol_type = other DNA
ggcgcgccagtccttacccggataaacaggctctgtatccgtggccctaagacgggcaggctggctgggtgggttaatgcgctgacccaggagaagctgcctgtctacatcagcctgggctgcagcgcgctgccgccgcggggccggcagagcagaactcctctagggaacctggatgggaaacagcccgactcggaccgatg

SEQ ID NO: 13470 - DNA, 203 bp, Homo sapiens
  source 1..203: mol_type = other DNA
ggcgcgccagtcctggcgcatttaaactgtgccgtgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactccccgactcggaccgatg

SEQ ID NO: 13471 - DNA, 203 bp, Homo sapiens
  source 1..203: mol_type = other DNA
ggcgcgccagtcctttgcacggtaaagaacaggaaaaagagaaaaaatcagtgatctgtgtcgagggcaatattgcaagtgggaagacgacatgcctggaattcttctccaacgcgacagacgtcgaggtgttaacggagcctgtgtccaagtggagaaatgtccgtggccacagattcagttaaaaccgactcggaccgatg

SEQ ID NO: 13472 - DNA, 203 bp, Homo sapiens
  source 1..203: mol_type = other DNA
ggcgcgccagtcctcatgatcctaaagaacaggaaaaagagaaaaaatcagtgatctgtgtcgagggcaatattgcaagtgggaagacgagcatttcccttacattctccaacgcgacagacgtcgaggtgttaacggagcctgtgtccaagtggagaaatgtccgtggccacaatcctctgggcctgcgactcggaccgatg

SEQ ID NO: 13473 - DNA, 203 bp, Homo sapiens
  source 1..203: mol_type = other DNA
ggcgcgccagtcctgtcaccagtaaagaacaggatttcccccgttgcacagtgatctgtgtcgagggcaatattgcaagtgggaagacgacatgcctggaattcttctccaacgcgacagacgtcgaggtgttaacggagcctgtgtccaagtggagaaatgtccgtggccacaatcctctgggcctgcgactcggaccgatg

SEQ ID NO: 13474 - DNA, 203 bp, Homo sapiens
  source 1..203: mol_type = other DNA
ggcgcgccagtcctataccggctaaagatgaggtttttgctaaatttttttgagtttatatttgtatgtcttatgctgaaaaatcttgtttcctaattagtaacgggcgatgaaggacgatgggtaaatattttagggccgattctttggttttatagccaagataccctgttgataaagtcttgtggcgactcggaccgatg

SEQ ID NO: 13475 - DNA, 203 bp, Homo sapiens
  source 1..203: mol_type = other DNA
ggcgcgccagtcctaagcctcgtaaatattactttcctcaaaaagagaaaacaaaaatgctagattttactttatgacttgaatgatgtggtaatgtcgaactctagtatttagaattagaatgtttcttagcggtcgtgtagttatttttatgtcataacctaggcgcagaccagctcctataacaacgactcggaccgatg

SEQ ID NO: 13476 - DNA, 203 bp, Homo sapiens
  source 1..203: mol_type = other DNA
ggcgcgccagtcctgtaagacataaatcccacgagggtcctttcttggattaacccgctcaatgcccggaaatttgggcgtgcccccgcaagactgctagccgagtagtgttgggtcgcgaaaggccttgcggtactgcctgatagggtgcttgcgagtgccccgggaggtctcgtagaccgtgcacccgactcggaccgatg

SEQ ID NO: 13477 - DNA, 203 bp, Homo sapiens
  source 1..203: mol_type = other DNA
ggcgcgccagtcctacacgacctaaatcccggccgatatggactcaaaaagaattaaaagaagctttgtccgatgggatagtgaagtctcacaccaacatttacaattgttatttagaaaacatagaaattatatatgtcaaggcttacttaagttagtaaaaacacatcagagtgggataagtgacacgactcggaccgatg

SEQ ID NO: 13478 - DNA, 203 bp, Homo sapiens
  source 1..203: mol_type = other DNA
ggcgcgccagtcctaacgattttaaattcccgcttaagttggctggtactgccgtaataaatttaagagcagaccatgcagccatgtatctttattcccttcttgaaaagggtaaactacttattagagatacaaataaagaagttttcgttggtgacagtttggttaatgtaatctaaactttaaaacgactcggaccgatg

SEQ ID NO: 13479 - DNA, 203 bp, Homo sapiens
  source 1..203: mol_type = other DNA
ggcgcgccagtcctaccatcaataaccttacactgtaaggggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctgcgactcggaccgatg

SEQ ID NO: 13480 - DNA, 203 bp, Homo sapiens
  source 1..203: mol_type = other DNA
ggcgcgccagtccttgaggtggtaagacacttgctgtcctaacacctgctataggctatccactgcatcatctctcctgccatacttcctactcacatcatatctattttaaagaaaaaataggcccgaacactaatcgtgccggcagtgccactgcacacacaacactacacagcaccggactgtgccgactcggaccgatg

SEQ ID NO: 13481 - DNA, 203 bp, Homo sapiens
  source 1..203: mol_type = other DNA
ggcgcgccagtcctcttccacttaagacacttgctgtcctaacacctgctataggctatccactgcatcatctctcctgccatacttcctactcacatcatatctattttaaagaaaaaataggcccgaacactaatcgtgccggctaacttctgtgcatcacaacactacacatacaatacactacacgactcggaccgatg

SEQ ID NO: 13482 - DNA, 203 bp, Homo sapiens
  source 1..203: mol_type = other DNA
ggcgcgccagtcctgaaacccttaagacacttgctgtcctaacacctgctataggctatccactgcatcatctctcggcggtggtcatagactcacatcatatctattttaaagaaaaaataggcccgaacactaatcgtgccggcagtgccactgcacacacaacactacacatacaatacactacacgactcggaccgatg

SEQ ID NO: 13483 - DNA, 203 bp, Homo sapiens
  source 1..203: mol_type = other DNA
ggcgcgccagtcctctctctcgtaagacacttgctgtcctaacacctggcgattttaccattctgcatcatctctcctgccatacttcctactcacatcatatctattttaaagaaaaaataggcccgaacactaatcgtgccggcagtgccactgcacacacaacactacacatacaatacactacacgactcggaccgatg

SEQ ID NO: 13484 - DNA, 203 bp, Homo sapiens
  source 1..203: mol_type = other DNA
ggcgcgccagtcctaagtgctctaagatcgacaccggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcacgactcggaccgatg

SEQ ID NO: 13485 - DNA, 203 bp, Homo sapiens
  source 1..203: mol_type = other DNA
ggcgcgccagtcctacggattataagcctgagaaaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 13486 - DNA, 203 bp, Homo sapiens
  source 1..203: mol_type = other DNA
ggcgcgccagtcctagatcacctaaggataatggggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatccgactcggaccgatg

SEQ ID NO: 13487 - DNA, 203 bp, Homo sapiens
  source 1..203: mol_type = other DNA
ggcgcgccagtcctcgatgcgctaaggccaatacacgggagctggttgtgagtcaccaaggaaggcagcggcagctccactcagccagtacccagatacgctgggaaccttccccagcacccaagatttactggcagatcctcttctggagcataattagcatcatcattattctggctggagcaattcgactcggaccgatg

SEQ ID NO: 13488 - DNA, 203 bp, Homo sapiens
  source 1..203: mol_type = other DNA
ggcgcgccagtccttcccaccttaaggccaatacacgggagctggttgtgagtcaccaaggaaggcagcggcagctccactcagccagtacccagatacgctgggaaccttccccagccatggcttccctggggcagatcctcttccctgtgggctggttcatcatcattattctggctggagcaattcgactcggaccgatg

SEQ ID NO: 13489 - DNA, 203 bp, Homo sapiens
  source 1..203: mol_type = other DNA
ggcgcgccagtcctgactagggtaaggccaatacacgggagctggttgtgagtcaccaaggaaggcagcggcagctccactcagccagtacccagatacgctgggaaccttccccagccatggcttccctggtcgcagggaggacttggagcataattagcatcatcattattctggctggagcaattcgactcggaccgatg

SEQ ID NO: 13490 - DNA, 203 bp, Homo sapiens
  source 1..203: mol_type = other DNA
ggcgcgccagtcctggctcctgtaaggccaatacacgggagctggttgtgagtcaccaaggaaggcagcggcagctccactcagccagtataacctccactgacgaaccttccccagccatggcttccctggggcagatcctcttctggagcataattagcatcatcattattctggctggagcaattcgactcggaccgatg

SEQ ID NO: 13491 - DNA, 203 bp, Homo sapiens
  source 1..203: mol_type = other DNA
ggcgcgccagtcctcgtcgtcgtaaggccaatactgattgtgaaaagctgagtcaccaaggaaggcagcggcagctccactcagccagtacccagatacgctgggaaccttccccagccatggcttccctggggcagatcctcttctggagcataattagcatcatcattattctggctggagcaattcgactcggaccgatg

SEQ ID NO: 13492 - DNA, 203 bp, Homo sapiens
  source 1..203: mol_type = other DNA
ggcgcgccagtcctagtatctgtaagggggcggggcagtctctacacagctcagcatcctgacgcctcctccccttgcaggggcgtgaagctacttcagactctgctgtgacgacttggccgccaggcaccgatcctccccggtgagaaggtccacgaatcttactgcagacagatttgctcagcgcgcgactcggaccgatg

SEQ ID NO: 13493 - DNA, 203 bp, Homo sapiens
  source 1..203: mol_type = other DNA
ggcgcgccagtcctactatgactaaggtgatccacccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggcccgactcggaccgatg

SEQ ID NO: 13494 - DNA, 203 bp, Homo sapiens
  source 1..203: mol_type = other DNA
ggcgcgccagtcctatccgcgttaatagctttcaacagagcggggaaagtgcgcatgcgctgactgagtcctcccatggcttcacagaagcagatggaggtagtgaccaaaggaactgggttccggcgccgccccaagaccatcacttacaccccggggacctgcgagctgctcagaggaggagatgccgactcggaccgatg

SEQ ID NO: 13495 - DNA, 203 bp, Homo sapiens
  source 1..203: mol_type = other DNA
ggcgcgccagtcctcatcccactaatcctgttgcgtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatcgactcggaccgatg

SEQ ID NO: 13496 - DNA, 203 bp, Homo sapiens
  source 1..203: mol_type = other DNA
ggcgcgccagtcctgggtttgctaatttttgggtactctgcgtcctcgcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 13497 - DNA, 203 bp, Homo sapiens
  source 1..203: mol_type = other DNA
ggcgcgccagtcctatatcctttacacacctgtgatagctatccaagcgttttcttgacaggataagcgatactagtggttttgctgtttatgttaagtccaaagtcggtaattaccgactgccatcaacccaaaagggttctggcatggacaccgcattgttgagaaataatatctaaattttaaggcgactcggaccgatg

SEQ ID NO: 13498 - DNA, 203 bp, Homo sapiens
  source 1..203: mol_type = other DNA
ggcgcgccagtcctcgtgacgatacacacctgtgcacatataagcgtggttttcttgacaggataagcgatactagtggttttgctgtttatgttaagtccaaatagacagtacgggaactgccatcaacccaaaagggttctggcatggacaccgcattgttgagaaataatatctaaattttaaggcgactcggaccgatg

SEQ ID NO: 13499 - DNA, 203 bp, Homo sapiens
  source 1..203: mol_type = other DNA
ggcgcgccagtcctctgtttgatacacacctgtgcacatataagcgtggttttcttgacaggataagcgatactagtggttttgctgtttggtggtcactagctgtcggtaattaccgactgccatcaacccaaaagggttctggcatggacaccgcattgttgagaaataatatctaaattttaaggcgactcggaccgatg

SEQ ID NO: 13500 - DNA, 203 bp, Homo sapiens
  source 1..203: mol_type = other DNA
ggcgcgccagtcctatgttgtttacagcacagatcaggtgaggagcacaccaaggagtgattacctggggcgctgttgttttctctttcccaacaagattatcatttcctttaaaaaaaatagttatcctggggcatacagccataccattctgaaggtgtcttatctcctctgatctagagagcacccgactcggaccgatg

SEQ ID NO: 13501 - DNA, 203 bp, Homo sapiens
  source 1..203: mol_type = other DNA
ggcgcgccagtcctgccgtccttacagcacagatcaggtgaggagcacaccaaggagtgatttttaaaacttactctgttttctctttccatttctccagggggtttcctttaaaaaaaatagttatcctggggcatacagccataccattctgaaggtgtcttatctcctctgatctagagagcacccgactcggaccgatg

SEQ ID NO: 13502 - DNA, 203 bp, Homo sapiens
  source 1..203: mol_type = other DNA
ggcgcgccagtcctcaagcgattacagcacagatcaggtgaggagcacaccaaggagtgatttttaaaacttactctgttttctctttcccaacaagattatcaggctaaaagtctttaatagttatcctggggcatacagccataccattctgaaggtgtcttatctcctctgatctagagagcacccgactcggaccgatg

SEQ ID NO: 13503 - DNA, 203 bp, Homo sapiens
  source 1..203: mol_type = other DNA
ggcgcgccagtccttccacgtgtacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgtgtgtccccagtgtcgactcggaccgatg

SEQ ID NO: 13504 - DNA, 203 bp, Homo sapiens
  source 1..203: mol_type = other DNA
ggcgcgccagtcctcccttcgttacagcacagatcaggtgaggagcactaagtaagaatccatttaaaacttactctgttttctctttcccaacaagattatcatttcctttaaaaaaaatagttatcctggggcatacagccataccattctgaaggtgtcttatctcctctgatctagagagcacccgactcggaccgatg

SEQ ID NO: 13505 - DNA, 203 bp, Homo sapiens
  source 1..203: mol_type = other DNA
ggcgcgccagtcctgcctaagctacagccaacatgaaggggggaggtgctagcagggccagccttgaactcgctggacagagctacagacctatggggcctggaagtgcccgctgagaaagggagaagacagcagaggggttgccgaggtgaggggttgcctccgaggcaacctccaagtcccagatccgactcggaccgatg

SEQ ID NO: 13506 - DNA, 203 bp, Homo sapiens
  source 1..203: mol_type = other DNA
ggcgcgccagtccttgaatacgtaccaattgctattgtaaaaagtgttaaaacatcgcaaccgtttgtttcataacaaaagccttaggcatctcctatggcaggaagaagcggagacagcgacgaagagctcatcagaacagtcagactcatcaagcttctctatcaaagcagtaagtagtacatgtacgactcggaccgatg

SEQ ID NO: 13507 - DNA, 203 bp, Homo sapiens
  source 1..203: mol_type = other DNA
ggcgcgccagtcctaaccgtaataccaattgctattgtaaaaagtgttgctttcattgccaagtttgtttcataacaaaagccttaggcatctcctatggcaggaagaagcggagacagcgacgaagagctcatcagaacagtcagactcatcaagcttctctatcaaagcagtggtcgtggggcccccgactcggaccgatg

SEQ ID NO: 13508 - DNA, 203 bp, Homo sapiens
  source 1..203: mol_type = other DNA
ggcgcgccagtcctgtcgatcctacctttaaagcggggcccggagccttccctccactgccctcgaacgcctcacttcctaagtctctgcatttctcagtcagtggacagcttttgggactcttgtgtgaggactttgggggaccaggccaggctgggcctctgctgattgagatcttgggatccagacgactcggaccgatg

SEQ ID NO: 13509 - DNA, 203 bp, Homo sapiens
  source 1..203: mol_type = other DNA
ggcgcgccagtcctggcccgcttacgcattaggtcccttcggtgagcatccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgactcggaccgatg

SEQ ID NO: 13510 - DNA, 203 bp, Homo sapiens
  source 1..203: mol_type = other DNA
ggcgcgccagtcctccagtatgtacgcattaggtggtaagccgagctctccctcggccttgttctgaatgcacacaaactgttctaaatgggatgtcctacaggtacccgcacgtaaccttcagagagtgcggatctgagtaggagaccgtggtgcactgctttacagatgcagcccggtttaaaaagcgactcggaccgatg

SEQ ID NO: 13511 - DNA, 203 bp, Homo sapiens
  source 1..203: mol_type = other DNA
ggcgcgccagtcctgagtaccttacgcattaggtggtaagccgagctctccctcggccttgttctgaatgcacacatgtctaggggctaactcccaagccggcctacccgcacgtaaccttcagagagtgcggatctgagtaggagaccgtggtgcactgctttacagatgcagcccggtttaaaaagcgactcggaccgatg

SEQ ID NO: 13512 - DNA, 203 bp, Homo sapiens
  source 1..203: mol_type = other DNA
ggcgcgccagtccttccaaggctacgcattaggtggtaagccgagctctccctcggccttgttctgaatgcacacatgtctaggggctaaggatgtcctacaggtacccgcacgtaaccttcagagagtgcgatcggcgaccttgcaccgtggtgcactgctttacagatgcagcccggtttaaaaagcgactcggaccgatg

SEQ ID NO: 13513 - DNA, 203 bp, Homo sapiens
  source 1..203: mol_type = other DNA
ggcgcgccagtcctttcgcttttacgcattaggtggtaagccgagctctccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgactcggaccgatg

SEQ ID NO: 13514 - DNA, 203 bp, Homo sapiens
  source 1..203: mol_type = other DNA
ggcgcgccagtcctccaggctatacgcattaggtggtaagccgagctctccctcggccttgttctgaatgcacacatgtctaggggctaaggatgtcctacaggtacccgcacgtaaccttcagagagtgcggatctgagtaggagttgccctcatgaaactttacagatgcagcccggtttaaaaagcgactcggaccgatg

SEQ ID NO: 13515 - DNA, 203 bp, Homo sapiens
  source 1..203: mol_type = other DNA
ggcgcgccagtcctagcttccctactgatccaaaatggaagactttgtgcgacagtgcttcaatccaatgattgtcgagcttgcggaaaagacaatgaaggaatatggggaagacccgaaaattgaaacaaataagttcgctgcaatatgcacacacttagaagtctgcttcatgtattcagacttcccgactcggaccgatg

SEQ ID NO: 13516 - DNA, 203 bp, Homo sapiens
  source 1..203: mol_type = other DNA
ggcgcgccagtcctgtagcaaatactttccggtagcggtgccagggcagtggcctaatacggaactccatttcccgcatgcagggcgattggccgctgaactcagaagcgggaggccggttccggttgcatcagcgagggattcacggcgaaatgagactgttcgtgagtgatggcgtcccgggttgccgactcggaccgatg

SEQ ID NO: 13517 - DNA, 203 bp, Homo sapiens
  source 1..203: mol_type = other DNA
ggcgcgccagtcctccgcgagctactttccggtagcggtgccagggcagtggcctaatacggggggtgcaacgattgcgtgcctcgcggaggccgctgaactcagaagcgggaggccggttccggttgcatcagcgagggattcacggcgaaatgagactgttcgtgagtgatggcgtcccgggttgccgactcggaccgatg

SEQ ID NO: 13518 - DNA, 203 bp, Homo sapiens
  source 1..203: mol_type = other DNA
ggcgcgccagtccttagtgaattactttccggtagcggtgccagggcataatttagcactaaaactccatttcccggcgtgcctcgcggaggccgctgaactcagaagcgggaggccggttccggttgcatcagcgagggattcacggcgaaatgagactgttcgtgagtgatggcgtcccgggttgccgactcggaccgatg

SEQ ID NO: 13519 - DNA, 203 bp, Homo sapiens
  source 1..203: mol_type = other DNA
ggcgcgccagtcctgtagaggctagaaaccagccaggccaatgtgggaaaaaggatagcccaaaggacaagaaaacacttctcactatgaattggtttggaagtaacttcttcaggtgtcctgaggatctttccttactcaacataggggagactctgttgtcacacatgtcatctgaagatgaacatcgactcggaccgatg

SEQ ID NO: 13520 - DNA, 203 bp, Homo sapiens
  source 1..203: mol_type = other DNA
ggcgcgccagtcctcgcaagtttagaaaccagcttattgccaaagggaaaaaggatagcccaaaggacaagaaaacacttctcactatgaattggtttggaagtaacttcttcaggtgcggaagcttatgcgccttactcaacatatactcacctctgttgtcacacatgtcatctgaagatgaacatcgactcggaccgatg

SEQ ID NO: 13521 - DNA, 203 bp, Homo sapiens
  source 1..203: mol_type = other DNA
ggcgcgccagtcctagtgcaaatagaaaccagcttattgccaaagggagtctccgagctatcaaggacaagaaaacacttctcactatgaattggtttggaagtaacttcttcaggtgtcctgaggatctttccttactcaacatatactcacctctgttgtcacacatgtcatctgaagatgaacatcgactcggaccgatg

SEQ ID NO: 13522 - DNA, 203 bp, Homo sapiens
  source 1..203: mol_type = other DNA
ggcgcgccagtccttaacacgttagaacatacgggagacgaagactgagctgttttggctgcatttctggcctcgagccgcagtcagcttctccccgtagaacccggcagtaggagacttagaatcgaatctcttctccctcccgcctcctgtttttggctttttgagaaaccttatcatccaacacacgactcggaccgatg

SEQ ID NO: 13523 - DNA, 203 bp, Homo sapiens
  source 1..203: mol_type = other DNA
ggcgcgccagtcctccgcaggttagactctggtaacaactcttgaaacacagatttcccacaagtctcctcttcgtcatcaagcaaccaccgcatccagcatcaagcccacctgaaattgtctccggcttccctctggccgaacgatatcggtagttaattaaaacttagggtgcaagatcatccacacgactcggaccgatg

SEQ ID NO: 13524 - DNA, 203 bp, Homo sapiens
  source 1..203: mol_type = other DNA
ggcgcgccagtcctggaacgcctagagctgtaatgccagctggttgtggaccagccgtgacctggggcaacccagccaacctcaccgtccaatgggctgcagccacctctctccagtgaggtctgagacccagccttaacgaggctacccccttccaggtccggccgtagcacctccgcgccgtcgcccgactcggaccgatg

SEQ ID NO: 13525 - DNA, 203 bp, Homo sapiens
  source 1..203: mol_type = other DNA
ggcgcgccagtccttagatttctagattaaacataatcatgcaaaatcactattttgtactactaactcattaagaaaaacttaggatccaagagatttactctaggatctcctattacagagtatgagacatagttgagagttcaacttgcaaaactctaaccttcactctaataacaattcatccacgactcggaccgatg

SEQ ID NO: 13526 - DNA, 203 bp, Homo sapiens
  source 1..203: mol_type = other DNA
ggcgcgccagtcctatagcgtatagattaaacataatcatgcaaaatcactattttgtactactaactcattaagaaaaacttaggatccaagagatttactcttcacggaatacgatagcttagcagtcattagttgagagttcaacttgcaaaactctaaccttcactctaataacaattcatccacgactcggaccgatg

SEQ ID NO: 13527 - DNA, 203 bp, Homo sapiens
  source 1..203: mol_type = other DNA
ggcgcgccagtcctgtcgcagctagattaaacataatcatgcaaaatcgggcaagacctaagctaactcattaagaaaaacttaggatccaagagatttactctaggatctcctattaagcttagcagtcattagttgagagttcaacttgcaaaactctaaccttcactctaataacaattcatccacgactcggaccgatg

SEQ ID NO: 13528 - DNA, 203 bp, Homo sapiens
  source 1..203: mol_type = other DNA
ggcgcgccagtcctctacgatttagattcgcgaatcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagcgactcggaccgatg

SEQ ID NO: 13529 - DNA, 203 bp, Homo sapiens
  source 1..203: mol_type = other DNA
ggcgcgccagtcctgggtccgatagattctatcttccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 13530 - DNA, 203 bp, Homo sapiens
  source 1..203: mol_type = other DNA
ggcgcgccagtcctgcttaacatagccacgaggacgagaagaagggagccggaggagctggtcgctgtcggctaagcaagattggagctactcgtcgtccacctccagctcgcgtaagggtggctgtgcgactgcggccatttgtgtcacagcgtatcctagcaagtgatcccccctgtgtgcggggccgactcggaccgatg

SEQ ID NO: 13531 - DNA, 203 bp, Homo sapiens
  source 1..203: mol_type = other DNA
ggcgcgccagtcctctcgtgactagccacgaggacgagaagaagggagccggaggagctggtcgctgtcggctaagcaagattggagctatcttggtcggtatcccagctcgcgtaagggtggctgtgcgactgcggccatttgtggatggaacagcgggagcaagtgatcccccctgtgtgcggggccgactcggaccgatg

SEQ ID NO: 13532 - DNA, 203 bp, Homo sapiens
  source 1..203: mol_type = other DNA
ggcgcgccagtcctgtaactgctagccacgaggacgagaagaagggaggttccccttgcaaccgctgtcggctaagcaagattggagctactcgtcgtccacctccagctcgcgtaagggtggctgtgcgactgcggccatttgtggatggaacagcgggagcaagtgatcccccctgtgtgcggggccgactcggaccgatg

SEQ ID NO: 13533 - DNA, 203 bp, Homo sapiens
  source 1..203: mol_type = other DNA
ggcgcgccagtccttatataggtagccacgaggagcgatcaggccttaccggaggagctggtcgctgtcggctaagcaagattggagctactcgtcgtccacctccagctcgcgtaagggtggctgtgcgactgcggccatttgtggatggaacagcgggagcaagtgatcccccctgtgtgcggggccgactcggaccgatg

SEQ ID NO: 13534 - DNA, 203 bp, Homo sapiens
  source 1..203: mol_type = other DNA
ggcgcgccagtcctccgtaagatagcctccccctggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaaccgactcggaccgatg

SEQ ID NO: 13535 - DNA, 203 bp, Homo sapiens
  source 1..203: mol_type = other DNA
ggcgcgccagtcctggttgacctagcgcaggagaaggctatctcggtccccagagaagcctgcgataggtgagtttctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13536 - DNA, 203 bp, Homo sapiens
  source 1..203: mol_type = other DNA
ggcgcgccagtcctcaactgactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13537 - DNA, 203 bp, Homo sapiens
  source 1..203: mol_type = other DNA
ggcgcgccagtcctggaaagtgtagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctgattgatgttttgacgactcggaccgatg

SEQ ID NO: 13538 - DNA, 203 bp, Homo sapiens
  source 1..203: mol_type = other DNA
ggcgcgccagtcctccacaccatagcgcaggagaaggctatctcggtcgatgtttggattccgacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13539 - DNA, 203 bp, Homo sapiens
  source 1..203: mol_type = other DNA
ggcgcgccagtcctactcgctctagcgcaggagattatgtgggtccgacccagagaagcctggacccacacgcgggctagatccagagaacctgacgacccggcgacggcgacgtctcttttgactaaaagacagtgtccagtgctccagcctaggagtctacggggaccgcctcccgcgccgccacccgactcggaccgatg

SEQ ID NO: 13540 - DNA, 203 bp, Homo sapiens
  source 1..203: mol_type = other DNA
ggcgcgccagtcctgggcgatataggatctgtgggactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 13541 - DNA, 203 bp, Homo sapiens
  source 1..203: mol_type = other DNA
ggcgcgccagtcctggtatagctaggccacgtaggcccgtaagatattataactattttattatattttattcaccccccacattaatcccagttaaagctttataactataagtaagccgtgccgaaacgttaatcggtcgctagacctaatcgccgccttagtttaattttccaaaatttatttttcgactcggaccgatg

SEQ ID NO: 13542 - DNA, 203 bp, Homo sapiens
  source 1..203: mol_type = other DNA
ggcgcgccagtcctctcaattataggctacgggtaggggacgcgcatataatacttctatgaagagatgccttggatagggtaacagcggcggatattggtgagttgttaagacaaaaaccattcaacgccggaggactgactctcatccagtggatgcattgagtggattgactgtcagggctgtctcgactcggaccgatg

SEQ ID NO: 13543 - DNA, 203 bp, Homo sapiens
  source 1..203: mol_type = other DNA
ggcgcgccagtccttacgcccttaggttataatgttaggactataaaaattagcttaatgcatttagtaatttaaggcttagttatttaactttacttatcaagatggccgttggcagccccacgaaatctagattagtccgaatgtcctattttgattacccttcggcggcactcagaaactcacctcgactcggaccgatg

SEQ ID NO: 13544 - DNA, 203 bp, Homo sapiens
  source 1..203: mol_type = other DNA
ggcgcgccagtcctgtggcttatagtgtgtattacaataattaaactaattaagctttgtttcacttgccatatgttttgtaatagaacaccactcattgaacgtaaaaatgtgtaccacatttaccaatcatatatgcacatagaccctttccctaaacgagttattgatttctaaactaaacgacacgactcggaccgatg

SEQ ID NO: 13545 - DNA, 203 bp, Homo sapiens
  source 1..203: mol_type = other DNA
ggcgcgccagtcctcaattgtgtagttgaacgaatgggctccctatccggacaggtggctcttgccctttagactacagttcccagcatgcccaggcgattgcgtcccagaaccgacgtcccaccgccttcccacatcggatcgcagggctcccaaaatggcctataacattcacgtgaatggagtcccgactcggaccgatg

SEQ ID NO: 13546 - DNA, 203 bp, Homo sapiens
  source 1..203: mol_type = other DNA
ggcgcgccagtccttcgtgcggtataagatacacctgcaaaggcggcacaaccccagtgccacgttgtgagttggatagttgtggaaagaccgccgatcggacgctcaagcgtattcaacaaggggctgaaggatgcccagaaggtaccccattgtatgggatctgatctggggcctcggtgcacatgcgactcggaccgatg

SEQ ID NO: 13547 - DNA, 203 bp, Homo sapiens
  source 1..203: mol_type = other DNA
ggcgcgccagtccttgcgttagtataagatacacctgcaaaggcggcacaaccccagtgccacgttgtgagttggatagttgtggaaagagtcaaatggctctcctcaagcgtattcaacaaggggctgaagcgcctggtcccaaaaccccattgtatgggatctgatctggggcctcggtgcacatgcgactcggaccgatg

SEQ ID NO: 13548 - DNA, 203 bp, Homo sapiens
  source 1..203: mol_type = other DNA
ggcgcgccagtcctcgaggtattataagatacacctgcaaaggcggcacaaccccagtgccacgttgtgagttggatagttgtggaaagagtcaaatggctctcctcaagcgtattcaacaaggggctgaaggatgcccagaaggtaccccattgtatggctatattcgccatccctcggtgcacatgcgactcggaccgatg

SEQ ID NO: 13549 - DNA, 203 bp, Homo sapiens
  source 1..203: mol_type = other DNA
ggcgcgccagtccttccttcagtataagatacacctgcaaaggcggcacaaccccagtgccacgttgtgagttggatagttgtggaaagagtcaaatggctctcctcaagcgtattcaacaaggggctgaaggatgcccagaaggttaaaaccgcagcaagatctgatctggggcctcggtgcacatgcgactcggaccgatg

SEQ ID NO: 13550 - DNA, 203 bp, Homo sapiens
  source 1..203: mol_type = other DNA
ggcgcgccagtcctcctcaaactataagatacacctgcaaaggcggcacaaccccagtgccagacatcacaggttttagttgtggaaagagtcaaatggctctcctcaagcgtattcaacaaggggctgaaggatgcccagaaggtaccccattgtatgggatctgatctggggcctcggtgcacatgcgactcggaccgatg

SEQ ID NO: 13551 - DNA, 203 bp, Homo sapiens
  source 1..203: mol_type = other DNA
ggcgcgccagtccttccaattttataagatacactccatgctcgctttcaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgcgactcggaccgatg

SEQ ID NO: 13552 - DNA, 203 bp, Homo sapiens
  source 1..203: mol_type = other DNA
ggcgcgccagtccttctcctgatatacaattttgagaggttaataagaaggaagtagtgctatcttaataattaggttaactatttagttttactgttcaggatgcctattggcagccagccgtcgctatatacaccctctctgcttcttatatgattaggttgtcatttagaataagaaaataacctcgactcggaccgatg

SEQ ID NO: 13553 - DNA, 203 bp, Homo sapiens
  source 1..203: mol_type = other DNA
ggcgcgccagtcctacattatttatactggctgcttatggtgacaattgagagattgttaccatatagctattggattggccatccggtgaccaatagagctattatatatctctttgttgggtttataccacttagcttgaaagaggttaaaacattactcaagtccccactattgaatacagcaaacgactcggaccgatg

SEQ ID NO: 13554 - DNA, 203 bp, Homo sapiens
  source 1..203: mol_type = other DNA
ggcgcgccagtcctagaagccgtatactggctgcttatggtgacaattgagagattgttaccatatagctattggattggccatccggtgctggcatctcggcctatatatctctttgttgggtttataccacttagcttgaaagaggttaaaacattacaattcattgttaagttgaatacagcaaacgactcggaccgatg

SEQ ID NO: 13555 - DNA, 203 bp, Homo sapiens
  source 1..203: mol_type = other DNA
ggcgcgccagtcctgtactttgtatactggctgcttatggtgacaattgagagattgttacccctcgaactcctctttggccatccggtgaccaatagagctattatatatctctttgttgggtttataccacttagcttgaaagaggttaaaacattacaattcattgttaagttgaatacagcaaacgactcggaccgatg

SEQ ID NO: 13556 - DNA, 203 bp, Homo sapiens
  source 1..203: mol_type = other DNA
ggcgcgccagtcctgaacctggtatagttaaggttgcgcttgcctattgttatgcgacatcgaggatggcgcgttgcagtccaacaagatccagggactgtacagaattttcctatacctcgagtcgggtttggaatctaaggttgactcgctgtaaataatgtaaatatgaaacaaatgaatgtaaacgactcggaccgatg

SEQ ID NO: 13557 - DNA, 203 bp, Homo sapiens
  source 1..203: mol_type = other DNA
ggcgcgccagtcctgcagcctgtatagttaaggttgcgcttgcctatttaggcatacttctcaggatggcgcgttgcagtccaacaagatccagggactgtacagaattttcctatacctcgagtcgggtttccgtatatgctcaaactcgctgtaaataatgtaaatatgaaacaaatgaatgtaaacgactcggaccgatg

SEQ ID NO: 13558 - DNA, 203 bp, Homo sapiens
  source 1..203: mol_type = other DNA
ggcgcgccagtcctgtgatctctatagttaaggttgcgcttgcctatttaggcatacttctcaggatggcgcgttgcagtccaacaagatccagggactgtacagaattttcctatacctcgagtcgggtttggaatctaaggttgactcgctgtaaataatgtaaatatgaaatgctaattctacggcgactcggaccgatg

SEQ ID NO: 13559 - DNA, 203 bp, Homo sapiens
  source 1..203: mol_type = other DNA
ggcgcgccagtcctaaacatactatcagcggatgttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcacccgactcggaccgatg

SEQ ID NO: 13560 - DNA, 203 bp, Homo sapiens
  source 1..203: mol_type = other DNA
ggcgcgccagtcctgcgtgtaatatcgaaggctccggcagcggtgtccgccccacggccggcgttgccggggtaacggcgagcgcgtggggccaagaaagaatacctcctctgaaaaatggcagaagcagttttccatgccccaaagaggaaaagaagagtgtatgagacttacgagtctccattgcccgactcggaccgatg

SEQ ID NO: 13561 - DNA, 203 bp, Homo sapiens
  source 1..203: mol_type = other DNA
ggcgcgccagtccttttatcattatctggtcggtcatctctgtaacctaagcgtgtgatgtcaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 13562 - DNA, 203 bp, Homo sapiens
  source 1..203: mol_type = other DNA
ggcgcgccagtccttcagaagatatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggttcagcgccatcggttggctaacaagaacgactcggaccgatg

SEQ ID NO: 13563 - DNA, 203 bp, Homo sapiens
  source 1..203: mol_type = other DNA
ggcgcgccagtcctctgtgggctatctggtcggtcatctctgtaacctccctaccaaggactaattggtctttaaaactcctcaatgcaccgggcgcggtggctcacgcctgtaatcccagcactttgggagtgttcatgaattccatcacgaggtcaggaaatcgagaccatcttggctaacaagaacgactcggaccgatg

SEQ ID NO: 13564 - DNA, 203 bp, Homo sapiens
  source 1..203: mol_type = other DNA
ggcgcgccagtcctgcagattctatctggtcggtcatctctgtaacctccctaccaaggactttacatataagttgactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 13565 - DNA, 203 bp, Homo sapiens
  source 1..203: mol_type = other DNA
ggcgcgccagtcctatggacgctatctggtcggtgtggataccttgacccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 13566 - DNA, 203 bp, Homo sapiens
  source 1..203: mol_type = other DNA
ggcgcgccagtcctgtttccaatatgctaaggggactcgtctccacctcgtaaaggaaactccccaagggaatccctgtcccctattttcaatgtaccagcaaattccaagacagtcctagcctatagaactcctacctcccatcccctgaggtggtccccattcctccctcccttcctccccccgcccgactcggaccgatg

SEQ ID NO: 13567 - DNA, 203 bp, Homo sapiens
  source 1..203: mol_type = other DNA
ggcgcgccagtccttgcgtatctatgctaaggggactcgtctccacctcgtaaaggaaactccccaagggaatccctgtcccctattttcctatccttctacccgaagttagtttgattagcctatagaactcctacctcccatcccctgaggtggtccccattcctccctcccttcctccccccgcccgactcggaccgatg

SEQ ID NO: 13568 - DNA, 203 bp, Homo sapiens
  source 1..203: mol_type = other DNA
ggcgcgccagtcctttgctttatatgctaaggggactcgtctccacctcgtaaaggaaactccccaagggaatccctgtcccctattttcctatccttctacccttccaagacagtccatataacgccttagcctacctcccatcccctgaggtggtccccattcctccctcccttcctccccccgcccgactcggaccgatg

SEQ ID NO: 13569 - DNA, 203 bp, Homo sapiens
  source 1..203: mol_type = other DNA
ggcgcgccagtccttactaccatatgctaaggggactcgtctccacctcgtaaaggaaactccccaagggaatccctgtcccctattttcctatccttctacccttccaagacagtcctagcctatagaactcctacctcccatcccctgaggtggtcccaggcttgattgtgattcctccccccgcccgactcggaccgatg

SEQ ID NO: 13570 - DNA, 203 bp, Homo sapiens
  source 1..203: mol_type = other DNA
ggcgcgccagtcctgattagattatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccagatgggtagtcatcgactcggaccgatg

SEQ ID NO: 13571 - DNA, 203 bp, Homo sapiens
  source 1..203: mol_type = other DNA
ggcgcgccagtccttcttactttatgctaaggggactcgtctccaccttaatgcattgttatcccaagggaatccctgtcccctattttcctatccttctacccttccaagacagtcctagcctatagaactcctacctcccatcccctgaggtggtccccattcctccctcccttcctccccccgcccgactcggaccgatg

SEQ ID NO: 13572 - DNA, 203 bp, Homo sapiens
  source 1..203: mol_type = other DNA
ggcgcgccagtcctgacatatttatgtatgtatgacgcaggtcccggcatacacatatacacatattggtttttttaatcatttgagagttagttgaagataaaaacccatcacccctaaatgtattccaaagaataagaacattgttttatacatagcacacttaacaaaatcaagaaatttaacatcgactcggaccgatg

SEQ ID NO: 13573 - DNA, 203 bp, Homo sapiens
  source 1..203: mol_type = other DNA
ggcgcgccagtcctagtctacatatgtatgtatgtatgtatatgtattatacacatatacacatattggtttttttaatcatttgagagttagttgaagataaaaacccatcaccccttgcatagaatttcggaataagaacattgttttatacatagcacacttaacaaaatcaagaaatttaacatcgactcggaccgatg

SEQ ID NO: 13574 - DNA, 203 bp, Homo sapiens
  source 1..203: mol_type = other DNA
ggcgcgccagtcctataaagtttatgtatgtatgtatgtatatgtattcacacttagccacgatattggtttttttaatcatttgagagttagttgaagataaaaacccatcacccctaaatgtattccaaagaataagaacattgttttatacatagcacacttaacaaaatcaagaaatttaacatcgactcggaccgatg

SEQ ID NO: 13575 - DNA, 203 bp, Homo sapiens
  source 1..203: mol_type = other DNA
ggcgcgccagtcctaaggagcgtatgtgaggggactgtttcctcttctttagcttcttccaccagaagggcctccaggattttgacactctgctcctgagtggtgatggaaatactctctacgtgggggctcgagaagccattctggccttggatatccaggatccaggggtccccaggctaaagaaccgactcggaccgatg

SEQ ID NO: 13576 - DNA, 203 bp, Homo sapiens
  source 1..203: mol_type = other DNA
ggcgcgccagtcctggacccattatgtgaggggatgaacgtagggcaccctttcaaggtaggcagaagggcctccaggattttgacactctgctcctgagtggtgatggaaatactctctacgtgggggctcgagaagccattctggccttggatatccaggatccaggggtccccaggctaaagaaccgactcggaccgatg

SEQ ID NO: 13577 - DNA, 203 bp, Homo sapiens
  source 1..203: mol_type = other DNA
ggcgcgccagtcctgaccactctatgtgaggggatgaacgtagggcacttagcttcttccaccagaagggcctccaggattttgacactctgctcctgagtggtagcaacgcctggtcctacgtgggggctcgagaagccattctggccttggatatccaggatccaggggtccccaggctaaagaaccgactcggaccgatg

SEQ ID NO: 13578 - DNA, 203 bp, Homo sapiens
  source 1..203: mol_type = other DNA
ggcgcgccagtcctgtcattcttatgtgaggggatgaacgtagggcacttagcttcttccaccagaagggcctccaggattttgacactctgctcctgagtggtgatggaaatactctctacgtgggggctcactcgaatgcggcagccttggatatccaggatccaggggtccccaggctaaagaaccgactcggaccgatg

SEQ ID NO: 13579 - DNA, 203 bp, Homo sapiens
  source 1..203: mol_type = other DNA
ggcgcgccagtccttgcaggactatgtgaggggatgaacgtagggcacttagcttcttccacgcttctaaagatgtggattttgacactctgctcctgagtggtgatggaaatactctctacgtgggggctcgagaagccattctggccttggatatccaggatccaggggtccccaggctaaagaaccgactcggaccgatg

SEQ ID NO: 13580 - DNA, 203 bp, Homo sapiens
  source 1..203: mol_type = other DNA
ggcgcgccagtcctatccactatatgttgaatgaggtgtatcaaactaaggagaccttctaacagccaggtcataggaatataaataaaaataagaataaaattgattccatcggaagattcatttcaagaagtgatcaaatcaaagcggttggcagacctaccaatcatataccacaagactcgacacgactcggaccgatg

SEQ ID NO: 13581 - DNA, 203 bp, Homo sapiens
  source 1..203: mol_type = other DNA
ggcgcgccagtcctggaatcaatatgttgaatgaggtgtatcaaactatttgagaaggagcccagccaggtcataggaatataaataaaaataagaataaaattgattccatcggaagattcatttcaagaagtgatcaaatcaaagcggttggcagacctaccaatcatataccacaagactcgacacgactcggaccgatg

SEQ ID NO: 13582 - DNA, 203 bp, Homo sapiens
  source 1..203: mol_type = other DNA
ggcgcgccagtcctaacgcggctattcatttgatgggtaaatattttagggccgattctttggttttatagccaagataccctgttgataaagtcttgtgggaggggcggattttaaagcttattttgaagctttttaaaaaagacatccttacctgttttaactgtagattatattaacttaaatagcgactcggaccgatg

SEQ ID NO: 13583 - DNA, 203 bp, Homo sapiens
  source 1..203: mol_type = other DNA
ggcgcgccagtccttctatgcttattcgatttggcagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagacgactcggaccgatg

SEQ ID NO: 13584 - DNA, 203 bp, Homo sapiens
  source 1..203: mol_type = other DNA
ggcgcgccagtccttggagtagtattggctgcttatggtgacaatcaaaaagttgttaccatatagctattggattggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 13585 - DNA, 203 bp, Homo sapiens
  source 1..203: mol_type = other DNA
ggcgcgccagtccttttacgactattggctgcttatggtgacaatcaaaaagttgttaccatatagctattggattggccatccggtgtgcaacagggcaattgtttacctatttattggttttgtaccattgaagggtctaggattgatcactctcaaattcattttgaccctcaacacaatcaaaccgactcggaccgatg

SEQ ID NO: 13586 - DNA, 203 bp, Homo sapiens
  source 1..203: mol_type = other DNA
ggcgcgccagtcctgtcgtcaatattggctgcttatggtgacaatcaaaaagttgttaccatcctagagacatgggggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 13587 - DNA, 203 bp, Homo sapiens
  source 1..203: mol_type = other DNA
ggcgcgccagtccttttgtccctattggctgcttatggtgacaatcaattctagcggcaacaatagctattggattggccatccggtgtgcaacagggcaattgtttacctatttattggttttgtaccattatcactgaagtctgtgatcactctcaaattcattttgaccctcaacacaatcaaaccgactcggaccgatg

SEQ ID NO: 13588 - DNA, 203 bp, Homo sapiens
  source 1..203: mol_type = other DNA
ggcgcgccagtcctatacgtcttatttctcaactaacgacttgtacgttgctcttagaggactagcaaccgttatactcagcctttctagaaaggttgagttatataacggtgaatgtgtatacttgttttgtgaacacccagctgttggaatagtcaacacagatttcaaattagaaatccactaagcgactcggaccgatg

SEQ ID NO: 13589 - DNA, 203 bp, Homo sapiens
  source 1..203: mol_type = other DNA
ggcgcgccagtccttaaggaactcaacaacatcaataaaacagacatcaatccattgaatcaactgccagaccgaacaaacaaatgtccgtcagcggaaccaccaaccaatcaatcaaccaactgatccatcagcaacctgacgaaattaacaatatagtccatgttgtcctgaaagatggggcaaatcgactcggaccgatg

SEQ ID NO: 13590 - DNA, 203 bp, Homo sapiens
  source 1..203: mol_type = other DNA
ggcgcgccagtccttggcattctcaagccctccggtagagaagccaagaatgtcctgaaggtaccccgcgcgcgggatctgatcaggagaccaattggcagtgctttacgctgccactttggtttaaaaactagtgacttcctaggaaaccaagtggtcttggttttccaattttgttgactgacaatcgactcggaccgatg

SEQ ID NO: 13591 - DNA, 203 bp, Homo sapiens
  source 1..203: mol_type = other DNA
ggcgcgccagtcctactctgtttcaagccctccggtagagaagccaagaatgtcctgaaggtaccccgcgcgcgggatctgatcaggagaccaattggcagtgctttacgctgccactttggtttaaaaactgtcacagcttctccaaaccaagtggtcttggttttccaatttgaggcggaacagcgcgactcggaccgatg

SEQ ID NO: 13592 - DNA, 203 bp, Homo sapiens
  source 1..203: mol_type = other DNA
ggcgcgccagtcctcccaccgatcaagccctccggtagagaagccaagaatgtcctgaaggtaccccgcgcgcgggatctgatcaggagaccaattggcagtgctttacgctgccactttggtttaaaaactgtcacagcttctccaaaccaagtggtcttggttttccaattttgttgactgacaatcgactcggaccgatg

SEQ ID NO: 13593 - DNA, 203 bp, Homo sapiens
  source 1..203: mol_type = other DNA
ggcgcgccagtcctctcttctatcaagccctccggtagagaagccaagaatgtcctgaaggtaccccgcgcgcgggatctgatcaggagaccaattggcagtgctttacgctgccactttggtttaaaaactgtcacagcttctccttcagcgagatggctggttttccaattttgttgactgacaatcgactcggaccgatg

SEQ ID NO: 13594 - DNA, 203 bp, Homo sapiens
  source 1..203: mol_type = other DNA
ggcgcgccagtcctagacaatatcaagccctccggtagagaagccaagaatgtcctgaaggtaccccgcgcgcggggctccgcagtattcccaattggcagtgctttacgctgccactttggtttaaaaactgtcacagcttctccaaaccaagtggtcttggttttccaattttgttgactgacaatcgactcggaccgatg

SEQ ID NO: 13595 - DNA, 203 bp, Homo sapiens
  source 1..203: mol_type = other DNA
ggcgcgccagtcctgagcattgtcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagcccgactcggaccgatg

SEQ ID NO: 13596 - DNA, 203 bp, Homo sapiens
  source 1..203: mol_type = other DNA
ggcgcgccagtcctggcacggatcaatgacctgttttcttctgtaaccacaggttcggtggtgagaggaagcctcgcagaatccagcagaatcctcacagaatccagcagcagctctgctggggacatggtccatggtgcaacccatctggtgcataccgcctgacctcctgatgctcaggagaagcccgactcggaccgatg

SEQ ID NO: 13597 - DNA, 203 bp, Homo sapiens
  source 1..203: mol_type = other DNA
ggcgcgccagtcctactggttttcaatgacctgttttcttctgtaaccacaggttcggtggtgagaggaagcctcgcagaatccagcagaatcctcacagaatccagcagcagctctgctggggacatggtctcgtacaaggaagtcagcaaagccctgacctgacctcctgatgctcaggagaagcccgactcggaccgatg

SEQ ID NO: 13598 - DNA, 203 bp, Homo sapiens
  source 1..203: mol_type = other DNA
ggcgcgccagtccttgtaagagtcaatgacctgttttcttctgtaaccacaggttcggtggtgagaggaagcctcgcagaatccagcagacgttgtcgttcgaacagcagcagctctgctggggacatggtccatggtgcaacccacagcaaagccctgacctgacctcctgatgctcaggagaagcccgactcggaccgatg

SEQ ID NO: 13599 - DNA, 203 bp, Homo sapiens
  source 1..203: mol_type = other DNA
ggcgcgccagtccttaaacgcgtcacatcaccagtgtatcctcagctcctaacactgtgtctggtacacattgtttgatggttttgatgtttcagattcgttatatttcacaaacacaaggcttgccagctgaatatcttctcagtgccggaacaaaaaccttggtagcccgatacagagatcctaatcgactcggaccgatg

SEQ ID NO: 13600 - DNA, 203 bp, Homo sapiens
  source 1..203: mol_type = other DNA
ggcgcgccagtcctgtcctggctcacatcaccagtgtatcctcagctctcctacgccaacacggtacacattgtttgatggttttgatgtttcagattcgttatatttcacaaacacaaggcttgccagctgaatatcttctcagtgccggaacaaaaacaaccaggtttttcaacagagatcctaatcgactcggaccgatg

SEQ ID NO: 13601 - DNA, 203 bp, Homo sapiens
  source 1..203: mol_type = other DNA
ggcgcgccagtcctgccaagattcaccagagcggaacaagaaagagaacggccaccggggtcggctgggacagactgcgggcacgtccccttccagaggctttaactgaaaaatagaacccaggaaggtgtggacactgccagcggctgcagccgacttggaatgacctgggagacaaatacaacagccgactcggaccgatg

SEQ ID NO: 13602 - DNA, 203 bp, Homo sapiens
  source 1..203: mol_type = other DNA
ggcgcgccagtccttccaaacgtcactcccagactccttgcggagctcaaaatacctacgacggctggtcactactccgagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 13603 - DNA, 203 bp, Homo sapiens
  source 1..203: mol_type = other DNA
ggcgcgccagtcctagtagttctcactcccagactccttgcggagctcgccgcctgattctaggctggtcactactagatattcaccgactttgcggcagccaggccgtcgacgatgcccagtgaaactctctgggaaattgcaaaagctgaagtggaaaaaaggggaattaatggaagtgaaggtgacgactcggaccgatg

SEQ ID NO: 13604 - DNA, 203 bp, Homo sapiens
  source 1..203: mol_type = other DNA
ggcgcgccagtcctgttacaattcactcccagactccttgcggagctcgccgcctgattctaggctggtcactactccgagcctgtgacggccaataaccagccgccgtcgacgatgcccagtgaaactctctgggaaattgcaaaagctgaagtggaaaaaaggggaattaatggaagtgaaggtgacgactcggaccgatg

SEQ ID NO: 13605 - DNA, 203 bp, Homo sapiens
  source 1..203: mol_type = other DNA
ggcgcgccagtcctggccacggtcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 13606 - DNA, 203 bp, Homo sapiens
  source 1..203: mol_type = other DNA
ggcgcgccagtcctgggcatcatcactcccagactccttgcggagctcgccgcctgattctaggctggtcactactccgagcctgtgacgtttgcggcagccaggccgtcgacgatgcccagtgaaactctctgggaaattgcaaatcacagccatatctaaaggggaattaatggaagtgaaggtgacgactcggaccgatg

SEQ ID NO: 13607 - DNA, 203 bp, Homo sapiens
  source 1..203: mol_type = other DNA
ggcgcgccagtccttaagtctatcactctcataatcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaacccgactcggaccgatg

SEQ ID NO: 13608 - DNA, 203 bp, Homo sapiens
  source 1..203: mol_type = other DNA
ggcgcgccagtcctcacggatgtcactgctatagagaaatttgcttaagacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 13609 - DNA, 203 bp, Homo sapiens
  source 1..203: mol_type = other DNA
ggcgcgccagtccttaaagtaatcactgctatagtacgcgggtggctgactggcagataagactgctgtggctgtctcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 13610 - DNA, 203 bp, Homo sapiens
  source 1..203: mol_type = other DNA
ggcgcgccagtccttgcaccggtcactgctatagtacgcgggtggctggacctacatgcttcctgctgtggctgtctcggaacccgtggtcctccgcttcatgacagcggcgtcaaatttggcaaaaatggcaaataatgatgctgttctgaagagactggagcagaagggtgcagaggcagatcaaacgactcggaccgatg

SEQ ID NO: 13611 - DNA, 203 bp, Homo sapiens
  source 1..203: mol_type = other DNA
ggcgcgccagtcctacttgggttcactgctatagtacgcgggtggctggacctacatgcttcctgctgtggctgtctcggaacccgtggtcctccgcttcatgattttctgccgtctccatcagttgccactaaataatgatgctgttctgaagagactggagcagaagggtgcagaggcagatcaaacgactcggaccgatg

SEQ ID NO: 13612 - DNA, 203 bp, Homo sapiens
  source 1..203: mol_type = other DNA
ggcgcgccagtccttcaccgcttcactgctatagtacgcgggtggctggacctacatgcttcctgctgtggctgtctcggaacccgtggtcctccgcttcatgattttctgccgtctcttggcaaaaatggctcggcgatgacgccttctgaagagactggagcagaagggtgcagaggcagatcaaacgactcggaccgatg

SEQ ID NO: 13613 - DNA, 203 bp, Homo sapiens
  source 1..203: mol_type = other DNA
ggcgcgccagtcctcaaagcactcactgctatagtacgcgggtggctggacctacatgcttctcatgcaacacccatcggaacccgtggtcctccgcttcatgattttctgccgtctcttggcaaaaatggcaaataatgatgctgttctgaagagactggagcagaagggtgcagaggcagatcaaacgactcggaccgatg

SEQ ID NO: 13614 - DNA, 203 bp, Homo sapiens
  source 1..203: mol_type = other DNA
ggcgcgccagtcctacttatactcacttctaactgcgataaatgctgacgtgaaaacgttgcgtattgctacaacacttggttagctatttagctttactaatcaagacgccgtcgtgcagcccacaaaagtctagatacgtcacaggagagcatacgctaggtcgcgttgactatccttatatatgacgactcggaccgatg

SEQ ID NO: 13615 - DNA, 203 bp, Homo sapiens
  source 1..203: mol_type = other DNA
ggcgcgccagtcctggattatctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggttggatcgatagtcttcgactcggaccgatg

SEQ ID NO: 13616 - DNA, 203 bp, Homo sapiens
  source 1..203: mol_type = other DNA
ggcgcgccagtcctatcatccgtcagccgcccgagggcgctgcgctgagccttacactctatgattgctcctaccgactcccatgaggaagtgcgatcgggaacctcctatatacttccgtttgcctcgcggtttctttctttccgtttatcggcattgaacgcaagcatggttaacgtccctaaaaccgactcggaccgatg

SEQ ID NO: 13617 - DNA, 203 bp, Homo sapiens
  source 1..203: mol_type = other DNA
ggcgcgccagtccttcaggacgtcagccgcccgagggcgctgcgctgagccttacactctatgattgctcctaccgactcccatgaggaagtgcgatcgggaacctcctatatacttcttccgtggcgcatttttctttctttccgcgccgatagcgctcacgcaagcatggttaacgtccctaaaaccgactcggaccgatg

SEQ ID NO: 13618 - DNA, 203 bp, Homo sapiens
  source 1..203: mol_type = other DNA
ggcgcgccagtcctgataatcatcagccgcccgagggcgctgcgctgagccttacactctattgcattctactttcactcccatgaggaagtgcgatcgggaacctcctatatacttccgtttgcctcgcggtttctttctttccgcgccgatagcgctcacgcaagcatggttaacgtccctaaaaccgactcggaccgatg

SEQ ID NO: 13619 - DNA, 203 bp, Homo sapiens
  source 1..203: mol_type = other DNA
ggcgcgccagtccttcccataatcagccggcgccgcgaatgttcaagttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13620 - DNA, 203 bp, Homo sapiens
  source 1..203: mol_type = other DNA
ggcgcgccagtccttagagcgctcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13621 - DNA, 203 bp, Homo sapiens
  source 1..203: mol_type = other DNA
ggcgcgccagtcctcagtattttcagccggcgccgcgccgccgggtgttactttgccccgcctctaacctaacacccctcctgtcaccgcctgttccggctatggtcccgtccggtgttctgtaagttggcaacctaggctcctgacgcgaccctggtcctgatggcggcggcgacggccgcggcagccgactcggaccgatg

SEQ ID NO: 13622 - DNA, 203 bp, Homo sapiens
  source 1..203: mol_type = other DNA
ggcgcgccagtccttatactgttcagcgagcgcagcctgcacgcccgcctcgcgtcccgggggggtcccgcctcccaccccgcctctggacttgtctctttccccgcgcgcgcggacagagccggcgtttaggcccgagcgagcccaatttttctacctggggaagacaacgcgggcaccgattcgcccgactcggaccgatg

SEQ ID NO: 13623 - DNA, 203 bp, Homo sapiens
  source 1..203: mol_type = other DNA
ggcgcgccagtcctaagagacatcagcgagcgcagcctgcacgcccgcctcgcgtcccgggggggtcccgcctcccaccccgcctctggacttgtctctttccccgcgcgcgcggacagagccggcgtttaggcccgagcgagcccgggggccgccggccgggaagacaacgcgtagtttagagacgtcgactcggaccgatg

SEQ ID NO: 13624 - DNA, 203 bp, Homo sapiens
  source 1..203: mol_type = other DNA
ggcgcgccagtcctgtacggcctcagcgagcgcagcctgcacgcccgcctcgcgtcccgggggggtcccgcctcccaccccgcctctggacttgtctctttccccgcgcgcgcggacagagccggcgtttagtaggcctgctctatgggggccgccggccgggaagacaacgcgggcaccgattcgcccgactcggaccgatg

SEQ ID NO: 13625 - DNA, 203 bp, Homo sapiens
  source 1..203: mol_type = other DNA
ggcgcgccagtcctaattcgtttcagcgagcgcagcctgcacgcccgcctcgcgtcccgggggggtcccgcctcccttagatttgactcgcttgtctctttccccgcgcgcgcggacagagccggcgtttaggcccgagcgagcccgggggccgccggccgggaagacaacgcgggcaccgattcgcccgactcggaccgatg

SEQ ID NO: 13626 - DNA, 203 bp, Homo sapiens
  source 1..203: mol_type = other DNA
ggcgcgccagtcctagggcttttcaggccccctccgcctccacccctgccctcctcaggccccctccgcctccacccctgccctcctcaggccccctgcgtcccaaggcttcggagtccaggccccctccgcctccggctccgtcctcctctggccccctccgcccccggccccggccccacggcgggcgactcggaccgatg

SEQ ID NO: 13627 - DNA, 203 bp, Homo sapiens
  source 1..203: mol_type = other DNA
ggcgcgccagtcctagtattaatcaggccccctccgcctccacccctgccctcctcaggccccctccgcctccacccctgccctcctcaggccccctgcgtccccgcctcgtcctcctcaggccccctccgcctccggctccgtccgggcggtattgggcccgcccccggccccggccccacggcgggcgactcggaccgatg

SEQ ID NO: 13628 - DNA, 203 bp, Homo sapiens
  source 1..203: mol_type = other DNA
ggcgcgccagtcctaaagcacttcaggccccctccgcctccacccctgccctcctcaggccccctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13629 - DNA, 203 bp, Homo sapiens
  source 1..203: mol_type = other DNA
ggcgcgccagtcctctatagcctcaggccccctccgcctccacccctgccctcctcaggccccctccgcctccacccctgccctcctcaggccccctgcgtccccgcctcgtcctcctcaggccccctccgcctccggctccgtcctcctctggccccctccgcccccggccccttgttggtaagaatcgactcggaccgatg

SEQ ID NO: 13630 - DNA, 203 bp, Homo sapiens
  source 1..203: mol_type = other DNA
ggcgcgccagtcctaggaacggtcaggccccctccgcctccacccctgccctcctcaggcccgagtttgaatactgcctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13631 - DNA, 203 bp, Homo sapiens
  source 1..203: mol_type = other DNA
ggcgcgccagtcctgggagccatcaggccccctccgcctccacccctggatcgtgtgactatcctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13632 - DNA, 203 bp, Homo sapiens
  source 1..203: mol_type = other DNA
ggcgcgccagtcctagtttggctcaggccccctctttacggtaaaaccccctcctcaggccccctccgcctccacccctgccctcctcaggccccctgcgtccccgcctcgtcctcctcaggccccctccgcctccggctccgtcctcctctggccccctccgcccccggccccggccccacggcgggcgactcggaccgatg

SEQ ID NO: 13633 - DNA, 203 bp, Homo sapiens
  source 1..203: mol_type = other DNA
ggcgcgccagtcctaccggtgctcaggcggaaggagcagtcctctgaagcttgaggagcctctagaactatgagcccgaggccttcccctctcccagagcgcagaggctttgaaggctacctctgggaagccaaaacgaccgcttggctgcgggagctgaaactgcgccatcgtcactgtcggcggcccgactcggaccgatg

SEQ ID NO: 13634 - DNA, 203 bp, Homo sapiens
  source 1..203: mol_type = other DNA
ggcgcgccagtcctttagccgatcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtactccagcatttggcgactcggaccgatg

SEQ ID NO: 13635 - DNA, 203 bp, Homo sapiens
  source 1..203: mol_type = other DNA
ggcgcgccagtcctcctgggtctcaggcggaaggagcagtcctctgaagcttgaggagcctctagaactatgagcccgaggccttcccctctcccagagcgcagaggctttgaaggctacctctgggaagccgctcaccgtcggaattcaaccattgctcaactgcgccatcgtcactgtcggcggcccgactcggaccgatg

SEQ ID NO: 13636 - DNA, 203 bp, Homo sapiens
  source 1..203: mol_type = other DNA
ggcgcgccagtcctgggctccctcaggcggaaggagcagtcctctgaagcttgaggagcctctagaactatgagcccgaggccttcccctctcccagagcgcaggtcgagacggattgacctctgggaagccgctcaccgtcggaagctgcgggagctgaaactgcgccatcgtcactgtcggcggcccgactcggaccgatg

SEQ ID NO: 13637 - DNA, 203 bp, Homo sapiens
  source 1..203: mol_type = other DNA
ggcgcgccagtcctgtgtttagtcatcgtgcgtcagagtgagcccggatggggcggcgggctaataatcgagggttgctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 13638 - DNA, 203 bp, Homo sapiens
  source 1..203: mol_type = other DNA
ggcgcgccagtcctctcggccatcatcgtgcgtcagagtgagcccggatggggcggcgggcttcgggagcgcccgggctgatccgagccgagcgggccgtatctccttgtcggcgccgctgattcccggctcgtgtcgtatactgtggcagccgcgcagcttccgtgtttgctgcgcccgcactgcgacgactcggaccgatg

SEQ ID NO: 13639 - DNA, 203 bp, Homo sapiens
  source 1..203: mol_type = other DNA
ggcgcgccagtcctgggtaaggtcatcgtgcgtcagagtgagcccggatggggcggcgggcttcgggagcgcccgggctgatccgagccgagcgggccgtatctccttgtcggcgccgctgattcccggctctgcggaggcctctactactgtaacatagttccgtgtttgctgcgcccgcactgcgacgactcggaccgatg

SEQ ID NO: 13640 - DNA, 203 bp, Homo sapiens
  source 1..203: mol_type = other DNA
ggcgcgccagtcctatgagccctcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagccaggtctgcaataacgcccgcactgcgacgactcggaccgatg

SEQ ID NO: 13641 - DNA, 203 bp, Homo sapiens
  source 1..203: mol_type = other DNA
ggcgcgccagtcctcgtgtcattcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 13642 - DNA, 203 bp, Homo sapiens
  source 1..203: mol_type = other DNA
ggcgcgccagtccttccaccattcatcgtgcgtcagagtgagcccggatggggcggcgggcttcgggagcgcccgggctgatccgagccggcttatgtcctaagccttgtcggcgccgctgattcccggctctgcggaggcctctaggcagccgcgcagcttccgtgtttgctgcgcccgcactgcgacgactcggaccgatg

SEQ ID NO: 13643 - DNA, 203 bp, Homo sapiens
  source 1..203: mol_type = other DNA
ggcgcgccagtccttgaccgaatcatgggttcggtggtggtggcgcttatcaatcgaaggcggcccaccacctcccagatagagcggcggcactgtagggaagaccggggaccggtcactaccaaggacgcagacctctttttgagtatcacgcctccggaagtagttgggcaagcccacctatatgtcgactcggaccgatg

SEQ ID NO: 13644 - DNA, 203 bp, Homo sapiens
  source 1..203: mol_type = other DNA
ggcgcgccagtcctggaggcagtcatgggttcggtggtggtggcgctttaggcagcctccacgcccaccacctcccagatagagcggcggcactgtagggaagaccggggaccggtcactaccaaggacgcagacctctttttgagacgtggaggcgtacaagtagttgggcaagcccacctatatgtcgactcggaccgatg

SEQ ID NO: 13645 - DNA, 203 bp, Homo sapiens
  source 1..203: mol_type = other DNA
ggcgcgccagtcctgcgtaatttcatgggttcggtggtggtggcgctttaggcagcctccacgcccaccacctcccagatagagcggcggcactgtagggaagattctactaaccgtgctaccaaggacgcagacctctttttgagtatcacgcctccggaagtagttgggcaagcccacctatatgtcgactcggaccgatg

SEQ ID NO: 13646 - DNA, 203 bp, Homo sapiens
  source 1..203: mol_type = other DNA
ggcgcgccagtcctccgggccctcattcattcaacaaatacgaatgtgcagcggtgctggggtcatgatggctcggtgggcagcgaggggaaactttaatcaagggagcacagtgcggattctattctgaaagtcaagaagacatcatccggaatattgccaggcacctcgcccaggtcggggacagccgactcggaccgatg

SEQ ID NO: 13647 - DNA, 203 bp, Homo sapiens
  source 1..203: mol_type = other DNA
ggcgcgccagtcctttcgtctgtcattcattcaacaaatacgaatgtgcagcggtgctggggtcatgatggctcggtgggcagcgaggggccgggccggctggaggagcacagtgcggattctattctgaaagtcaagaagacatcatccggaatattgccaggcacctcgccccatcttaacctcttcgactcggaccgatg

SEQ ID NO: 13648 - DNA, 203 bp, Homo sapiens
  source 1..203: mol_type = other DNA
ggcgcgccagtccttatcatagtcattcattcaagcctactaggctaccagcggtgctggggtcatgatggctcggtgggcagcgaggggccgggccggctggaggagcacagtgcggattctattctgaaagtcaagaagacatcatccggaatattgccaggcacctcgcccaggtcggggacagccgactcggaccgatg

SEQ ID NO: 13649 - DNA, 203 bp, Homo sapiens
  source 1..203: mol_type = other DNA
ggcgcgccagtcctgtgtgctatccacaggcctatgctgtgatatctggggctcctgctgctatagctggatttgcagctttactgcaaactgtgactggtgtgagcgctgttgctcaagtggggtatagatcaaccttatcggatgatcacaaagtttctactgttggtttatatcaacaaccaggacgactcggaccgatg

SEQ ID NO: 13650 - DNA, 203 bp, Homo sapiens
  source 1..203: mol_type = other DNA
ggcgcgccagtcctacttaatgtccacaggcctatgctgtgatatctggggctcctgctgctatagctggatttgcagctttactgcaaactgtgactggtgtgagcgctgttgctcaagtggggtatagattttttagtgactgggatcacaaagtttctactgttggtttatcatccgtgtatccgcgactcggaccgatg

SEQ ID NO: 13651 - DNA, 203 bp, Homo sapiens
  source 1..203: mol_type = other DNA
ggcgcgccagtcctgcatgtcgtccacaggcctatgctgtgatatctggggctcctgctgctccctaatccgactgagctttactgcaaactgtgactggtgtgagcgctgttgctcaagtggggtatagattttttagtgactgggatcacaaagtttctactgttggtttatatcaacaaccaggacgactcggaccgatg

SEQ ID NO: 13652 - DNA, 203 bp, Homo sapiens
  source 1..203: mol_type = other DNA
ggcgcgccagtcctatctaacatccagacccacccctgggcggaactcctcggccaggtcctggagtcccgtaacacccttcccctggagccatgctgggccctagcccgggtccctcgccgggctccgcccacagcatgatggggcccagcccagggccgccctcagcaggacaccccatccccacccgactcggaccgatg

SEQ ID NO: 13653 - DNA, 203 bp, Homo sapiens
  source 1..203: mol_type = other DNA
ggcgcgccagtcctttcgcgcgtccagacccacccctgggcggaactcctcggccaggtccttccccgggccctggcccttcccctggagccatgctgggccctagcccgggtccctcgccgggctccgcccacagcatgatggggaaggttatgtttttgccctcagcaggacaccccatccccacccgactcggaccgatg

SEQ ID NO: 13654 - DNA, 203 bp, Homo sapiens
  source 1..203: mol_type = other DNA
ggcgcgccagtcctaactcctatccagacccacccctgggcggaactcctcggccaggtccttccccgggccctggcccttcccctggagccatgctgggccctagcccgggtccctcgccgggctccgcccacagcatgatggggcccagcccagggcctagacagcagtcgaaccccatccccacccgactcggaccgatg

SEQ ID NO: 13655 - DNA, 203 bp, Homo sapiens
  source 1..203: mol_type = other DNA
ggcgcgccagtccttattaagttccagacccacccctgggcggaactcctcggccaggtccttccccgggccctggcccttcccctggagccatgctgggccctagcccgggtccctcttgtcaggggcgttacagcatgatggggcccagcccagggccgccctcagcaggacaccccatccccacccgactcggaccgatg

SEQ ID NO: 13656 - DNA, 203 bp, Homo sapiens
  source 1..203: mol_type = other DNA
ggcgcgccagtcctcgataacgtccagacccacccctgggcggaactcctcggccaggtccttccccgggccctgggagacaagagacgtccatgctgggccctagcccgggtccctcgccgggctccgcccacagcatgatggggcccagcccagggccgccctcagcaggacaccccatccccacccgactcggaccgatg

SEQ ID NO: 13657 - DNA, 203 bp, Homo sapiens
  source 1..203: mol_type = other DNA
ggcgcgccagtcctattggacctccatgatttttcatcatagtggaaagctgttctctgtgttaaaccaatcagttgcgaccttctcttaacagtgtgaagtgagggggtctctctccctccttctccttcctctgtgattcaccttcctttttaccctgccctgcggcggctccgccccttaccttccgactcggaccgatg

SEQ ID NO: 13658 - DNA, 203 bp, Homo sapiens
  source 1..203: mol_type = other DNA
ggcgcgccagtcctaacattggtccatgattttttgaatctagactgggctgttctctgtgtagccgtcccatccggcgaccttctcttaacagtgtgaagtgagggggtctctctccctccttctccttcctctgtgattcaccttcctttttaccctgccctgcggcggctccgccccttaccttccgactcggaccgatg

SEQ ID NO: 13659 - DNA, 203 bp, Homo sapiens
  source 1..203: mol_type = other DNA
ggcgcgccagtccttgttgtaatccatgattttttgaatctagactgggctgttctctgtgttaaaccaatcagttaattgtcaagtgacacagtgtgaagtgagggggtctctctccctccttctccttcctctgtgattcaccttcctttttaccctgccctgcggcggctccgccccttaccttccgactcggaccgatg

SEQ ID NO: 13660 - DNA, 203 bp, Homo sapiens
  source 1..203: mol_type = other DNA
ggcgcgccagtcctggtttcggtccatgattttttgaatctagactgggctgttctctgtgttaaaccaatcagttgcgaccttctcttaacagtgtgaagtgaaatccggaaggaaactccttctccttcctctgtgattcaccttcctttttaccctgccctgcggcggctccgccccttaccttccgactcggaccgatg

SEQ ID NO: 13661 - DNA, 203 bp, Homo sapiens
  source 1..203: mol_type = other DNA
ggcgcgccagtcctttattcggtccatgattttttgaatctagactgggctgttctctgtgttaaaccaatcagttgcgaccttctcttaacagtgtgaagtgagggggtctctctccctccttctccttccgagagaggcggaggtcctttttaccctgccctgcggcggctccgccccttaccttccgactcggaccgatg

SEQ ID NO: 13662 - DNA, 203 bp, Homo sapiens
  source 1..203: mol_type = other DNA
ggcgcgccagtccttgttcgcatccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttccgactcggaccgatg

SEQ ID NO: 13663 - DNA, 203 bp, Homo sapiens
  source 1..203: mol_type = other DNA
ggcgcgccagtccttcgagagatccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctctaatagcgcgggggcgactcggaccgatg

SEQ ID NO: 13664 - DNA, 203 bp, Homo sapiens
  source 1..203: mol_type = other DNA
ggcgcgccagtcctgctacggttccatgattttttgaatctagactgggctgttctctgtgttaaaccaatcagttgcgaccttctcttaacagtgtgaagtgagggggtctctctccctccttctccttcctctgtgattcaccttcctttttaccctggggcaacttcataacgccccttaccttccgactcggaccgatg

SEQ ID NO: 13665 - DNA, 203 bp, Homo sapiens
  source 1..203: mol_type = other DNA
ggcgcgccagtccttcattccttcccaactgctagtggctgagtccctggcggggcgcggcggtggaaggtgtcgcgtacgggcttcccgagctgacgtggcttcgcgacttgcttctgcagctggagcctcaggcggcagcgcttctagaaatgctgagccgattatcaggattagcaaatgttgttcgactcggaccgatg

SEQ ID NO: 13666 - DNA, 203 bp, Homo sapiens
  source 1..203: mol_type = other DNA
ggcgcgccagtcctgtaaaccgtcccaactgctagtggctgagtccctggcggggcgcggcggtggaaggtgtcgcgtacgggcttcccgagctgacgtggcttgaattgggaggggggcagctggagcctcaggcggcagcgcttaggatccattgcttccgattatcaggattagcaaatgttgttcgactcggaccgatg

SEQ ID NO: 13667 - DNA, 203 bp, Homo sapiens
  source 1..203: mol_type = other DNA
ggcgcgccagtcctcgttgctgtcccaactgctagtggctgagtccctggcggggcgcggcggtggaaggtgtcgcgtacgggcttcccgagctgacgtggcttgaattgggaggggggcagctggagcctcgctttcagcgtggcctagaaatgctgagccgattatcaggattagcaaatgttgttcgactcggaccgatg

SEQ ID NO: 13668 - DNA, 203 bp, Homo sapiens
  source 1..203: mol_type = other DNA
ggcgcgccagtcctgagcggcatcccgtcggagtccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 13669 - DNA, 203 bp, Homo sapiens
  source 1..203: mol_type = other DNA
ggcgcgccagtcctggcatgtctccctagagcagacagtcaattgtagagcctgcactctcagaaatcagacttgagtggccggaacccttgagaccagaggcttaccatgctgctccctaggagggccaggaactgctgacgtgaccactggacagttattcgtgtctcttacaattaccaaacagacgactcggaccgatg

SEQ ID NO: 13670 - DNA, 203 bp, Homo sapiens
  source 1..203: mol_type = other DNA
ggcgcgccagtccttgcgagtatccctagagcaggggtgtttgccagcagcctgcactctcagaaatcagacttgagtggccggaacccttgagaccagaggctacattgaaatacagctaggagggccaggaactgctgacgtgaccactggacagttattcgtgtctcttacaattaccaaacagacgactcggaccgatg

SEQ ID NO: 13671 - DNA, 203 bp, Homo sapiens
  source 1..203: mol_type = other DNA
ggcgcgccagtcctagtcatcttccctagcttgactctcaacaaaaagccaccgacattaagagagagagtattgctgcttagttaactgcaggccctatttagggttaccgcccaggatctgcaacagcattcctgtatcatccagggcaccggtggacttggtgaggattgagttgacctcatcatcgactcggaccgatg

SEQ ID NO: 13672 - DNA, 203 bp, Homo sapiens
  source 1..203: mol_type = other DNA
ggcgcgccagtcctaaccagattccctctccttacctgcgtcctcgggggcgtgcgcaccaccccccctcccgcctaggaggggggagggccccctcttggccaatcgtcggctacgatttaaactcccctggagactgcggctactgccaccgccttgcctccactgcctcttcgcgcagcacacagcgactcggaccgatg

SEQ ID NO: 13673 - DNA, 203 bp, Homo sapiens
  source 1..203: mol_type = other DNA
ggcgcgccagtcctattccttctccctctccttacctgcgtcctcgggggcgtgcgcaccaccccccctcccgcctaggaggggggagggccccctcttggccaccgccttcgcggcctttaaactcccctgctatactgttactatgccaccgccttgcctccactgcctcttcgcgcagcacacagcgactcggaccgatg

SEQ ID NO: 13674 - DNA, 203 bp, Homo sapiens
  source 1..203: mol_type = other DNA
ggcgcgccagtcctgttgcctctccctctccttacctgcgtcctcgggggcgtgcgcaccaccccccctcccgcctaggaggggggagggccccctcttggccaccgccttcgcggcctttaaactcccctggagactgcggcagtaagtaccgccttgcctccactgcctcttcgcgcagcacacagcgactcggaccgatg

SEQ ID NO: 13675 - DNA, 203 bp, Homo sapiens
  source 1..203: mol_type = other DNA
ggcgcgccagtcctatgcattttccctctccttacctgcgtcctcgggggcgtgcgcaccaccccccctcccgcctaggaggggggagggccccctcttggccaccgccttcgcggcctttatgaggggctggagactgcggcagtaagtaccgccttgcctccactgcctcttcgcgcagcacacagcgactcggaccgatg

SEQ ID NO: 13676 - DNA, 203 bp, Homo sapiens
  source 1..203: mol_type = other DNA
ggcgcgccagtcctttcggcactccctctccttacctgcgtcctcgggggcgtgcgcaccaccccccctcccgcctaggaggggggagggccccctcttggccaccgccttcgcggcctttatgaggggctggagactgcggctactgccaccgccttgcctccactgcctcttcgcgcagcacacagcgactcggaccgatg

SEQ ID NO: 13677 - DNA, 203 bp, Homo sapiens
  source 1..203: mol_type = other DNA
ggcgcgccagtcctcattctcatccctctccttacctgcgtcctcgggggcgtgcgcaccaccccccctcccgcctaggaggggggagggtaaagaaccatgacccgccttcgcggcctttaaactcccctggagactgcggctactgccaccgccttgcctccactgcctcttcgcgcagcacacagcgactcggaccgatg

SEQ ID NO: 13678 - DNA, 203 bp, Homo sapiens
  source 1..203: mol_type = other DNA
ggcgcgccagtccttgtaattatccctctccttacctgcgtcctcgggggcgtgcgcaccaccccccctcccgccttcatctatactttcccccctcttggccaccgccttcgcggcctttaaactcccctggagactgcggctactgccaccgccttgcctccactgcctcttcgcgcagcacacagcgactcggaccgatg

SEQ ID NO: 13679 - DNA, 203 bp, Homo sapiens
  source 1..203: mol_type = other DNA
ggcgcgccagtcctcacagttctccctctccttacctgcgtcctcgggggcgtgcgcaccacgattggagaataaaaggaggggggagggccccctcttggccaccgccttcgcggcctttaaactcccctggagactgcggctactgccaccgccttgcctccactgcctcttcgcgcagcacacagcgactcggaccgatg

SEQ ID NO: 13680 - DNA, 203 bp, Homo sapiens
  source 1..203: mol_type = other DNA
ggcgcgccagtcctacatctgctccctctccttagggagacaagatcaggcgtgcgcaccaccccccctcccgcctaggaggggggagggccccctcttggccaccgccttcgcggcctttaaactcccctggagactgcggctactgccaccgccttgcctccactgcctcttcgcgcagcacacagcgactcggaccgatg

SEQ ID NO: 13681 - DNA, 203 bp, Homo sapiens
  source 1..203: mol_type = other DNA
ggcgcgccagtcctatgcttggtcccttacacatatgattatgtagcgtgcttattagtagtagatacatctaaatgtacaggacttaggataagttttgattatataagataggatgtgaaggctccgatttgtgaataggtttttatattcgaagtaggtagtattgcgcatactattaattccaccgactcggaccgatg

SEQ ID NO: 13682 - DNA, 203 bp, Homo sapiens
  source 1..203: mol_type = other DNA
ggcgcgccagtcctgggcgcgttcccttacacatatgattatgtagcgtgcttattagtagtagatacatctaaattctacaacgacctaataagttttgattatataagataggatgtgaaggctccgatttgtgaataggttttggccaatcctcggcgtagtattgcgcatactattaattccaccgactcggaccgatg

SEQ ID NO: 13683 - DNA, 203 bp, Homo sapiens
  source 1..203: mol_type = other DNA
ggcgcgccagtcctcgtacgattccgacctgggaccgacaatagacttgagcaatgtttgctgtcttccattggagtgactgaatttctacatgacggctttttgacaagacttaaaacctgtcttggatagagaatatttagccatttacctaaaaatggtattttttacatgcaatgcatgtggtgcgactcggaccgatg

SEQ ID NO: 13684 - DNA, 203 bp, Homo sapiens
  source 1..203: mol_type = other DNA
ggcgcgccagtcctgcagtgagtccgacctgggaggctggggctcagagagcaatgtttgctgtcttccattggagatgaatctaccgcgcatgacggctttttgacaagacttaaaacctgtcttggatagagaatatttagccatttacctaaaaatggtattttttacatgcaatgcatgtggtgcgactcggaccgatg

SEQ ID NO: 13685 - DNA, 203 bp, Homo sapiens
  source 1..203: mol_type = other DNA
ggcgcgccagtcctaacctccttccgatggcaatccaagcccttcacaagtctatacaacatccgagtacctatcacaacctccatctccatccaacacaacaaaccagtagtcattaaaaagcgtattatttaccctgcgtccctccaaatcaaccagaatcaaaatcaactctggggcaaataacacgactcggaccgatg

SEQ ID NO: 13686 - DNA, 203 bp, Homo sapiens
  source 1..203: mol_type = other DNA
ggcgcgccagtcctattaggggtccggactcttcccgcaacccctccgagaggtccggtattcgcctcgaggcggcggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 13687 - DNA, 203 bp, Homo sapiens
  source 1..203: mol_type = other DNA
ggcgcgccagtcctagatatcatccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 13688 - DNA, 203 bp, Homo sapiens
  source 1..203: mol_type = other DNA
ggcgcgccagtcctgctgagactccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgccctgcgtcggtaacggcgactcggaccgatg

SEQ ID NO: 13689 - DNA, 203 bp, Homo sapiens
  source 1..203: mol_type = other DNA
ggcgcgccagtcctttcagccttccggactcttcccgcaacccctccggctccctttccgcacgcctcgaggcggcggcggccaccgagacagcagcgcaccttcccccatcccttccccttatcccccagcccaaaagggcccggtctgcgccccacccgaagtacaggataagctacgccgccgcccgactcggaccgatg

SEQ ID NO: 13690 - DNA, 203 bp, Homo sapiens
  source 1..203: mol_type = other DNA
ggcgcgccagtcctcgcctacttccggactcttcccgcaacccctccggctccctttccgcacgcctcgaggcggcggcggccaccgagacagcagcgcaccttcccccatcccttccccttatcccccagctgttgccccataattctgcgccccacccccgcccgtccgcccgctacgccgccgcccgactcggaccgatg

SEQ ID NO: 13691 - DNA, 203 bp, Homo sapiens
  source 1..203: mol_type = other DNA
ggcgcgccagtcctttcaaagttccggactcttcccgcaacccctccggctccctttccgcacgcctcgaggcggcggcggccaccgagagtttctacggttaacccccatcccttccccttatcccccagcccaaaagggcccggtctgcgccccacccccgcccgtccgcccgctacgccgccgcccgactcggaccgatg

SEQ ID NO: 13692 - DNA, 203 bp, Homo sapiens
  source 1..203: mol_type = other DNA
ggcgcgccagtcctttggttgctccggactcttcccgcaacccctccggctccctttccgcatcaaggtctcgaaaggcggccaccgagacagcagcgcaccttcccccatcccttccccttatcccccagcccaaaagggcccggtctgcgccccacccccgcccgtccgcccgctacgccgccgcccgactcggaccgatg

SEQ ID NO: 13693 - DNA, 203 bp, Homo sapiens
  source 1..203: mol_type = other DNA
ggcgcgccagtcctgcaccagttccgttgattagcctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagcgactcggaccgatg

SEQ ID NO: 13694 - DNA, 203 bp, Homo sapiens
  source 1..203: mol_type = other DNA
ggcgcgccagtcctgacatcgatcctaagtggtcgactcaaccgttaccagtgtctctgagcttctggcaagtatgaggcaaggatttcacagaagaacttggagcaaaaattcccactgtcatagctataggctgtccagtcttgagggagctgcaggaacaggaaaaagagaccttcagagaagaccgactcggaccgatg

SEQ ID NO: 13695 - DNA, 203 bp, Homo sapiens
  source 1..203: mol_type = other DNA
ggcgcgccagtcctctgaggcttcctaagtggtctggaacctaacctgcagtgtctctgagcttctggcaagtatgaggcaaggatttcacagaagaacttggagcaaaaattcccactgtcatagctataggctgtccagtcttgcttccaaccgcattacaggaaaaagagaccttcagagaagaccgactcggaccgatg

SEQ ID NO: 13696 - DNA, 203 bp, Homo sapiens
  source 1..203: mol_type = other DNA
ggcgcgccagtcctccctcaagtcctcaaggtttagagacacacggtcactgcagctgaagccgctgcccctgctacagatgaagaaaaggaggctgggagagccaaggatcacgcagcaaggaagaaacagacccaggtgcagactcaggcaccaccaggaccagctgatcattccagcccacagcacgactcggaccgatg

SEQ ID NO: 13697 - DNA, 203 bp, Homo sapiens
  source 1..203: mol_type = other DNA
ggcgcgccagtccttcccgaggtcctcagacccggcccggtcttcgcgcccggactcctggcatgccgtggttcaccactcaccgctctgacgggtgcagacgcgggagttgtcccagactgtggagtggcgggcacggccccagccccccttcccttccctgaccccttcttgccatcgccccagaccgactcggaccgatg

SEQ ID NO: 13698 - DNA, 203 bp, Homo sapiens
  source 1..203: mol_type = other DNA
ggcgcgccagtccttctgcatttcctcagacccggcccggtcttcgcgcccggactcctggcgccagcgctaggcgcactcaccgctctgacgggtgcagacgcgggagttgtcccagactgtggagtggcgaagtgccagttttacccccttcccttccctgaccccttcttgccatcgccccagaccgactcggaccgatg

SEQ ID NO: 13699 - DNA, 203 bp, Homo sapiens
  source 1..203: mol_type = other DNA
ggcgcgccagtccttggcgccgtcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagaccgactcggaccgatg

SEQ ID NO: 13700 - DNA, 203 bp, Homo sapiens
  source 1..203: mol_type = other DNA
ggcgcgccagtcctaatccgagtcctcagacccggcccggtcttcgcgcccggactcctggcgccagcgctaggcgcactcaccgctctgacgggtgcagacgcgggagttgtcccagactgtggagtggcgggcacggccccagccccccttcccttccgaattgggaagagaccatcgccccagaccgactcggaccgatg

SEQ ID NO: 13701 - DNA, 203 bp, Homo sapiens
  source 1..203: mol_type = other DNA
ggcgcgccagtcctcggcagcgtcctcagacccggcccggtcttcgcgcccggactcctggcgccagcgctaggcgcactcaccgctctgacgggtgcagacgcgggagttgtcccagactgtggagtggcgggcacggccccagcgtagagggtaacagctgaccccttcttgccatcgccccagaccgactcggaccgatg

SEQ ID NO: 13702 - DNA, 203 bp, Homo sapiens
  source 1..203: mol_type = other DNA
ggcgcgccagtcctgtacgtaatcctcagacccggcccggtcttcgcgcccggactcctggcgccagcgctaggcgcactcaccgctctgacgggtgcagacgcgggagttgtcccagggatcatccccaatggcacggccccagccccccttcccttccctgaccccttcttgccatcgccccagaccgactcggaccgatg

SEQ ID NO: 13703 - DNA, 203 bp, Homo sapiens
  source 1..203: mol_type = other DNA
ggcgcgccagtcctgttcatactcctcagacccggcccggtcttcgcgcccggactcctggcgccagcgctaggcgcactcaccgctctgcacttgaattttatgggagttgtcccagactgtggagtggcgggcacggccccagccccccttcccttccctgaccccttcttgccatcgccccagaccgactcggaccgatg

SEQ ID NO: 13704 - DNA, 203 bp, Homo sapiens
  source 1..203: mol_type = other DNA
ggcgcgccagtcctcaaccacctcctcagacccggcccggtcttcgcggggtccactgcatggccagcgctaggcgcactcaccgctctgacgggtgcagacgcgggagttgtcccagactgtggagtggcgggcacggccccagccccccttcccttccctgaccccttcttgccatcgccccagaccgactcggaccgatg

SEQ ID NO: 13705 - DNA, 203 bp, Homo sapiens
  source 1..203: mol_type = other DNA
ggcgcgccagtcctccttagagtcctggctgcggggcgagccgggcgtctgctgcagcggccgcggtggctgaggaggcccgagaggagtcggtggcagcggcggcggcgggaccggcagcagcagcagcagcagcagcagcagcaaccactagcctcctgccccgcggcgctgccgcacgagccccacgactcggaccgatg

SEQ ID NO: 13706 - DNA, 203 bp, Homo sapiens
  source 1..203: mol_type = other DNA
ggcgcgccagtcctcactttcctcctggctgcggggcgagccgggcgtctgctgcagcggccgcggtggctgaggaggcccgagaggagtcggtggcagcggcggcggcgggaccggcccttaatatttttccagcagcagcagcaaccactagcctcctgccccgcggcgctgccgcacgagccccacgactcggaccgatg

SEQ ID NO: 13707 - DNA, 203 bp, Homo sapiens
  source 1..203: mol_type = other DNA
ggcgcgccagtcctctggaaggtccttgaacttttggccgccatgtgcttcccgaaggtcctactgctcacgcaacagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 13708 - DNA, 203 bp, Homo sapiens
  source 1..203: mol_type = other DNA
ggcgcgccagtcctgaagaaggtccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 13709 - DNA, 203 bp, Homo sapiens
  source 1..203: mol_type = other DNA
ggcgcgccagtccttggacccttcgcaagctcttaaatttgacaatggatgaaaaagtctttgttttgaaagattttatcagaagacaagtgcctgacatacctgaactgtcttatcagaaggaggcattactttctcaagtcgaagtaccaatggtcttaacagagggcttcaagctcctatcatgccgactcggaccgatg

SEQ ID NO: 13710 - DNA, 203 bp, Homo sapiens
  source 1..203: mol_type = other DNA
ggcgcgccagtcctgtcgggagtcgcactttcaaaaggaacaagatatgtgctgaagtccagataacagccaagcaacctgaccaagaactaccaactctattctatagactaaaaagtcgccattttagttatataaaaatcaagttagaataagaattaaatcaatcaagaacgggacaaataaaacgactcggaccgatg

SEQ ID NO: 13711 - DNA, 203 bp, Homo sapiens
  source 1..203: mol_type = other DNA
ggcgcgccagtcctcgaaaggatcgccgccacctccgcctcttcagtctcctggtcttcgtcctgctcgcgctgaccacctctcagggaaagggggggacataggggcgtcgcggggccccggcgaatgcgccccccgccgcctctcgggctgcgccgcctcgcggggatgaagcaccggccgtgaagcgactcggaccgatg

SEQ ID NO: 13712 - DNA, 203 bp, Homo sapiens
  source 1..203: mol_type = other DNA
ggcgcgccagtccttgtccggttcgccgccacctccgcctcttcagtctcctggtcttcgtcgccgctctctctctcacctctcagggaaagggggggacatagacagtcaagtacctcccggcgaatgcgccccccgccgcctctcgggctgcgccgcctcgcggggatgaagcaccggccgtgaagcgactcggaccgatg

SEQ ID NO: 13713 - DNA, 203 bp, Homo sapiens
  source 1..203: mol_type = other DNA
ggcgcgccagtcctggcgcatttcgccgccacctccgcctcttcagtctcctggtcttcgtcgccgctctctctctcacctctcagggaaagggggggacataggggcgtcgcggggccccggcgaatgcgccccccgccgcctctaaaatacacgtatttcgcggggatgaagcaccggccgtgaagcgactcggaccgatg

SEQ ID NO: 13714 - DNA, 203 bp, Homo sapiens
  source 1..203: mol_type = other DNA
ggcgcgccagtcctccctgccgtcgccgccacctccgcctcttcagtctcctggtcttcgtcgccgctctctctctgcaacactcttatgagggggggacataggggcgtcgcggggccccggcgaatgcgccccccgccgcctctcgggctgcgccgcctcgcggggatgaagcaccggccgtgaagcgactcggaccgatg

SEQ ID NO: 13715 - DNA, 203 bp, Homo sapiens
  source 1..203: mol_type = other DNA
ggcgcgccagtcctcttagttttcgcgcttcccctccctccggggctgggcctgccccggccgtcgcggagcctcccctcccaccgtccgtgagtgtacgcgcccggccgccgcctccaggcagcccggagcaacccggcgcccggccccgctgggcgcagcactccgtcggcgttattacacctaatcgactcggaccgatg

SEQ ID NO: 13716 - DNA, 203 bp, Homo sapiens
  source 1..203: mol_type = other DNA
ggcgcgccagtcctgggttgcgtcgcgcttcccctccctccggggctgggcctgccccggccgtcgcggagcctcccctcccaccgtccgtgagtgtacgcgcccggccgccgcctccaggcagcccggagccgtatccgtatgatccccgctgggcgcagcactccgtcggcggcggcggcggcgcgcgactcggaccgatg

SEQ ID NO: 13717 - DNA, 203 bp, Homo sapiens
  source 1..203: mol_type = other DNA
ggcgcgccagtcctgctagtattcggattaatactggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 13718 - DNA, 203 bp, Homo sapiens
  source 1..203: mol_type = other DNA
ggcgcgccagtcctgagacgaatcgtcacatcgtggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 13719 - DNA, 203 bp, Homo sapiens
  source 1..203: mol_type = other DNA
ggcgcgccagtcctggacttgatcgtccgcctaaacggttcgagagttaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 13720 - DNA, 203 bp, Homo sapiens
  source 1..203: mol_type = other DNA
ggcgcgccagtcctaagcctcgtcgtccgcctaataccgcgcctgcgcaccgcgtctcttccggctgttcaagattcctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 13721 - DNA, 203 bp, Homo sapiens
  source 1..203: mol_type = other DNA
ggcgcgccagtcctcgtagggctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccgaccgggatattgtgaaattgaaatcagccgactcggaccgatg

SEQ ID NO: 13722 - DNA, 203 bp, Homo sapiens
  source 1..203: mol_type = other DNA
ggcgcgccagtcctgttggcattcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagagtgaaatgtggcttcgactcggaccgatg

SEQ ID NO: 13723 - DNA, 203 bp, Homo sapiens
  source 1..203: mol_type = other DNA
ggcgcgccagtcctagtgaatttcgtccgcctaataccgcgcctgcgcaccgcgtctcttcctttctgggctcggacctaggtcgcggcgacatggccaaacgtaccaagaaagtcgggatcgtcggtaaatcgtcacgagcgagcggggcctccctccggaaaatggtgaagaaaattgaaatcagccgactcggaccgatg

SEQ ID NO: 13724 - DNA, 203 bp, Homo sapiens
  source 1..203: mol_type = other DNA
ggcgcgccagtccttccgcgaatcgtccgcctaataccgcgcctgcgcaccgcgtctcttcctttctgggctcggagtccaacgagacttacatggccaaacgtaccaagaaagtcgggatcgtcggtaaatacgggacccgctatggggcctccctccggaaaatggtgaagaaaattgaaatcagccgactcggaccgatg

SEQ ID NO: 13725 - DNA, 203 bp, Homo sapiens
  source 1..203: mol_type = other DNA
ggcgcgccagtcctacagccaatcgtccgcctaataccgcgcctgcgccataacctcgcctatttctgggctcggacctaggtcgcggcgacatggccaaacgtaccaagaaagtcgggatcgtcggtaaatacgggacccgctatggggcctccctccggaaaatggtgaagaaaattgaaatcagccgactcggaccgatg

SEQ ID NO: 13726 - DNA, 203 bp, Homo sapiens
  source 1..203: mol_type = other DNA
ggcgcgccagtccttgagtgattcgttagtcagagtgggcggagccgcccgcgggcacctgctatagctcttccatccgcgtcgctgaggggtagcgatgcgggctccggggatgaggtcgcggccggcgggtcccgcgctgttgctgctgctgctcttcctcggagcggccgagtcggtgcgtcgggcgactcggaccgatg

SEQ ID NO: 13727 - DNA, 203 bp, Homo sapiens
  source 1..203: mol_type = other DNA
ggcgcgccagtccttaaacaattcgttgaactacatgttgtaaggctttagagaaataagggagtgtcctatttaggatgaggtgctccggtggcagccccaccaaaacctctagcgactaggaacagctatatcgggttgctatagcagtcaggatgtcgcgtaaatcggtgtaaatacccaaacctcgactcggaccgatg

SEQ ID NO: 13728 - DNA, 203 bp, Homo sapiens
  source 1..203: mol_type = other DNA
ggcgcgccagtcctaagaaatttcgttgaactacatgttgtaaggctttagagaaataagggagtgtcctatttaggatgaggtgctccggtggcagccccaccaaaacctctagcgactaggaacagctatgagcctggctgcgtgcagtcaggatgtcattctggcgttccgaaatacccaaacctcgactcggaccgatg

SEQ ID NO: 13729 - DNA, 203 bp, Homo sapiens
  source 1..203: mol_type = other DNA
ggcgcgccagtcctggagtagttcgttgaactactatcgaacgcctgctagagaaataagggagtgtcctatttaggatgaggtgctccggtggcagccccaccaaaacctctagcgactaggaacagctatatcgggttgctatagcagtcaggatgtcattctggcgttccgaaatacccaaacctcgactcggaccgatg

SEQ ID NO: 13730 - DNA, 203 bp, Homo sapiens
  source 1..203: mol_type = other DNA
ggcgcgccagtcctctgtgaagtctaatgcttagcgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggcgactcggaccgatg

SEQ ID NO: 13731 - DNA, 203 bp, Homo sapiens
  source 1..203: mol_type = other DNA
ggcgcgccagtcctaggtattgtctcacaaggactgggtgaagagttctgcagccttacagagactggaaaagaagcccaaaccaaggcccccagagaggtcccccaggcccctttggaaagggaccgtgaggctggagatccggcgcaggagaccaacgcctgccatgctgttccggctctcagagccgactcggaccgatg

SEQ ID NO: 13732 - DNA, 203 bp, Homo sapiens
  source 1..203: mol_type = other DNA
ggcgcgccagtcctttgcgctctctcacaaggactgggtgaagagttctgcagccttacagagactggaaaagaagcccaaaccaaggcccccagagaggtcccccaggcccctttgggtccctgagcctcagctggagatccggcattactctggcgaccctgccatgctgttccggctctcagagccgactcggaccgatg

SEQ ID NO: 13733 - DNA, 203 bp, Homo sapiens
  source 1..203: mol_type = other DNA
ggcgcgccagtcctaagtgctctctcacaaggactgggtgaagagttctgcagccttacagagactggaaaagaagtattttgtctacggcccagagaggtcccccaggcccctttgggtccctgagcctcagctggagatccggcgcaggagaccaacgcctgccatgctgttccggctctcagagccgactcggaccgatg

SEQ ID NO: 13734 - DNA, 203 bp, Homo sapiens
  source 1..203: mol_type = other DNA
ggcgcgccagtcctagatcacctctgacatggtgctgttcatggcggtagctagctggtagtcctccggcccctgaatgcggctaatcctaactgcggagcacatgctcacaaaccagtgggtggtgtgtcgtaacgggcaactctgcagcggaaccgactactttgggtgtccgtgtttccttttatcgactcggaccgatg

SEQ ID NO: 13735 - DNA, 203 bp, Homo sapiens
  source 1..203: mol_type = other DNA
ggcgcgccagtccttcccaccttctgacatggtgtgaagagcctattgagctagctggtagtcctccggcccctgaatgcggctaatcctaactgcggagcacatgctcacaaaccagtgggtggtgtgtcgacgatccaggaaaagcagcggaaccgactactttgggtgtccgtgtttccttttatcgactcggaccgatg

SEQ ID NO: 13736 - DNA, 203 bp, Homo sapiens
  source 1..203: mol_type = other DNA
ggcgcgccagtcctcggcgtgatctgacatggtgtgaagagcctattgagctagctggtagtcctccggcccctgaatgcggctaatcctgttaaaacttttgttgctcacaaaccagtgggtggtgtgtcgtaacgggcaactctgcagcggaaccgactactttgggtgtccgtgtttccttttatcgactcggaccgatg

SEQ ID NO: 13737 - DNA, 203 bp, Homo sapiens
  source 1..203: mol_type = other DNA
ggcgcgccagtcctaacagagctctgctgccgccaccgcccactcttacccccgccgcttctcgactctgttgttagccgaagactcgcctctcagccgcccgccgcacagacgcacgagtaaaaagtgcagctccatcggctgatagaatagtcaacttgactctgggcggcaccgggcgtcccacgcgactcggaccgatg

SEQ ID NO: 13738 - DNA, 203 bp, Homo sapiens
  source 1..203: mol_type = other DNA
ggcgcgccagtcctttgtatcgtctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 13739 - DNA, 203 bp, Homo sapiens
  source 1..203: mol_type = other DNA
ggcgcgccagtcctactatgactctgctgccgccaccgcccactcttacccccgccgcttctcgactctgttgttagccgaagactcgcctctcagccgcccgccgcacagacgcacgagtaaaaagtgcagctccatcggctgatcctcgctaagctcctgagggttctaagtccgggcgtcccacgcgactcggaccgatg

SEQ ID NO: 13740 - DNA, 203 bp, Homo sapiens
  source 1..203: mol_type = other DNA
ggcgcgccagtcctcttgcgtttctgctgccgccaccgcccactcttacccccgccgcttctcgactctgttgttagccgaagactcgcctctcagccgcccgcgctggttggtataaagtaaaaagtgcagctccatcggctgatcctcgctaagctccgactctgggcggcaccgggcgtcccacgcgactcggaccgatg

SEQ ID NO: 13741 - DNA, 203 bp, Homo sapiens
  source 1..203: mol_type = other DNA
ggcgcgccagtcctttagttcatctgctgccgccaccgcccactcttacccccgccgcttctgctaatcaaaacatgccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 13742 - DNA, 203 bp, Homo sapiens
  source 1..203: mol_type = other DNA
ggcgcgccagtcctaatgagaatctgctgccgcctggataacacagatcccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 13743 - DNA, 203 bp, Homo sapiens
  source 1..203: mol_type = other DNA
ggcgcgccagtcctagttaagatcttgctttcgtaataaaattctgtacataaaagtcgaaagtattgctatagttttcagcaaaaacaactatttaggcatacttctcaggatggcgcgttgcagtccaacaagatccagggactgtacagaattttcctatacctcgagtcgggtttggaatctaacgactcggaccgatg

SEQ ID NO: 13744 - DNA, 203 bp, Homo sapiens
  source 1..203: mol_type = other DNA
ggcgcgccagtcctgggtttgctctttcagatttggaactgtatctgtatggaaacaacagagttttcttgaagtacaactaaggacaggtcaccactaggcactaacatcgctgactcagcacccgccactgatggtctatctgatgctgaaaatgtctctagttttttgacaacggctaaataacccgactcggaccgatg

SEQ ID NO: 13745 - DNA, 203 bp, Homo sapiens
  source 1..203: mol_type = other DNA
ggcgcgccagtcctttgcgtgttctttcagatttggaactgtatctgtatggaaacaacagagttttcttgaagtacaactaaggacaggtcaccactaggcactaacatcgctgacttgcatgattatggagatggtctatctgatgctgaaaatgtctggcccaccccaggtacggctaaataacccgactcggaccgatg

SEQ ID NO: 13746 - DNA, 203 bp, Homo sapiens
  source 1..203: mol_type = other DNA
ggcgcgccagtccttcggcgtctctttcagatttggaactgtatctgtatggaaacaacagatcacaggattcagccaactaaggacaggtcaccactaggcactaacatcgctgacttgcatgattatggagatggtctatctgatgctgaaaatgtctctagttttttgacaacggctaaataacccgactcggaccgatg

SEQ ID NO: 13747 - DNA, 203 bp, Homo sapiens
  source 1..203: mol_type = other DNA
ggcgcgccagtcctggatgctttctttcagatttggaactgtatctgttcatgcgaggttatgttttcttgaagtacaactaaggacaggtcaccactaggcactaacatcgctgacttgcatgattatggagatggtctatctgatgctgaaaatgtctctagttttttgacaacggctaaataacccgactcggaccgatg

SEQ ID NO: 13748 - DNA, 203 bp, Homo sapiens
  source 1..203: mol_type = other DNA
ggcgcgccagtcctccttcctatgaaaatgccgtcggtttcgaaagcgaaatataacaatacgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 13749 - DNA, 203 bp, Homo sapiens
  source 1..203: mol_type = other DNA
ggcgcgccagtcctgcgaaccctgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgacatgaccagatttcgactcggaccgatg

SEQ ID NO: 13750 - DNA, 203 bp, Homo sapiens
  source 1..203: mol_type = other DNA
ggcgcgccagtcctgccgtccttgaaaatgccgtcggtttcgaaagcggcggcagcggcgctgagcgggtcccccccgcagactgagaagccgacccactacagtagaggttttcgcatcaggacggagcagtgccccctgttttcacagcacaagtgcgcgcagcaccggccgttcacctgcttccacgactcggaccgatg

SEQ ID NO: 13751 - DNA, 203 bp, Homo sapiens
  source 1..203: mol_type = other DNA
ggcgcgccagtcctcaagcgattgaaaatgccgtcggtttcgaaagcggcggcagcggcgctgagcgggtcccccccgcagactgagaagggcgttgcaatgccgtacctgaaggagttcaggacggagcagtgccccctgttttcacagcacaagtgcgcgcagcaccggccgttcacctgcttccacgactcggaccgatg

SEQ ID NO: 13752 - DNA, 203 bp, Homo sapiens
  source 1..203: mol_type = other DNA
ggcgcgccagtcctgcttgaggtgaaaatgccgtgttccgtctgccatgcggcagcggcgctgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 13753 - DNA, 203 bp, Homo sapiens
  source 1..203: mol_type = other DNA
ggcgcgccagtcctcacatgtatgaaaccggaaactgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 13754 - DNA, 203 bp, Homo sapiens
  source 1..203: mol_type = other DNA
ggcgcgccagtcctcccttcgttgaagtagacttgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggcgactcggaccgatg

SEQ ID NO: 13755 - DNA, 203 bp, Homo sapiens
  source 1..203: mol_type = other DNA
ggcgcgccagtcctgcctaagctgaattcattttaagtctaacgagacattctcaggaactccagaccttcctatttatgttgttttttgtattctatggaggaatcgtgtttggaaaccttcttattgtcataacagtggtatctgactcccaccttcactctcccatgtacttcctgctagccaaccgactcggaccgatg

SEQ ID NO: 13756 - DNA, 203 bp, Homo sapiens
  source 1..203: mol_type = other DNA
ggcgcgccagtccttgctcaaatgaattcatttttctgggtctctctgattctcaggaactccagaccttcctattccgaagtagaaacctattctatggaggaatcgtgtttggaaaccttcttattgtcataacagtggtatctgactcccaccttcactctcccatgtacttcctgctagccaaccgactcggaccgatg

SEQ ID NO: 13757 - DNA, 203 bp, Homo sapiens
  source 1..203: mol_type = other DNA
ggcgcgccagtccttgaatacgtgaattcatttttctgggtctctctgattctcaggaactccagaccttcctatttatgttgttttttggcccgacgcatcttatcgtgtttggaaaccttcttattgtcataacagtggtatctgactcccaccttcactctcccatgtacttcctgctagccaaccgactcggaccgatg

SEQ ID NO: 13758 - DNA, 203 bp, Homo sapiens
  source 1..203: mol_type = other DNA
ggcgcgccagtccttcaactggtgaattcatttttctgggtctctctgattctcaggaactccagaccttcctatttatgttgttttttgtattctatggaggaatcgtgtttggaaaccttcttattgtcacggatagtcatagcgactcccaccttcactctcccatgtacttcctgctagccaaccgactcggaccgatg

SEQ ID NO: 13759 - DNA, 203 bp, Homo sapiens
  source 1..203: mol_type = other DNA
ggcgcgccagtcctcaagtccctgaattcatttttctgggtctctctgattctcaggaactccagaccttcctatttatgttgttttttgtattctatggaggaatcgtgtttggaaaccttcttattgtcataacagtggtatctacgaaaaaccttcactctcccatgacagatttgctagccaaccgactcggaccgatg

SEQ ID NO: 13760 - DNA, 203 bp, Homo sapiens
  source 1..203: mol_type = other DNA
ggcgcgccagtcctataaatcctgaattcatttttctgggtctctctgattctcaggaactccagaccttcctatttatgttgttttttgtattctatggaggaatcgtgtttggaaaccttcttattgtcataacagtggtatctttggtttctaactcctctcccatgtacttcctgctagccaaccgactcggaccgatg

SEQ ID NO: 13761 - DNA, 203 bp, Homo sapiens
  source 1..203: mol_type = other DNA
ggcgcgccagtcctgcgttctgtgaattcatttttctgggtctctctgattctcaggaactcgcttttagagccggtatgttgttttttgtattctatggaggaatcgtgtttggaaaccttcttattgtcataacagtggtatctgactcccaccttcactctcccatgtacttcctgctagccaaccgactcggaccgatg

SEQ ID NO: 13762 - DNA, 203 bp, Homo sapiens
  source 1..203: mol_type = other DNA
ggcgcgccagtcctgtcgatcctgaattcatttttctgggtctctctgattctcagggactccagaccttcctatttatgttgttttttgatcagagccattttatcgtgtttggaaaccttcttattgtcataacagtggtatctgactcccaccttcactctcccatgtacttcctgctagccaaccgactcggaccgatg

SEQ ID NO: 13763 - DNA, 203 bp, Homo sapiens
  source 1..203: mol_type = other DNA
ggcgcgccagtcctgtctactttgaattcatttttctgggtctctctgattctcagggactccagaccttcctatttatgttgttttttgtattctatggaggaatcgtgtttggaaaaacgagcggatcagtaacagtggtatctgactcccaccttcactctcccatgtacttcctgctagccaaccgactcggaccgatg

SEQ ID NO: 13764 - DNA, 203 bp, Homo sapiens
  source 1..203: mol_type = other DNA
ggcgcgccagtcctccaggctatgaattcatttttctgggtctctctgtgcgcacacggactcagaccttcctatttatgttgttttttgtattctatggaggaatcgtgtttggaaaccttcttattgtcataacagtggtatctgactcccaccttcactctcccatgtacttcctgctagccaaccgactcggaccgatg

SEQ ID NO: 13765 - DNA, 203 bp, Homo sapiens
  source 1..203: mol_type = other DNA
ggcgcgccagtcctacgtcaggtgacatcgctaggaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctccgactcggaccgatg

SEQ ID NO: 13766 - DNA, 203 bp, Homo sapiens
  source 1..203: mol_type = other DNA
ggcgcgccagtcctcgtggaagtgacgcccaggtctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagcccgactcggaccgatg

SEQ ID NO: 13767 - DNA, 203 bp, Homo sapiens
  source 1..203: mol_type = other DNA
ggcgcgccagtcctggcggctctgacggaggcgccgctgccagggggcgtgcggcagcgcgggaataagccttaaagcggcggcggcggaggcggcggcggcggcggcggcggcggcggctgggcctcgagcgcccgcagcccacctctcgggggcgggctcccggcgctagcagggctgaagagaagcgactcggaccgatg

SEQ ID NO: 13768 - DNA, 203 bp, Homo sapiens
  source 1..203: mol_type = other DNA
ggcgcgccagtcctattcgtagtgacttctcagggatgtaaccggacctggttcagtatccgggttgtcctgtattgttacggtgtatccgtcttggcacactgaaagggtatttttgggtaatcctttcctactgcctgatagggtggcgtgcccggccacgagagattaagggtagcaatttaaaccgactcggaccgatg

SEQ ID NO: 13769 - DNA, 203 bp, Homo sapiens
  source 1..203: mol_type = other DNA
ggcgcgccagtcctgtaccgtttgaggaacactaatggtggcgacgcccgaggcaagctctggaaagcaacgccgagtctctgagaagagggagcataggctgtgctgatttaaaaacagaaaatgcaaagttggactgaaaatatcccacgtcttctaagcaatctgcttaaggcttccaaacttaccgactcggaccgatg

SEQ ID NO: 13770 - DNA, 203 bp, Homo sapiens
  source 1..203: mol_type = other DNA
ggcgcgccagtcctcaacctaatgaggaacactaggctgttgtctagacgaggcaagctctggaaagcaacgccgagtctctgagaagagcagttcagtaactagctgatttaaaaacagaaaatgcaaagttggactgaaaatatcccacgtcttctaagcaatctgcttaaggcttccaaacttaccgactcggaccgatg

SEQ ID NO: 13771 - DNA, 203 bp, Homo sapiens
  source 1..203: mol_type = other DNA
ggcgcgccagtccttcgtagcctgaggaacactaggctgttgtctagacgaggcaagctctggaaagcaacgccgagtctctgagaagagggagcataggctgtgctgatttaaaaacagaaaatgcaaagttggactgaaaatatatgcatgtcagccggcaatctgcttaaggcttccaaacttaccgactcggaccgatg

SEQ ID NO: 13772 - DNA, 203 bp, Homo sapiens
  source 1..203: mol_type = other DNA
ggcgcgccagtcctctgccgggtgaggctcagctaattgacctcaagaaagcaatcatccgcagtgcaatttgatcaagaaacacccaattacactacactggtatgacactgtactaaccctgagggttttagaaaaaacgattaacgataaataagccgtggggtcttgtgttacctgaggcagcccgactcggaccgatg

SEQ ID NO: 13773 - DNA, 203 bp, Homo sapiens
  source 1..203: mol_type = other DNA
ggcgcgccagtccttatccatgtgaggctcagctaattgacctcaagaaagcaatcatccgcagtgcaatttgatcgtcttggttgtccgtacactacactggtatgacactgtactaaccctgagggttttagaaaaaacgattaacgataaataagcccgaacactacacactacctgaggcagcccgactcggaccgatg

SEQ ID NO: 13774 - DNA, 203 bp, Homo sapiens
  source 1..203: mol_type = other DNA
ggcgcgccagtccttaacacgttgaggtcctctccagcaagctacacaaagtatagatatttgtgcctaatgcaaaaagctatatttacacatttcaagagagggtgcacttgctggggggaggacatgggccgggaaggattggaagaccaaggacctccccctcctccccctccaggtctagtctacgactcggaccgatg

SEQ ID NO: 13775 - DNA, 203 bp, Homo sapiens
  source 1..203: mol_type = other DNA
ggcgcgccagtcctagcgtgtttgagtaggttggattcgttaaactcacggacagaagcgctggtcggcgtctggcggttattgttcaaaactacaactccattttgacactttctcacttgtaccgatcttcagacgccctccttcttcatgagaatgatgccatccataagatctgtgcaaaactgcgactcggaccgatg

SEQ ID NO: 13776 - DNA, 203 bp, Homo sapiens
  source 1..203: mol_type = other DNA
ggcgcgccagtccttacaggcatgagtaggttggtccgaagtttgaaccggacagaagcgctggtcggcgtctggcggttattgttcaaaactacaactccattttgacactttctcacttgtaccgatcttagtttctatgttgccttcatgagaatgatgccatccataagatctgtgcaaaactgcgactcggaccgatg

SEQ ID NO: 13777 - DNA, 203 bp, Homo sapiens
  source 1..203: mol_type = other DNA
ggcgcgccagtcctcacgcctctgagtaggttggtccgaagtttgaaccggacagaagcgctggtcggcgtctggcggttattgttcaaaactacaactccattttgacactttctcacttgtaccgatcttcagacgccctccttcttcatgagaatgatgccatccataagaatccaaggccgggccgactcggaccgatg

SEQ ID NO: 13778 - DNA, 203 bp, Homo sapiens
  source 1..203: mol_type = other DNA
ggcgcgccagtcctcataacgctgagtaggttggtccgaagtttgaaccggacagaagcgctggtcggcgtctggctaccgggtcaacccactacaactccattttgacactttctcacttgtaccgatcttcagacgccctccttcttcatgagaatgatgccatccataagatctgtgcaaaactgcgactcggaccgatg

SEQ ID NO: 13779 - DNA, 203 bp, Homo sapiens
  source 1..203: mol_type = other DNA
ggcgcgccagtcctaccttacgtgagtaggttggtccgaagtttgaacgcacggctccttggggtcggcgtctggcggttattgttcaaaactacaactccattttgacactttctcacttgtaccgatcttcagacgccctccttcttcatgagaatgatgccatccataagatctgtgcaaaactgcgactcggaccgatg

SEQ ID NO: 13780 - DNA, 203 bp, Homo sapiens
  source 1..203: mol_type = other DNA
ggcgcgccagtcctgcacaggatgatcccccagccaggggtccgcaacaacgtggtacgtgtcgaaactttgcccatagcagcgggcgggcactttgcactggaacttacaacacccgagcaaggacgcgactctcccgacgcggggaggctattctgcccatttggggacacttccccgccgctgcccgactcggaccgatg

SEQ ID NO: 13781 - DNA, 203 bp, Homo sapiens
  source 1..203: mol_type = other DNA
ggcgcgccagtcctggcgggcatgatcccccagccaggggtccgcaacccttgccgcatccacgaaactttgcccatagcagcgggcgggcactttgcactggaacttacaacacccgagcaaggacgcgactctcccgacgcggggaggctattctgcccatttggggacactcgatgtggaacaaacgactcggaccgatg

SEQ ID NO: 13782 - DNA, 203 bp, Homo sapiens
  source 1..203: mol_type = other DNA
ggcgcgccagtcctgttgggtatgatcccccagccaggggtccgcaacccttgccgcatccacgaaactttgcccatagcagcgggcgggcactttgcactggataggcactggggtcagcaaggacgcgactctcccgacgcggggaggctattctgcccatttggggacacttccccgccgctgcccgactcggaccgatg

SEQ ID NO: 13783 - DNA, 203 bp, Homo sapiens
  source 1..203: mol_type = other DNA
ggcgcgccagtcctgcttaacatgatcccccagcggttatcgttggcgccttgccgcatccacgaaactttgcccatagcagcgggcgggcactttgcactggaacttacaacacccgagcaaggacgcgactctcccgacgcggggaggctattctgcccatttggggacacttccccgccgctgcccgactcggaccgatg

SEQ ID NO: 13784 - DNA, 203 bp, Homo sapiens
  source 1..203: mol_type = other DNA
ggcgcgccagtcctctcgtgactgatcgttgagctaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 13785 - DNA, 203 bp, Homo sapiens
  source 1..203: mol_type = other DNA
ggcgcgccagtcctcaatcatttgatggcgtcaaaagacgtcgttcctactgctgctagcagtgaaaatgctaacaacaatagtagtattaagtctcgtctattccaattggctttatgttcaggtggggctacgtccccacccaactcgataaagataaccaaccaagatatggctctggggctgatcgactcggaccgatg

SEQ ID NO: 13786 - DNA, 203 bp, Homo sapiens
  source 1..203: mol_type = other DNA
ggcgcgccagtcctccacaccatgatggcgtcaaaagacgtcgttcctactgctgctagcagtgaaaatgctaacaacaatagtagtattaagtctcgtctattggcgagactcaagggttcaggtggggctacgtccccacccaactcgataaagataaccaaccaagatatggctctggggctgatcgactcggaccgatg

SEQ ID NO: 13787 - DNA, 203 bp, Homo sapiens
  source 1..203: mol_type = other DNA
ggcgcgccagtcctctttattgtgatggcgtcaaaagacgtcgttcctactgctgctagcagtgaaaatgctaacaacaatagtagtattaagtctcgtctattggcgagactcaagggttcaggtggggctttcagtatgaattgctcgataaagataaccaaccaagatatggctctggggctgatcgactcggaccgatg

SEQ ID NO: 13788 - DNA, 203 bp, Homo sapiens
  source 1..203: mol_type = other DNA
ggcgcgccagtcctgggaagcttgatggcgtcaaaagacgtcgttcctactgctgctagcagtgaaaatgctaacaacaatagtagtattaagtctcgtctattggcgagactcaaggtgaacatcacattaacgtccccacccaactcgataaagataaccaaccaagatatggctctggggctgatcgactcggaccgatg

SEQ ID NO: 13789 - DNA, 203 bp, Homo sapiens
  source 1..203: mol_type = other DNA
ggcgcgccagtccttttcgtcctgcaaattagactccttgcggagctcgccgcctgattctaggctggtcacacgataaagcctgtgacgtttgcggcagccaggccgtcgacgatgcccagtgaaactctctgggaaattgcaaaagctgaagtggaaaaaaggggaattaatggaagtgaaggtgacgactcggaccgatg

SEQ ID NO: 13790 - DNA, 203 bp, Homo sapiens
  source 1..203: mol_type = other DNA
ggcgcgccagtcctacgtaccgtgcaaggagacgccgccgccttcatgctgccggcgggctgacgcataaacacattggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 13791 - DNA, 203 bp, Homo sapiens
  source 1..203: mol_type = other DNA
ggcgcgccagtcctctcaattatgcaaggagacgccgccgccttcatgctgccggcgggctgctcgcgccggctggtggccgagctgcagggcgccctggacgcaacgttgttcgttaaattgcaattggagcagagcctgcgcgtttgccgtcggctgctgcatgcctgggaaccaactgggacccgcgactcggaccgatg

SEQ ID NO: 13792 - DNA, 203 bp, Homo sapiens
  source 1..203: mol_type = other DNA
ggcgcgccagtcctggccaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 13793 - DNA, 203 bp, Homo sapiens
  source 1..203: mol_type = other DNA
ggcgcgccagtcctttctgttgtgcaaggagacgccgccgccttcatgctgccggcgggctgctcgcgccggctggtggccgagctgcagggcgccctggacgcctgcgcacagcgacttggaatgcaaacccagagcctgcgcgtttgccgtcggctgctgcatgcctgggaaccaactgggacccgcgactcggaccgatg

SEQ ID NO: 13794 - DNA, 203 bp, Homo sapiens
  source 1..203: mol_type = other DNA
ggcgcgccagtcctgtgtcgtctgcaaggagacgccgccgccttcatgctgtgcatctagtgctcgcgccggctggtggccgagctgcagggcgccctggacgcctgcgcacagcgacaattgcaattggagcagagcctgcgcgtttgccgtcggctgctgcatgcctgggaaccaactgggacccgcgactcggaccgatg

SEQ ID NO: 13795 - DNA, 203 bp, Homo sapiens
  source 1..203: mol_type = other DNA
ggcgcgccagtcctgagatggctgcaattgaagtaggcacatgtcgaattgctactgttgaaggcctaacaacctctgaggcaattgctgctataggcctcactccacaggcctatgctgtgatatctggggctcctgctgctatagctggatttgcagctttactgcaaactgtgactggtgtgagccgactcggaccgatg

SEQ ID NO: 13796 - DNA, 203 bp, Homo sapiens
  source 1..203: mol_type = other DNA
ggcgcgccagtcctgaggagtttgcaattgaagtgcaacttgcatctgagtgacgctcgcttggcctaacaacctctgaggcaattgctgctataggcctcactccacaggcctatgctgtgatatctggggctcctgctgctatagctggatttgcagctttactgcaaactgtgactggtgtgagccgactcggaccgatg

SEQ ID NO: 13797 - DNA, 203 bp, Homo sapiens
  source 1..203: mol_type = other DNA
ggcgcgccagtccttgaagagttgcaattgaagtgcaacttgcatctgttgctactgttgaacagaatcagggaggtgaggcaattgctgctataggcctcactccacaggcctatgctgtgatatctggggctcctgctgctatagctggatttgcagctttactgcaaactgtgactggtgtgagccgactcggaccgatg

SEQ ID NO: 13798 - DNA, 203 bp, Homo sapiens
  source 1..203: mol_type = other DNA
ggcgcgccagtccttacgcccttgcaattgaagtgcaacttgcatctgttgctactgttgaaggcctaacaacctctgaggcaattgctgctataggcctcactccacaggcctatgctgtgatatctggggctcctgctgctataatatccccgttttgtttactgcaaactgtgactggtgtgagccgactcggaccgatg

SEQ ID NO: 13799 - DNA, 203 bp, Homo sapiens
  source 1..203: mol_type = other DNA
ggcgcgccagtcctagcacttgtgcaattgaagtgcaacttgcatctgttgctactgttgaaggcctaacaacctctgaggcaattgctgctataggcctcactccacaggcctatgctgtgatatctggggctcctgctgctatagctggatttgcagctttactgcaaactgtgactggtgtgagccgactcggaccgatg

SEQ ID NO: 13800 - DNA, 203 bp, Homo sapiens
  source 1..203: mol_type = other DNA
ggcgcgccagtcctgcgcaacgtgcaattgaagtgcaacttgcatctgttgctactgttgaaggcctaacaacctctgaggcaattgctgctataggcctcactccacaggcctatgctgtgatatctgggggatggaagcggggggctggatttgcagctttactgcaaactgtgactggtgtgagccgactcggaccgatg

SEQ ID NO: 13801 - DNA, 203 bp, Homo sapiens
  source 1..203: mol_type = other DNA
ggcgcgccagtcctaaggcatgtgcacactcggactgggtataaagcagctgaaatgtggagtttcctcccaggagctgagagcgtgtccatgggcccagtgcctggcgtgtcctccctgggagcttgctggacgcatgaccaggattctgggagggcagaggacagaccacaggcacccaggataaccgactcggaccgatg

SEQ ID NO: 13802 - DNA, 203 bp, Homo sapiens
  source 1..203: mol_type = other DNA
ggcgcgccagtcctctaaggtatgcacagctaagacgtcgcgcttgcgcaggcgctcggcgctacccaacctacagagccaagatggcgcataggggttctccaggctgcagttggcgccttatcagtatctaagcggagtgttttggaaggagttaaggggctgtggcaaacgccctctccgccgtccgactcggaccgatg

SEQ ID NO: 13803 - DNA, 203 bp, Homo sapiens
  source 1..203: mol_type = other DNA
ggcgcgccagtcctaacactactgcacagctaagacgtcgcgcttgcggtattagcaatgtgagaggcctgcgggaagccaagatggcgcataggggttctccaggctgcagttggcgccttatcagtatctaagcggagtgttttggaaggagttaaggggctgtggcaaacgccctctccgccgtccgactcggaccgatg

SEQ ID NO: 13804 - DNA, 203 bp, Homo sapiens
  source 1..203: mol_type = other DNA
ggcgcgccagtcctccatacggtgcacagctaagtgcctcgaagccgacaggcgctcggcgcagaggcctgcgggaagccaagatggcgcataggggttctccaggctgcagttggcgccttatcagtatctaagcggagtgttttggaaggagttaaggggctgtggcaaacgccctctccgccgtccgactcggaccgatg

SEQ ID NO: 13805 - DNA, 203 bp, Homo sapiens
  source 1..203: mol_type = other DNA
ggcgcgccagtcctcaattgtgtgcacttcagagcgggatgtaaccgccacgtggcattgccaacaaggagaagaactccttgcccagctgcaccgacccctagagccatgcactaacaaatgctattgtaagcgatgcagtttccattgccagctgtgtttctcgaaaaaggggctcggaatatcatcgactcggaccgatg

SEQ ID NO: 13806 - DNA, 203 bp, Homo sapiens
  source 1..203: mol_type = other DNA
ggcgcgccagtcctatacatgatgcacttcagagcgggatgtaaccgctcaagaattggctaaacaaggagaagaaactaacagaatatagcaccgacccctagagccatgcactaacaaatgctattgtaagcgatgcagtttccattgccagctgtgtttctcgaaaaaggggctcggaatatcatcgactcggaccgatg

SEQ ID NO: 13807 - DNA, 203 bp, Homo sapiens
  source 1..203: mol_type = other DNA
ggcgcgccagtcctcgtgcagttgcacttcagagcgggatgtaaccgctcaagaattggctaaacaaggagaagaactccttgcccagctgcaccgacccctagagccatgcactaacaaatgctattgtaagcgatgcagtttccattgccagctgtgtgaacaaccgcgctagctcggaatatcatcgactcggaccgatg

SEQ ID NO: 13808 - DNA, 203 bp, Homo sapiens
  source 1..203: mol_type = other DNA
ggcgcgccagtccttagggcaatgcacttcagagcgggatgtaaccgctcaagaattggctaaacaaggagaagaactccttgcccagctttcgatcgtaaccaagccatgcactaacaaatgctattgtaagcgatgcagtttccattgccagctgtgtttctcgaaaaaggggctcggaatatcatcgactcggaccgatg

SEQ ID NO: 13809 - DNA, 203 bp, Homo sapiens
  source 1..203: mol_type = other DNA
ggcgcgccagtcctatcacgcttgcacttcagaggccaggcaggtgaatcaagaattggctaaacaaggagaagaactccttgcccagctgcaccgacccctagagccatgcactaacaaatgctattgtaagcgatgcagtttccattgccagctgtgtttctcgaaaaaggggctcggaatatcatcgactcggaccgatg

SEQ ID NO: 13810 - DNA, 203 bp, Homo sapiens
  source 1..203: mol_type = other DNA
ggcgcgccagtcctgtagaacttgcagcagcagctcttctggcctctcacgccatccaggggaccttgtcctaccctcttgtgtccgtcgtcagtgaatctctgactcgaaaaggtacagccgaagatagcatacttgctgttgccgttgtcattatcctgtttattatcttgctgggagttatcatgcgactcggaccgatg

SEQ ID NO: 13811 - DNA, 203 bp, Homo sapiens
  source 1..203: mol_type = other DNA
ggcgcgccagtcctctaatgattgcagcagcagctcttctggcctctcacgccatccaggggaccttgtcctaccctcttgtgtccgtcgtcagtgaatctctgactcgaaaaggtactcagcttctctatcgtgcgatgcaacgtgttgtcattatcctgtttattatcttgctgggagttatcatgcgactcggaccgatg

SEQ ID NO: 13812 - DNA, 203 bp, Homo sapiens
  source 1..203: mol_type = other DNA
ggcgcgccagtccttatctcgctgcagcagcagctcttctggcctctcacgccatccaggggaccttgtcctaccctcttgtgtccgtcgtcagtgaatctctgactcgaaaaggtactcagcttctctatctacttgctgttgccgttgtcattatcctgtttattatcttgccacactcatggtgacgactcggaccgatg

SEQ ID NO: 13813 - DNA, 203 bp, Homo sapiens
  source 1..203: mol_type = other DNA
ggcgcgccagtccttttagctatgcagcagcagctcttctggcctctcacgccatccaggggaccttgtcctaccctcttgtgtccgtcgtcagtgaatctctgcagaagttgacacatcagcttctctatctacttgctgttgccgttgtcattatcctgtttattatcttgctgggagttatcatgcgactcggaccgatg

SEQ ID NO: 13814 - DNA, 203 bp, Homo sapiens
  source 1..203: mol_type = other DNA
ggcgcgccagtccttgcctccatgcagcagcagctcttctggcctctcttttagatacttacaccttgtcctaccctcttgtgtccgtcgtcagtgaatctctgactcgaaaaggtactcagcttctctatctacttgctgttgccgttgtcattatcctgtttattatcttgctgggagttatcatgcgactcggaccgatg

SEQ ID NO: 13815 - DNA, 203 bp, Homo sapiens
  source 1..203: mol_type = other DNA
ggcgcgccagtcctgaacgagctgcagtcaagttgaccaagaagcgggactcagttcgagagcctctgtcggatgccagcctggacctgcagacggttatccgcacctcacccagctccctcgtagctttcatcaactcgcgatgcacatctccaggaggctcctacggtcatctctccattggcacccgactcggaccgatg

SEQ ID NO: 13816 - DNA, 203 bp, Homo sapiens
  source 1..203: mol_type = other DNA
ggcgcgccagtcctgaacctggtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatcaggaagacttaggtcgactcggaccgatg

SEQ ID NO: 13817 - DNA, 203 bp, Homo sapiens
  source 1..203: mol_type = other DNA
ggcgcgccagtccttgaaaccatgcagtcaagttgaccaagaagcgggcactgtccatctcacctctgtcggatgccagcctggacctgcagacggttatccgcacctcacccagctccctcgtagctttcatcaactcgcgatgcgaccgcagtatcccctcctacggtcatctctccattggcacccgactcggaccgatg

SEQ ID NO: 13818 - DNA, 203 bp, Homo sapiens
  source 1..203: mol_type = other DNA
ggcgcgccagtcctgcagcctgtgcagtcaagttgaccaagaagcgggcactgtccatctcacctctgtcggatgccagcctggacctgcagacggttatccgcacctcacccagctcgtgatgccaccatttcaactcgcgatgcacatctccaggaggctcctacggtcatctctccattggcacccgactcggaccgatg

SEQ ID NO: 13819 - DNA, 203 bp, Homo sapiens
  source 1..203: mol_type = other DNA
ggcgcgccagtccttgttatggtgcagtcaagttgaccaagaagcgggcactgtccatctcacctctgtcggatgccagcctggacctgcagacggttatccgcgatagcagtttgctcctcgtagctttcatcaactcgcgatgcacatctccaggaggctcctacggtcatctctccattggcacccgactcggaccgatg

SEQ ID NO: 13820 - DNA, 203 bp, Homo sapiens
  source 1..203: mol_type = other DNA
ggcgcgccagtcctgtgatctctgcagtcaagttgaccaagaagcgggcactgtccatctcacctctgtcggatgccagcctggacctgcgcttctagtaatagacctcacccagctccctcgtagctttcatcaactcgcgatgcacatctccaggaggctcctacggtcatctctccattggcacccgactcggaccgatg

SEQ ID NO: 13821 - DNA, 203 bp, Homo sapiens
  source 1..203: mol_type = other DNA
ggcgcgccagtcctgcccgtgatgcagtcaagttgaccaagaagcgggcactgtccatctcacctctgtcggatgcgccagcttgaggtaagacggttatccgcacctcacccagctccctcgtagctttcatcaactcgcgatgcacatctccaggaggctcctacggtcatctctccattggcacccgactcggaccgatg

SEQ ID NO: 13822 - DNA, 203 bp, Homo sapiens
  source 1..203: mol_type = other DNA
ggcgcgccagtccttgccgacctgcagtctcctcaggccttattaggacacatagttagccctaggtgtgaatatcaagcaggacataacaaggtaggatctctacaatacttggcactagcagcattaataacaccaaaaaagataaagccacctttgcctagtgttacgaaactgacagaggatagcgactcggaccgatg

SEQ ID NO: 13823 - DNA, 203 bp, Homo sapiens
  source 1..203: mol_type = other DNA
ggcgcgccagtccttttagacgtgcagtgcggagccatgtcagcaagaaggccccgcactcgatccacgctggctccctacggaggcccacctactcgaggcccaccgactcctactgcaatcagtactatgcgatcgtcctagagagtccattcagctgcacttccgcctcagtatggcatcacagccgactcggaccgatg

SEQ ID NO: 13824 - DNA, 203 bp, Homo sapiens
  source 1..203: mol_type = other DNA
ggcgcgccagtcctaaacatactgcagtgcggagggggcgggaagtccaggccccgcactcgatccacgctggctcaacctctgttagtccctactcgaggcccaccgactcctactgcaatcagtactatgcgatcgtcctagagagtccattcagctgcacttccgcctcagtatggcatcacagccgactcggaccgatg

SEQ ID NO: 13825 - DNA, 203 bp, Homo sapiens
  source 1..203: mol_type = other DNA
ggcgcgccagtcctgctctatatgcatactttttagagaaaccaaataattttttattgcatacccgtttttaataaaatacattgcataccctcttttaataaaaaatattgcatactttgacgaaacaaattttcgttgcatacccaataaaagattattatattgcatacctcgagactggccgccgactcggaccgatg

SEQ ID NO: 13826 - DNA, 203 bp, Homo sapiens
  source 1..203: mol_type = other DNA
ggcgcgccagtcctccatgttttgccaggtaacgccaagccagccacccagggcgagtcatcgacccaaaaggtcagaccgtctcacacaaacaatcccaagtaaaggctctgacgtctccccctttttttaggaactgaaaccacggccctgacgtccctcccccctaggaacaggaacagctctcccgactcggaccgatg

SEQ ID NO: 13827 - DNA, 203 bp, Homo sapiens
  source 1..203: mol_type = other DNA
ggcgcgccagtcctctcagagatgcccctgctctgcactctcaggacaaagttgctcttactccaaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 13828 - DNA, 203 bp, Homo sapiens
  source 1..203: mol_type = other DNA
ggcgcgccagtcctagtctacatgcccctgctctgcactctcaggtatcgagattctggctcccaaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 13829 - DNA, 203 bp, Homo sapiens
  source 1..203: mol_type = other DNA
ggcgcgccagtcctactgcccttgcccctgctctgcactctcaggtattccctgctctcctgaacaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 13830 - DNA, 203 bp, Homo sapiens
  source 1..203: mol_type = other DNA
ggcgcgccagtcctagcagctttgcccctgctctgcactctcaggtattccctgctcttactccaaaaagatggacccaggtccgaaggggcactgccactgtgatacctcgcctagacctccaggtcactgcgggccaccccctggccatggcccagggccctgcgggccacccccccaccatggtccgactcggaccgatg

SEQ ID NO: 13831 - DNA, 203 bp, Homo sapiens
  source 1..203: mol_type = other DNA
ggcgcgccagtcctataaagtttgcccctgctctgcactctcaggtattccctgctcttactccaaaaagatggacccaggtccgaaggggcactgccactgtggggggcatggccatagaagtatctttgccgggccaccccctggccatggcccagggccctgcgggccacccccccaccatggtccgactcggaccgatg

SEQ ID NO: 13832 - DNA, 203 bp, Homo sapiens
  source 1..203: mol_type = other DNA
ggcgcgccagtcctggacccattgcccctgctctgcactctcaggtattccctgctcttactccaaaaagatggacccaggtccgaaggggcactgccactgtggggggcatggccatcctccaggtcactgcgggccaccccctggccatggcccagggaaagctcctaggtgcccccaccatggtccgactcggaccgatg

SEQ ID NO: 13833 - DNA, 203 bp, Homo sapiens
  source 1..203: mol_type = other DNA
ggcgcgccagtcctacttcgaatgccgccatgcaagggctgttctcacacggctactcactgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13834 - DNA, 203 bp, Homo sapiens
  source 1..203: mol_type = other DNA
ggcgcgccagtcctcaatgggttgccgccatgcagcactacggggtgaacggcacgattgtgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13835 - DNA, 203 bp, Homo sapiens
  source 1..203: mol_type = other DNA
ggcgcgccagtcctggatgggatgccgccatgcagcactacggggtgaacggctactcactgcacgccatgaactcactcagcgccatgtacaacctgcaccagcaggcagcccagcacttagtttcctaagccgactaccggccttcagtgcatgcgcttacattggctgagcgcctggctgacatccgactcggaccgatg

SEQ ID NO: 13836 - DNA, 203 bp, Homo sapiens
  source 1..203: mol_type = other DNA
ggcgcgccagtcctacgctttctgccgccatgcagcactacggggtgaacggctactcactgcacgccatgaactcactcagcgccatgtacaacctgcaccagcaggcagcccagcaggcccagcatgcccccgactaccggccttcagtgcatgcgctgggtgcattgcgtagcctggctgacatccgactcggaccgatg

SEQ ID NO: 13837 - DNA, 203 bp, Homo sapiens
  source 1..203: mol_type = other DNA
ggcgcgccagtcctagccagcatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcagaaattctgggctcgactcggaccgatg

SEQ ID NO: 13838 - DNA, 203 bp, Homo sapiens
  source 1..203: mol_type = other DNA
ggcgcgccagtcctaggtaacttgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcagtcacggtcagaccgactcggaccgatg

SEQ ID NO: 13839 - DNA, 203 bp, Homo sapiens
  source 1..203: mol_type = other DNA
ggcgcgccagtccttaacgatatgccgccatgcagcactacggggtgaacggctactcactgcacgccatgaactcactcagcgccatgtacaacctgcaccagcaggcagcccagcaggcccagcatgccctatttgcagatttatcagtgcatgcgcttacattggctgagcgcctggctgacatccgactcggaccgatg

SEQ ID NO: 13840 - DNA, 203 bp, Homo sapiens
  source 1..203: mol_type = other DNA
ggcgcgccagtcctacaagcgctgccgccatgcagcactacggggtgaacggctactcactgcacgccatgaactcactcagcgccatgtacaacctgcaccaggcaaattagtcagtggcccagcatgcccccgactaccggccttcagtgcatgcgcttacattggctgagcgcctggctggctgtcgactcggaccgatg

SEQ ID NO: 13841 - DNA, 203 bp, Homo sapiens
  source 1..203: mol_type = other DNA
ggcgcgccagtccttctctgagtgccgccatgcagcactacggggtgaacggctactcactgcacgccatgaactccacagagaaggaaaacaacctgcaccagcaggcagcccagcaggcccagcatgcccccgactaccggccttcagtgcatgcgcttacattggctgagcgcctggctgacatccgactcggaccgatg

SEQ ID NO: 13842 - DNA, 203 bp, Homo sapiens
  source 1..203: mol_type = other DNA
ggcgcgccagtccttagccgcctgccgccatgcagcactacggggtgaacggctactcactgcacgccatgaactcgagaccaaatcctcacaacctgcaccagcaggcagcccagcaggcccagcatgcccccgactaccggccttcagtgcatgcgcttacattggctgagcgcctggctggctgtcgactcggaccgatg

SEQ ID NO: 13843 - DNA, 203 bp, Homo sapiens
  source 1..203: mol_type = other DNA
ggcgcgccagtcctcttactagtgccgccatgcagcactacggggtgaacggctactcactggtaaaggctccgcaactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13844 - DNA, 203 bp, Homo sapiens
  source 1..203: mol_type = other DNA
ggcgcgccagtcctcctggacatgccgccatgcagcactacggggtgatgcaactggtggcacacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 13845 - DNA, 203 bp, Homo sapiens
  source 1..203: mol_type = other DNA
ggcgcgccagtcctagattcgttgccggttttgcgacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaacgactcggaccgatg

SEQ ID NO: 13846 - DNA, 203 bp, Homo sapiens
  source 1..203: mol_type = other DNA
ggcgcgccagtcctcaggtacatgcctgcacaccctatgggtgtgaagccaaacaatggacaaggtgtgaagagccccgtgtgctcgctttgagtcctccggcccctgaatgtggctaaccttaaccctgcagctagagcacgtaaatgtgcagcgcggcagtcgtaatgagcaattgcgggatgggacgactcggaccgatg

SEQ ID NO: 13847 - DNA, 203 bp, Homo sapiens
  source 1..203: mol_type = other DNA
ggcgcgccagtcctggcacacgtgcctgcacaccctatgggtgtgaagccaaacaatggacaaggtgtgaagagccccgtgtgctcgctttgagtcctccggcccctgaatgtggctaaccttaaccctgcagctagagcacgtaacccaatgtgtatctgccacccgaccatcattgcgggatgggacgactcggaccgatg

SEQ ID NO: 13848 - DNA, 203 bp, Homo sapiens
  source 1..203: mol_type = other DNA
ggcgcgccagtcctaacgcggctgcctgcacaccctatgggtgtgaagccaaacaatggacaaggtgtgaagagccccgtgtgctcgctttgagtcctccggcccctgaatgtggctagttcacgagtgtgtgctagagcacgtaacccaatgtgtatctagtcgtaatgagcaattgcgggatgggacgactcggaccgatg

SEQ ID NO: 13849 - DNA, 203 bp, Homo sapiens
  source 1..203: mol_type = other DNA
ggcgcgccagtccttcgatcgttgcctgcacaccctatgggtgtgaagccaaacaatggacaaggtgtgaagagccccgtgtgctcgctttgagtcctccggccgacttggtgactggaccttaaccctgcagctagagcacgtaacccaatgtgtatctagtcgtaatgagcaattgcgggatgggacgactcggaccgatg

SEQ ID NO: 13850 - DNA, 203 bp, Homo sapiens
  source 1..203: mol_type = other DNA
ggcgcgccagtccttctatgcttgcctgcacaccctatgggtgtgaagccaaacaatggacacaccaaatgtctagccgtgtgctcgctttgagtcctccggcccctgaatgtggctaaccttaaccctgcagctagagcacgtaacccaatgtgtatctagtcgtaatgagcaattgcgggatgggacgactcggaccgatg

SEQ ID NO: 13851 - DNA, 203 bp, Homo sapiens
  source 1..203: mol_type = other DNA
ggcgcgccagtcctcccatttgtgcctgcacaccgccgtcaatgctgcccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggatgggacgactcggaccgatg

SEQ ID NO: 13852 - DNA, 203 bp, Homo sapiens
  source 1..203: mol_type = other DNA
ggcgcgccagtcctaatctttatgcctgccacttccggctcctgcgtcgctccggaagcctgactagattctctcacttggtaatccagattcggctaggaaaagacaagctttccagagaatgtttcagagaaagttacgtggagcgtgggcgtttcgcagactcctaagagaccttcagagaagaccgactcggaccgatg

SEQ ID NO: 13853 - DNA, 203 bp, Homo sapiens
  source 1..203: mol_type = other DNA
ggcgcgccagtccttcagtgcctgcctgggcagagggaggtgacgcgcggtgtggggaaagcctttaacttggcctctggcagccgatttaacccgagcgagcaggtctttgctattttcatcatctgtagaaacgggagttgcgaggcggatgagtgactgcaggtcgtccttctgcatctattgagcgactcggaccgatg

SEQ ID NO: 13854 - DNA, 203 bp, Homo sapiens
  source 1..203: mol_type = other DNA
ggcgcgccagtcctccgccatgtgcctgggcagagggaggtgacgcgcggtgtggggaaagcctttaacttggcctctggcagccgatttaacccgagcgagcaggtctttgctattttcatcatctgtagatggatatcacctccggcggatgagtgactgcaggtcgtccttggtggaaggaaccacgactcggaccgatg

SEQ ID NO: 13855 - DNA, 203 bp, Homo sapiens
  source 1..203: mol_type = other DNA
ggcgcgccagtcctatacgtcttgcctgggcagagggaggtgacgcgcttcaccacagcctgctttaacttggcctctggcagccgatttaacccgagcgagcaggtctttgctattttcatcatctgtagaaacgggagttgcgaggcggatgagtgactgcaggtcgtccttggtggaaggaaccacgactcggaccgatg

SEQ ID NO: 13856 - DNA, 203 bp, Homo sapiens
  source 1..203: mol_type = other DNA
ggcgcgccagtcctatggctcctgcctgggcagatatcccactgttttggtgtggggaaagcctttaacttggcctctggcagccgatttaacccgagcgagcaggtctttgctattttcatcatctgtagaaacgggagttgcgaggcggatgagtgactgcaggtcgtccttggtggaaggaaccacgactcggaccgatg

SEQ ID NO: 13857 - DNA, 203 bp, Homo sapiens
  source 1..203: mol_type = other DNA
ggcgcgccagtccttgggcaactgcgcaccagaaatgcatcctgccttcctcacccaggactggtctgagagggattcatgatggaagcatgttcattctgtgacctggttctcgcctaaatgtggtcaacagtgtcagcagttcagaggacatcaagcccttaccagggcttcccgggattggaaaccgactcggaccgatg

SEQ ID NO: 13858 - DNA, 203 bp, Homo sapiens
  source 1..203: mol_type = other DNA
ggcgcgccagtcctcaccacaatgcgcaccttccctgtaagagagcttgccagcagagagtgctctgagcactgaaactcagaggagagaatctgtctcccaggtctgctgatagacgtgggtgtgtattgaagaagaacaatctctaaacagagtcaactataactactaactccagagattaccagcgactcggaccgatg

SEQ ID NO: 13859 - DNA, 203 bp, Homo sapiens
  source 1..203: mol_type = other DNA
ggcgcgccagtccttggcattctgcgcaccttccctgtaagagagcttgccagcagagagtgctctgagcactgaactgattctctagagatctgtctcccaggtctgctgatagacggtaacagaatcaccagaagaacaatctctaaacagagtcaactataactactaactccagagattaccagcgactcggaccgatg

SEQ ID NO: 13860 - DNA, 203 bp, Homo sapiens
  source 1..203: mol_type = other DNA
ggcgcgccagtcctctcttctatgcgcaccttccgccgtcattcctaagccagcagagagtgctctgagcactgaaactcagaggagagaatctgtctcccaggtctgctgatagacggtaacagaatcaccagaagaacaatctctaaacagagtcaactataactactaactccagagattaccagcgactcggaccgatg

SEQ ID NO: 13861 - DNA, 203 bp, Homo sapiens
  source 1..203: mol_type = other DNA
ggcgcgccagtcctccacttggtgcgccggagggagggtgggaatgtctgcacgtgggtctgggtgtgagctgtctgagagtctggatgtatggctgtggaagtccaggagcagtggccttgtttgccagcagccggatgcccgggcccactgggcgggcggcccaggaaaaaggggatgagcagactcgactcggaccgatg

SEQ ID NO: 13862 - DNA, 203 bp, Homo sapiens
  source 1..203: mol_type = other DNA
ggcgcgccagtcctacgtcgcttgcgccggagggttaaaacagtctggtgcacgtgggtctgggtgtgagctgtctgagagtctggatgtatggctgtggaagtccaggagcagtggccttgtttgccagcagccggatgcccgggcccactgggcgggccagtggccgcctgcgggatgagcagactcgactcggaccgatg

SEQ ID NO: 13863 - DNA, 203 bp, Homo sapiens
  source 1..203: mol_type = other DNA
ggcgcgccagtccttgtaagagtgcgcctgcccccaggctagcgtttggactgttttgttttccagtatgtacgaaggcaggaagattgcacaagtcagggggcgtttccaatcgggtgtcaattttggatctccccccccccacccccctttggatcttgtcgggctttccacgtttcacttaaaaacgactcggaccgatg

SEQ ID NO: 13864 - DNA, 203 bp, Homo sapiens
  source 1..203: mol_type = other DNA
ggcgcgccagtcctagcgaaactgcgcctgcccccaggctagcgtttggactgttttgtttttggcggaactaccgggcaggaagattgcacaagtcagggggcgtttccaatcgggtgtcaattttggatcgggtaaaatggtggcccctttggatcttgtcgggctttccacgtttcacttaaaaacgactcggaccgatg

SEQ ID NO: 13865 - DNA, 203 bp, Homo sapiens
  source 1..203: mol_type = other DNA
ggcgcgccagtcctcctagtgatgcgcctgcccccaggctagcgtttggactgttttgtttttggcggaactaccgggcaggaagattgcacaagtcagggggcgtttccaatcgggtgtcaattttggatctccccccccccacccccctttggatcttgtcgggctttccacaggattggagcggccgactcggaccgatg

SEQ ID NO: 13866 - DNA, 203 bp, Homo sapiens
  source 1..203: mol_type = other DNA
ggcgcgccagtcctccaccctttgcgcctgcccccaggctagcgtttggactgttttgtttttggcggaactaccgggcaggaagattgcacaagtcagggggcgtttccaatcgggtgtcaattttggatctccccccccccacccccctttggatcttgtcgggctttccacgtttcacttaaaaacgactcggaccgatg

SEQ ID NO: 13867 - DNA, 203 bp, Homo sapiens
  source 1..203: mol_type = other DNA
ggcgcgccagtcctaacaacgttgcgcctgcccccaggctagcgtttggactgttttgtttttggcggaactaccgggcaggaagattgcacaagtcagggggcgtttccaatcgggttaagtgaaatagcttccccccccccacccccctttggatcttgtcgggctttccacgtttcacttaaaaacgactcggaccgatg

SEQ ID NO: 13868 - DNA, 203 bp, Homo sapiens
  source 1..203: mol_type = other DNA
ggcgcgccagtcctgcatcgattgcggtgcggagactccatgaggcccctcggcgagcttgtctgagtggaggcggcgggcgcaggactcgggtggaagggggccagcttgggggcgaggagtggacccgccacgggagctttgtcaataagcccacgcggggctggctgcatcccaacgacaaagtccgactcggaccgatg

SEQ ID NO: 13869 - DNA, 203 bp, Homo sapiens
  source 1..203: mol_type = other DNA
ggcgcgccagtccttccactcctgcggtgcggagactccatgaggccctggacatgaacaagctgagtggaggcggcgggcgcaggactcgggtggaagggggccagcttgggggcgaacgtgcttagttatacgggagctttgtcaataagcccacgcggggctggctgcatcccaacgacaaagtccgactcggaccgatg

SEQ ID NO: 13870 - DNA, 203 bp, Homo sapiens
  source 1..203: mol_type = other DNA
ggcgcgccagtccttaacagcatgcggtgcggagactccatgaggccctggacatgaacaagctgagtggaggcggcgggcgcaggactcgggtggaagggggccagcttgggggcgaggagtggacccgccacgggagctttgtcaataagcccacgcgacttcctgcttcagccaacgacaaagtccgactcggaccgatg

SEQ ID NO: 13871 - DNA, 203 bp, Homo sapiens
  source 1..203: mol_type = other DNA
ggcgcgccagtcctttccctggtgcggtgcggagactccatgaggccctggacatgaacaagctgagtggaggcggcgggcgcaggactcgggtggaagggggcttatccaatcctagggagtggacccgccacgggagctttgtcaataagcccacgcggggctggctgcatcccaacgacaaagtccgactcggaccgatg

SEQ ID NO: 13872 - DNA, 203 bp, Homo sapiens
  source 1..203: mol_type = other DNA
ggcgcgccagtcctgtaagcgttgcggtgcggagactccatgaggccctggacatgaacaagggacaatctaagttcgggcgcaggactcgggtggaagggggccagcttgggggcgaggagtggacccgccacgggagctttgtcaataagcccacgcggggctggctgcatcccaacgacaaagtccgactcggaccgatg

SEQ ID NO: 13873 - DNA, 203 bp, Homo sapiens
  source 1..203: mol_type = other DNA
ggcgcgccagtcctggccacggtgcgtcgccctcggatccgaaacgcaggccaactcgaccacagatgctctgaacgttcttctcatcatcgtggatgacctgcagggtcgagatccttgttatggggataagctggtgaggtccccaaatattgaccaactggcatcccacagcctcctcttccagacgactcggaccgatg

SEQ ID NO: 13874 - DNA, 203 bp, Homo sapiens
  source 1..203: mol_type = other DNA
ggcgcgccagtcctccggtgtatgcgtcgccctcggatccgaaacgcaggccaactcgaccacagatgctctgaacgttcttctcatcatcgtggatgacctgcgcccctccctgggcgtaacattaatattgctggtgaggtccccaaatattgaccaactggcatcccacagcctcctcttccagacgactcggaccgatg

SEQ ID NO: 13875 - DNA, 203 bp, Homo sapiens
  source 1..203: mol_type = other DNA
ggcgcgccagtcctgggcatcatgcgtcgccctcggatccgaaacgcaggccaactcgaccacagatgctctgaacgttcttctcatcatcgtggatgacctgcgcccctccctgggctgttatggggataacacacctctcgtatcaaatattgaccaactggcatcccacagcctcctcttccagacgactcggaccgatg

SEQ ID NO: 13876 - DNA, 203 bp, Homo sapiens
  source 1..203: mol_type = other DNA
ggcgcgccagtccttaccgcagtgcgtcgccctcggatccgaaacgcaggccaactcgaccacagatgctctgaacgttcttctcatcatcgtggatgacctgcgcccctccctgggctgttatggggataagctggtgaggtccccaaatattgaccaaaacctgagtacttacctcctcttccagacgactcggaccgatg

SEQ ID NO: 13877 - DNA, 203 bp, Homo sapiens
  source 1..203: mol_type = other DNA
ggcgcgccagtcctttgacgcatgcgtcgccctcggatccgaaacgcattgtcgtggtttagcagatgctctgaacgttcttctcatcatcgtggatgacctgcgcccctccctgggctgttatggggataagctggtgaggtccccaaatattgaccaactggcatcccacagcctcctcttccagacgactcggaccgatg

SEQ ID NO: 13878 - DNA, 203 bp, Homo sapiens
  source 1..203: mol_type = other DNA
ggcgcgccagtccttgcaccggtgctaatatctggagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgcgactcggaccgatg

SEQ ID NO: 13879 - DNA, 203 bp, Homo sapiens
  source 1..203: mol_type = other DNA
ggcgcgccagtcctacttgggttgctactcctgtcgcgatgaaccacgagtttcattgtggtataaatggaatagcaggtgttgtcaggtacaaggtttgtagcttgccaatatgttcattaccaacactgcagattcccattgagttggtgggggttttgttacctttgttttttttctcagcaaaacgactcggaccgatg

SEQ ID NO: 13880 - DNA, 203 bp, Homo sapiens
  source 1..203: mol_type = other DNA
ggcgcgccagtcctcgacacagtgctactcctgtgataggtttatcttagtttcattgtggtataaatggaatagcaggtgttgtcaggtacaaggtttgtagccctgtggataccggattaccaacactgcagattcccattgagttggtgggggttttgttacctttgttttttttctcagcaaaacgactcggaccgatg

SEQ ID NO: 13881 - DNA, 203 bp, Homo sapiens
  source 1..203: mol_type = other DNA
ggcgcgccagtcctgcgcccagtgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttcacctcagctcgggcgactcggaccgatg

SEQ ID NO: 13882 - DNA, 203 bp, Homo sapiens
  source 1..203: mol_type = other DNA
ggcgcgccagtcctcgcgtggatgctactcctgtgataggtttatcttcccacggccacataataaatggaatagcaggtgttgtcaggtacaaggtttgtagcttgccaatatgttcattaccaacactgcagattcccattgagttggtgggggttttgttacctttgttttttttctcagcaaaacgactcggaccgatg

SEQ ID NO: 13883 - DNA, 203 bp, Homo sapiens
  source 1..203: mol_type = other DNA
ggcgcgccagtcctgatgccagtgctactgcccccggtggcgaaaaacgggaacagcggggcaaacagtgagtggggttcagcgtagactctggaccaggagaggcccgcggtgaccgaggcctgggccccggaaaccaatagagccatggcgactccctctgctgccttcgaggcccttatgaatggcgactcggaccgatg

SEQ ID NO: 13884 - DNA, 203 bp, Homo sapiens
  source 1..203: mol_type = other DNA
ggcgcgccagtcctcaccctcttgctactgccccgaacccgcgctgcaaaagggttaccctaaaacagtgagtggggttcagcgtagactctggaccaggagaggcccgcggtgaccgaggcctgggccccggaaaccaatagagccatggcgactccctctgctgccttcgaggcccttatgaatggcgactcggaccgatg

SEQ ID NO: 13885 - DNA, 203 bp, Homo sapiens
  source 1..203: mol_type = other DNA
ggcgcgccagtcctcccgagcttgcttcaacacccaggccaggtctctgcctcggaagaagaaggtgtcaaccaattccagaacaagcacctctgccaccggatgtcctctgcgctggaatcagtcactgtcagcgacagacccctcggggtgtccatcacaaaagccgaggtagcccctgaagaagacgactcggaccgatg

SEQ ID NO: 13886 - DNA, 203 bp, Homo sapiens
  source 1..203: mol_type = other DNA
ggcgcgccagtcctctatgccttgcttcaacacccaggccaggtctctgcctcggaagaagagctgaggtttgccatccagaacaagcacctctgccaccggatgtcctctgcgctggaatcagtcactgtcagcgacagaccccttctaaacgttcattcaaaagccgaggtagcccctgaagaagacgactcggaccgatg

SEQ ID NO: 13887 - DNA, 203 bp, Homo sapiens
  source 1..203: mol_type = other DNA
ggcgcgccagtcctatgtgagatgcttcaacaccgccaaatacgaatagcctcggaagaagagctgaggtttgccatccagaacaagcacctctgccaccggatgtcctctgcgctggaatcagtcactgtcagcgacagacccctcggggtgtccatcacaaaagccgaggtagcccctgaagaagacgactcggaccgatg

SEQ ID NO: 13888 - DNA, 203 bp, Homo sapiens
  source 1..203: mol_type = other DNA
ggcgcgccagtcctctttggcgtggagtcaggaactaaagaatagtgctgttagcttgctcaatgccacagccatagcagtagctgagggcgggatcttccacttagaagtagtacaaggagcttgtagagctattcgccacatacctagaagaataagacagggcttggaaaggattttgctataagcgactcggaccgatg

SEQ ID NO: 13889 - DNA, 203 bp, Homo sapiens
  source 1..203: mol_type = other DNA
ggcgcgccagtcctaattcgtttggagtcaggaagatgcttccctatgtgttagcttgctcaatgccacagccatagcagtagctgaggggacagatagggttatagaagtagtacaaggagcttgtagagctattcgccacatacctagaagaataagacagggcttggaaaggattttgctataagcgactcggaccgatg

SEQ ID NO: 13890 - DNA, 203 bp, Homo sapiens
  source 1..203: mol_type = other DNA
ggcgcgccagtcctctatagcctggataattttccgtgaaactggatgatctttgaatattaaatgaaaggagactagaataacagtctcttgactattcatgagtactaaagtctgagagcattctttcttggtgtgcaaatcacgcctggcagcccctgcccacagtacccgaagatggcaggcctcgactcggaccgatg

SEQ ID NO: 13891 - DNA, 203 bp, Homo sapiens
  source 1..203: mol_type = other DNA
ggcgcgccagtcctatagtgcttggatcctaggcgattttggttacgcccggcgccgtgggcttttctgtttggacaacatcaaaaacatccattgcacaatggggcagttcattagcttcatgcaagaaataccaacctttttgcaggaggctctgaacattgctcttgttgcagtcagtctcattgcgactcggaccgatg

SEQ ID NO: 13892 - DNA, 203 bp, Homo sapiens
  source 1..203: mol_type = other DNA
ggcgcgccagtcctatcgggtctggatcctaggcgattttggttacgctataattgtaactgttttctgtttggacaacatcaaaaacatccattgcacaatggggcagttcattagcccatctaggttgggaccaacctttttgcaggaggctctgaacattgctcttgttgcagtcagtctcattgcgactcggaccgatg

SEQ ID NO: 13893 - DNA, 203 bp, Homo sapiens
  source 1..203: mol_type = other DNA
ggcgcgccagtcctcctggcgttggatcctaggcgattttggttacgctataattgtaactgttttctgtttggacaacatcaaaaacatccattgcacaatggggcagttcattagcttcatgcaagaaataccaacctttttgctaacccaaagtggtattgctcttgttgcagtcagtctcattgcgactcggaccgatg

SEQ ID NO: 13894 - DNA, 203 bp, Homo sapiens
  source 1..203: mol_type = other DNA
ggcgcgccagtcctaccggtgctggatcctaggcgtaactagatcaagttttgctgagtaaaattttaaacacattgagtatccgtgcaagacagcgcagagctccccacaatgggcaactgcaataagcctcccaagaggcctcccaacacacaaacatataggtgaagcgagtcagcagagttcagcgactcggaccgatg

SEQ ID NO: 13895 - DNA, 203 bp, Homo sapiens
  source 1..203: mol_type = other DNA
ggcgcgccagtcctgttgtaactggatcctaggcgtaactagatcaagttttgctgagtaaaattttaaacacattgagtatccgtgcaagacagcgcagagctccccacaatgggcaactgcaataagcctcccaagaggcctcccaacacacaaacatcatccaaccaaccctcagcagagttcagcgactcggaccgatg

SEQ ID NO: 13896 - DNA, 203 bp, Homo sapiens
  source 1..203: mol_type = other DNA
ggcgcgccagtcctatggtgagtggatcctaggcgtaactagatcaagttttgctgagtaaaattttaaacacattgagtatccgtgcaagacagcgcagagctccccacaatgggcacgcagtcatccgtacccaagaggcctcccaacacacaaacatcatccaaccaaccctcagcagagttcagcgactcggaccgatg

SEQ ID NO: 13897 - DNA, 203 bp, Homo sapiens
  source 1..203: mol_type = other DNA
ggcgcgccagtcctgggctccctggatcctaggcgtaactagatcaagttttgctgagtaaaattttaaacacattgagtatccgtgcaagacagcgcagagctttgactgtgatcatactgcaataagcctcccaagaggcctcccaacacacaaacatcatccaaccaaccctcagcagagttcagcgactcggaccgatg

SEQ ID NO: 13898 - DNA, 203 bp, Homo sapiens
  source 1..203: mol_type = other DNA
ggcgcgccagtcctgcccgctttggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacatcaacaaagccaaacgactcggaccgatg

SEQ ID NO: 13899 - DNA, 203 bp, Homo sapiens
  source 1..203: mol_type = other DNA
ggcgcgccagtccttgaccgaatggcacaaagggactgttttcttactcttagtctgagtgactgccaaggaaggcaaaggtagagcaactggatctctggctctccacatagcttctgatctcagaccttactaaaatgctttctgggcccaaggacaacatcgtagacggacaatgattttgagtccgactcggaccgatg

SEQ ID NO: 13900 - DNA, 203 bp, Homo sapiens
  source 1..203: mol_type = other DNA
ggcgcgccagtcctaggcgtactggcaccctgaccatggaaccctgaagtggcagtgacttctagagctcagtggcagaccccacgaccctcttcgagccttcctccccctcccaccaccagctttcaagctcccagagggaggggtggggaggggatcctgatctcacagggcagggggcttccatccgactcggaccgatg

SEQ ID NO: 13901 - DNA, 203 bp, Homo sapiens
  source 1..203: mol_type = other DNA
ggcgcgccagtcctgacggcggtggcaccctgaccatggaaccctgaagtggcagtgacttctagagctcagtggcagaccccacgacccttcctcccccttcctccccctcccaccaccagctttcaagctttattttaagcacctggggaggggatcctgatctcacagggcagggggcttccatccgactcggaccgatg

SEQ ID NO: 13902 - DNA, 203 bp, Homo sapiens
  source 1..203: mol_type = other DNA
ggcgcgccagtccttccgacggtggcaccctgacggctattgagattcgtggcagtgacttctagagctcagtggcagaccccacgacccttcctcccccttcctccccctcccaccaccagctttcaagctcccagagggaggggtggggaggggatcctgatctcacagggcagggggcttccatccgactcggaccgatg

SEQ ID NO: 13903 - DNA, 203 bp, Homo sapiens
  source 1..203: mol_type = other DNA
ggcgcgccagtcctgcccttagtggcggcgaacgcacttccggcgtgtgtccttacgggtgcgtccgggcggctgcttgcaggtgccacccagcgggttccagcttgtttgctgcataacaacgtttctaactggcgggcaaggggtccggctggagccgggcggctctcctccagctccttctcggccgactcggaccgatg

SEQ ID NO: 13904 - DNA, 203 bp, Homo sapiens
  source 1..203: mol_type = other DNA
ggcgcgccagtcctaactcctatggcggcgaacgcacttccggcgtgtgtccttacgggtgcgtccgggcggctgcttgcaggtgccacccagcgggttccagcttgtttgctgcatagattacaacggtgatggcgggcaagcgggtttctgcccaaacggcggctctcctccagctccttctcggccgactcggaccgatg

SEQ ID NO: 13905 - DNA, 203 bp, Homo sapiens
  source 1..203: mol_type = other DNA
ggcgcgccagtcctgccgccactggcggcgaacgcacttccggcgtgtgtccttacgggtgctgggacaatcggctttgcaggtgccacccagcgggttccagcttgtttgctgcatagattacaacggtgatggcgggcaaggggtccggctggagccgggcggctctcctccagctccttctcggccgactcggaccgatg

SEQ ID NO: 13906 - DNA, 203 bp, Homo sapiens
  source 1..203: mol_type = other DNA
ggcgcgccagtcctccaacggctggctaacgccaatcacgtgggagcctgaacaaggtgtgaagagcctattgagctacataagaatcctccggcccctgaatgcggctaatcccaacctcggagcaggtggtcacaaaccagtgattggcctgtcgtaacgcgcaagtccgtggcggaaccgactaccgactcggaccgatg

SEQ ID NO: 13907 - DNA, 203 bp, Homo sapiens
  source 1..203: mol_type = other DNA
ggcgcgccagtcctggtttcggtggctaacgccatgggacgctagttgtgaacaaggtgtgaagagcctattgagctacataagaatcctccggcccctgaatgaaaggtgattgtctctcggagcaggtggtcacaaaccagtgattggcctgtcgtaacgcgcaagtccgtggcggaaccgactaccgactcggaccgatg

SEQ ID NO: 13908 - DNA, 203 bp, Homo sapiens
  source 1..203: mol_type = other DNA
ggcgcgccagtcctttattcggtggctaacgccatgggacgctagttgtgaacaaggtgtgaagagcctattgagctacataagaatcctccggcccctgaatgcggctaatcccaacctcggagcaggtggcatttctttgaaccttggcctgtcgtaacgcgcaagtccgtggcggaaccgactaccgactcggaccgatg

SEQ ID NO: 13909 - DNA, 203 bp, Homo sapiens
  source 1..203: mol_type = other DNA
ggcgcgccagtccttagtaatgtggctaacgccatgggacgctagttgtgaacaaggtgtgaccccaggtcgactatacataagaatcctccggcccctgaatgcggctaatcccaacctcggagcaggtggtcacaaaccagtgattggcctgtcgtaacgcgcaagtccgtggcggaaccgactaccgactcggaccgatg

SEQ ID NO: 13910 - DNA, 203 bp, Homo sapiens
  source 1..203: mol_type = other DNA
ggcgcgccagtcctcagcgctatggctgcttatgagttgtccttatagttgttatcataaagcgaattggattggccatccggtgaaagtgagactcattatctatctgtttgctggatccgctccattgagtgtgtttactctaagtacaatttcaacagttatttcaatcagacaattgtatcatacgactcggaccgatg

SEQ ID NO: 13911 - DNA, 203 bp, Homo sapiens
  source 1..203: mol_type = other DNA
ggcgcgccagtccttctcagtctggctgcttatggtgacaatcaaaaagttgttaccatatagctattggattggccatccggtgtgcaacagggcaattgtttacctatttattggttttgtaccattatcgaaattacggtacctcactctcaaattcattttgaccctcaacacaatcaaacatgcgactcggaccgatg

SEQ ID NO: 13912 - DNA, 203 bp, Homo sapiens
  source 1..203: mol_type = other DNA
ggcgcgccagtccttctagcactggctgcttatggtgacaatcaaaaagttgttaccatatagctattggattggccatccggtgtgcaagtatcattaacaaaacctatttattggttttgtaccattatcactgaagtctgtgatcactctcaaattcattttgaccctcaacacaatcaaacatgcgactcggaccgatg

SEQ ID NO: 13913 - DNA, 203 bp, Homo sapiens
  source 1..203: mol_type = other DNA
ggcgcgccagtcctgagcggcatggctgcttatggtgacaatcacagattgttatcataaagcgaattggattggccatccggtgaaagtatattcagacccagatctgtttgctggatccgctccattgagtgtgtttactctaagtacaatttcaacagttatttcaatcagacaattgtatcatacgactcggaccgatg

SEQ ID NO: 13914 - DNA, 203 bp, Homo sapiens
  source 1..203: mol_type = other DNA
ggcgcgccagtcctggagccgctggctgcttatggtgacaatcacagattgttatcataaagcgaattggattggccatccggtgaaagtgagactcattatctatctgtttgctggatccgctccattgagtgtgtttactctaatactgcggagtttcgttatttcaatcagacaattgtatcatacgactcggaccgatg

SEQ ID NO: 13915 - DNA, 203 bp, Homo sapiens
  source 1..203: mol_type = other DNA
ggcgcgccagtcctggcccttatggctgcttatgtctgtgcggcgggggttgttaccatatagctattggattggccatccggtgtgcaacagggcaattgtttacctatttattggttttgtaccattatcactgaagtctgtgatcactctcaaattcattttgaccctcaacacaatcaaacatgcgactcggaccgatg

SEQ ID NO: 13916 - DNA, 203 bp, Homo sapiens
  source 1..203: mol_type = other DNA
ggcgcgccagtcctgctaagtatggctgtggcacacccaccggtggcacacccctccctcgggtccagttcagcccacagactcctgggacagtgaaggcactaccagcctctcctttgaggagtgttgcagcctttctgtgtgccagatgcctagtgaagaaaagctgaaaccctggagctttgtgccgactcggaccgatg

SEQ ID NO: 13917 - DNA, 203 bp, Homo sapiens
  source 1..203: mol_type = other DNA
ggcgcgccagtccttctctagttggctgtggcacacccaccggtggcacacccctccctcgggtccagttcagccctacagtgggcttttggagagccagggccccagcctctcctttgaggagtgttgcagcctttctgtgtgccagatgcctagtgaagaaaagctgaaaccctggagctttgtgccgactcggaccgatg

SEQ ID NO: 13918 - DNA, 203 bp, Homo sapiens
  source 1..203: mol_type = other DNA
ggcgcgccagtcctgttctaggtggctgtggcacacccaccggtggcacacccctccctcggtcgagtcatcatatacagactcctgggaggagagccagggccccagcctctcctttgaggagtgttgcagcctttctgtgtgccagatgcctagtgaagaaaagctgaaaccctggagctttgtgccgactcggaccgatg

SEQ ID NO: 13919 - DNA, 203 bp, Homo sapiens
  source 1..203: mol_type = other DNA
ggcgcgccagtcctatgcattttggctgtggcaccagacagaagcagccacccctccctcgggtccagttcagcccacagactcctgggaggagagccagggccccagcctctcctttgaggagtgttgcagcctttctgtgtgccagatgcctagtgaagaaaagctgaaaccctggagctttgtgccgactcggaccgatg

SEQ ID NO: 13920 - DNA, 203 bp, Homo sapiens
  source 1..203: mol_type = other DNA
ggcgcgccagtcctcattctcatgggacgccatcaataacaattggctctgtctctctcaccattgcaacagtatgcttcctcatgcagattgccatcctggtaactactgtgacattgcattttaagcaacatgagtgcgactcccccgcgagcaaccaagtaatgccgtgtgaaccaataataatacgactcggaccgatg

SEQ ID NO: 13921 - DNA, 203 bp, Homo sapiens
  source 1..203: mol_type = other DNA
ggcgcgccagtccttgtaattatgggcgacagggccagcagtctcctcacagtgatcggatataagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13922 - DNA, 203 bp, Homo sapiens
  source 1..203: mol_type = other DNA
ggcgcgccagtcctcacagttctgggcgacagggccagcagtctcctctttacagaaaagagggcctcagacagataccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13923 - DNA, 203 bp, Homo sapiens
  source 1..203: mol_type = other DNA
ggcgcgccagtcctaagaatgctgggcgacagggccagcagtctcctctttacagaaaagagtaagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13924 - DNA, 203 bp, Homo sapiens
  source 1..203: mol_type = other DNA
ggcgcgccagtcctgctgttaatgggcgacaggggggaggtatgatgttttacagaaaagagtaagagtactgaggaccgtcgcctctagtcgaagatgagccggcccgaaggaaggaaaaaccgcggggggagagaagaggttctcgagcagtgggtgagcggaagaaagaagttagaggaactcgacgactcggaccgatg

SEQ ID NO: 13925 - DNA, 203 bp, Homo sapiens
  source 1..203: mol_type = other DNA
ggcgcgccagtcctaaatcgactggggagggggactgttttgtaacatccacgcagtacaccccaatctcccagttcatttcctaatccttaaactccggtttcaaactccctcgctttgctcttcagttgcaggttccgatctttgggtactccaggagctgttctatagcccctgcttctggacctcgactcggaccgatg

SEQ ID NO: 13926 - DNA, 203 bp, Homo sapiens
  source 1..203: mol_type = other DNA
ggcgcgccagtcctgcgggtggtggggagggggagaacaagtattatcccacgcagtacaccccaatctcccagttcatttcctaatccttaaactccggtttcaaactccctcgctttgctcttcagttgcaggttccgatctttgggtactccaggagctgttctatagcccctgcttctggacctcgactcggaccgatg

SEQ ID NO: 13927 - DNA, 203 bp, Homo sapiens
  source 1..203: mol_type = other DNA
ggcgcgccagtcctgcagtgagtggggagggggagaacaagtattatcccacgcagtacaccccaatctcccagttcatttcctaatccttaaactccggtttcaaactccctcgctttgctcttcagttgcaggttccgatctttgggtactccaggagctgttctatagcccgactgggacagtgacgactcggaccgatg

SEQ ID NO: 13928 - DNA, 203 bp, Homo sapiens
  source 1..203: mol_type = other DNA
ggcgcgccagtcctcagcgtattggggagggggagaacaagtattatcccacgcagtacaccgagcggcatggaggcatttcctaatccttaaactccggtttcaaactccctcgctttgctcttcagttgcaggttccgatctttgggtactccaggagctgttctatagcccctgcttctggacctcgactcggaccgatg

SEQ ID NO: 13929 - DNA, 203 bp, Homo sapiens
  source 1..203: mol_type = other DNA
ggcgcgccagtcctcaccaaggtggggcgatcctaccctgttcctccgcttcttcgttgggcgcatctcctggaactgggccgcgtccccgccgcctttccgtcatttcttcagatagctccccagctgtggaaaatgagcatcctcaagagaccccagaatccaacaatagcgtgtatacttccttccgactcggaccgatg

SEQ ID NO: 13930 - DNA, 203 bp, Homo sapiens
  source 1..203: mol_type = other DNA
ggcgcgccagtcctttgtcacctggggtttcggtggtgaaaaaagtttttccccggggtctgggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13931 - DNA, 203 bp, Homo sapiens
  source 1..203: mol_type = other DNA
ggcgcgccagtcctaacggccctggggtttcggttcccccccttccccgcttatccacgtacggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13932 - DNA, 203 bp, Homo sapiens
  source 1..203: mol_type = other DNA
ggcgcgccagtcctgaggtcattggggtttcggttcccccccttccccttccccggggtctgattcgacgtcattgccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13933 - DNA, 203 bp, Homo sapiens
  source 1..203: mol_type = other DNA
ggcgcgccagtccttcctttgctggggtttcggttcccccccttccccttccccggggtctgggggtgacattgcaccgcgcccctcgtggggtcgcgttgccaccccacgcggactccccagctcgcgcgcccctcccatttgccacaaaactgttataccccaccccccttcccacctgaccagcccgactcggaccgatg

SEQ ID NO: 13934 - DNA, 203 bp, Homo sapiens
  source 1..203: mol_type = other DNA
ggcgcgccagtcctaattacggtggggtttcggttcccccccttccccttccccggggtctgggggtgacattgcaccgcgcccctcgtggggtcgcgttgccaccccacgcggactccccagctcgcgcgcccctcccatttgcctgtcctggtcaggcccccaccccccttcccacctgaccagcccgactcggaccgatg

SEQ ID NO: 13935 - DNA, 203 bp, Homo sapiens
  source 1..203: mol_type = other DNA
ggcgcgccagtcctggttcccttggggtttcggttcccccccttccccttccccggggtctgggggtgacattgcaccgcgcccctcgtggggtcgcgttgccattgatacgttctcgcccagctcgcgcgcccctcccatttgcctgtcctggtcaggcccccaccccccttcccacctgaccagcccgactcggaccgatg

SEQ ID NO: 13936 - DNA, 203 bp, Homo sapiens
  source 1..203: mol_type = other DNA
ggcgcgccagtcctgagagttttggggtttcggttcccccccttccccttccccggggtctgggggtgacattgcagacgtgggggatcagggtcgcgttgccaccccacgcggactccccagctcgcgcgcccctcccatttgcctgtcctggtcaggcccccaccccccttcccacctgaccagcccgactcggaccgatg

SEQ ID NO: 13937 - DNA, 203 bp, Homo sapiens
  source 1..203: mol_type = other DNA
ggcgcgccagtccttgctatcttgggtctagacaacttgatcattataaggctggtttgcatggatccaagaccataaatctaggatcctttacaatctcagaccctggtgcaaggttatatatagagcccaattctcctaattaaacagtgtctcaggttgacaaatggacaagttggatctagtcacgactcggaccgatg

SEQ ID NO: 13938 - DNA, 203 bp, Homo sapiens
  source 1..203: mol_type = other DNA
ggcgcgccagtcctttcaaagttggtaacaggttaatactagcatacagagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 13939 - DNA, 203 bp, Homo sapiens
  source 1..203: mol_type = other DNA
ggcgcgccagtcctggtaacactggtaacaggttccagggtaacagagacattcatcatcaactgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 13940 - DNA, 203 bp, Homo sapiens
  source 1..203: mol_type = other DNA
ggcgcgccagtcctcgaacttatggtaacaggttccagggtaacagaggagggagctgggtcctgtttactcccagtcctgccgatgaggattctgaccgtagacactgaattgtcccgtacctatccgtgcagacatccacaatccaccagggctgagctcgaactgccacctctgccagcaggacccgactcggaccgatg

SEQ ID NO: 13941 - DNA, 203 bp, Homo sapiens
  source 1..203: mol_type = other DNA
ggcgcgccagtcctccggcacttggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctaacaatctgccgtgcgactcggaccgatg

SEQ ID NO: 13942 - DNA, 203 bp, Homo sapiens
  source 1..203: mol_type = other DNA
ggcgcgccagtcctggtcggaatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 13943 - DNA, 203 bp, Homo sapiens
  source 1..203: mol_type = other DNA
ggcgcgccagtcctgaggctgttggtaacaggttccagggtaacagaggagggagctgggtcctgtttactcccagtcctgccgatgaggattctgaccgtagattggtcgcgtataggtacctatccgtgctctttctgtgttctcaccagggctgagctcgaactgccacctctgccagcaggacccgactcggaccgatg

SEQ ID NO: 13944 - DNA, 203 bp, Homo sapiens
  source 1..203: mol_type = other DNA
ggcgcgccagtcctgacatcgatggtattttttgggcctcgtgcttcgtggtgggagacccaggtcgaggtccgggtggggccggtgaggccgaataaaagcaaaggtgttggctcgggcctcttcgcgtggccggtgacgccttggctcccccgcaggtccggccgtagcacctccgcgccgtcgcccgactcggaccgatg

SEQ ID NO: 13945 - DNA, 203 bp, Homo sapiens
  source 1..203: mol_type = other DNA
ggcgcgccagtcctcctctccgtggtattttttgggcctcgtgcttcgtggtgggagacccaggtcgaggtccgggtggggccggtgaggggttgggcgtcgggaggtgttggctcgggcctcttcgcgtggccggtgacgccttggctcccccgcaggttttatacatatcaatccgcgccgtcgcccgactcggaccgatg

SEQ ID NO: 13946 - DNA, 203 bp, Homo sapiens
  source 1..203: mol_type = other DNA
ggcgcgccagtcctcctacgcatggtattttttgggcctcgtgcttcgtggtgggagacccaggtcgaggtccgggtggggccggtgaggggttgggcgtcgggaggtgttggctcggtaggacgtcttcatccggtgacgccttggctcccccgcaggtccggccgtagcacctccgcgccgtcgcccgactcggaccgatg

SEQ ID NO: 13947 - DNA, 203 bp, Homo sapiens
  source 1..203: mol_type = other DNA
ggcgcgccagtcctattagaaatggtggggcgtcgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 13948 - DNA, 203 bp, Homo sapiens
  source 1..203: mol_type = other DNA
ggcgcgccagtcctagaattgctggttcattagcaagcccagtgtttacagcacctctcacatccaggacgaccccatcctggcgctcactcttagtagtatggcttagtacgcattaggtggtaagccgagctctccctcggccttgttctgaatgcacacatgtctaggggctaaggatgtcctaccgactcggaccgatg

SEQ ID NO: 13949 - DNA, 203 bp, Homo sapiens
  source 1..203: mol_type = other DNA
ggcgcgccagtcctccctcaagtggttttaacaggggtcctttcttggataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcacccgactcggaccgatg

SEQ ID NO: 13950 - DNA, 203 bp, Homo sapiens
  source 1..203: mol_type = other DNA
ggcgcgccagtccttacttctttgtaaggcccacctcatggtaaatcgaggtacccgcaggtaacaagagacactgtggatctgatctggggccacctacctctatcctggtgaggtggttaaaaaacgtctagtgggccaaacccaggggggatccctggtttccttattttagtgtaaatgtcattcgactcggaccgatg

SEQ ID NO: 13951 - DNA, 203 bp, Homo sapiens
  source 1..203: mol_type = other DNA
ggcgcgccagtccttcccgaggtgtaaggcccacgaaggatgcccagaaggtacccgcaggtaacaagagacactgattcgtgaccagctggccacctacctctatcctggtgaggtggttaaaaaacgtctagtgggccaaacccaggggggatccctggtttccttattttagtgtaaatgtcattcgactcggaccgatg

SEQ ID NO: 13952 - DNA, 203 bp, Homo sapiens
  source 1..203: mol_type = other DNA
ggcgcgccagtccttctgcatttgtaaggcccacgaaggatgcccagaaggtacccgcaggtaacaagagacactgtggatctgatctggggccacctacctctatcctggtgaggtggttaaaaaacgtctagtgggccaaacccaggggggatccctggtttccttattttaccagcgcacgttcccgactcggaccgatg

SEQ ID NO: 13953 - DNA, 203 bp, Homo sapiens
  source 1..203: mol_type = other DNA
ggcgcgccagtcctgttcatactgtaaggcccacgaaggatgcccagaaggtacccgcaggttgtgtagagtcgattggatctgatctggggccacctacctctatcctggtgaggtggttaaaaaacgtctagtgggccaaacccaggggggatccctggtttccttattttagtgtaaatgtcattcgactcggaccgatg

SEQ ID NO: 13954 - DNA, 203 bp, Homo sapiens
  source 1..203: mol_type = other DNA
ggcgcgccagtcctggacgttctgtaggcgcttatacagattttattatcttttccatcagattcatcatcaacagcatggaagcgagaaaccaaacagctatttcaaaattccttctcctgggactgatagaggatccggaactgcagcccgtccttttcagcctgttcctgtccatgtacttggtccgactcggaccgatg

SEQ ID NO: 13955 - DNA, 203 bp, Homo sapiens
  source 1..203: mol_type = other DNA
ggcgcgccagtcctagtggccatgtcagagtgtctgggaagctcaaagccaaagtcctaatgtgcagtcaggtgaatttattgaaaaatttgaggctcctggtggtgcaaatcaaagaactgctcctcagtggatgttgcctttacttctaggcctgtacggaagtgttacttctgctctaaaagcttcgactcggaccgatg

SEQ ID NO: 13956 - DNA, 203 bp, Homo sapiens
  source 1..203: mol_type = other DNA
ggcgcgccagtccttcgtatgttgtccatcgttaaaacgggatggggagctggaccaggtgacagcggcatggacatatgccccaggctttcctgctggggtccatccatgagcctgcaggtgccctcatggagccccagccctgccctggaagcttggctgagagcttcctggaggaggagcttcggcgactcggaccgatg

SEQ ID NO: 13957 - DNA, 203 bp, Homo sapiens
  source 1..203: mol_type = other DNA
ggcgcgccagtcctagaaagactgtcccatttatccgtcaggtgacactatcctaaaggcagaagccttcaggtctgacccagccaatcaaagcattataccagaccatggaatgcataccaaacattattgacactaatgacacaagcccccttaaggcagaaaaaccaagagaacaataggccagacgactcggaccgatg

SEQ ID NO: 13958 - DNA, 203 bp, Homo sapiens
  source 1..203: mol_type = other DNA
ggcgcgccagtcctactaacattgtcccatttatccgtcaggtgacactatcctaaaggcagaagccttcaggtctgacccagccaatcaaagcattataccagaccatggaatgcataccaaacattattgacactaatgacacacaaaattggttttaagaaaaaccaagagtgggtcgtttatctcgactcggaccgatg

SEQ ID NO: 13959 - DNA, 203 bp, Homo sapiens
  source 1..203: mol_type = other DNA
ggcgcgccagtcctgacccaactgtcccatttatccgtcaggtgacactatcctaaaggcagaagccttcaggtctgacccagccaatcaaagcattataccagaccatggaatgcataccaaacattattgacactaatgacacacaaaattggttttatacgcctgtgcccaaacaataggccagacgactcggaccgatg

SEQ ID NO: 13960 - DNA, 203 bp, Homo sapiens
  source 1..203: mol_type = other DNA
ggcgcgccagtcctcactttcctgtctgtggtaagtaggcagcctccagacagtttcttccgcttcctgtaccacccggctcaagtagcggaaggcctcagacctcctatcagcccgtcggcctccgggccctgcattctctagccatggaccgggaccttttgcggcagtcgctaaattgccacgggcgactcggaccgatg

SEQ ID NO: 13961 - DNA, 203 bp, Homo sapiens
  source 1..203: mol_type = other DNA
ggcgcgccagtcctgagtgacgtgtctgtggtaagtaggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 13962 - DNA, 203 bp, Homo sapiens
  source 1..203: mol_type = other DNA
ggcgcgccagtccttggccctatgtctgtgtactgtgattgattataggacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 13963 - DNA, 203 bp, Homo sapiens
  source 1..203: mol_type = other DNA
ggcgcgccagtccttttgagtgtgtctgtgtacttccggcagcctccagacagtttcttccgcttcctgtaccacccggctcaagtagcggacacggaacagggaactatcagcccgtcggcctccgggccctgcattctctagccatggaccgggaccttttgcggcagtcgcgcccagaatggtcacgactcggaccgatg

SEQ ID NO: 13964 - DNA, 203 bp, Homo sapiens
  source 1..203: mol_type = other DNA
ggcgcgccagtccttcgggctttgtctgtgtacttccggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggcgactcggaccgatg

SEQ ID NO: 13965 - DNA, 203 bp, Homo sapiens
  source 1..203: mol_type = other DNA
ggcgcgccagtccttgccacactgtctgtgtacttccggcagcctccagacagtttcttccgcttcctgtaccacccggctcaagtagcggacacggaacagggcctagggcagggtacggcctccgggccctgcattctctagccatggaccgggaccttttgcggcagtcgctaaattgccacgggcgactcggaccgatg

SEQ ID NO: 13966 - DNA, 203 bp, Homo sapiens
  source 1..203: mol_type = other DNA
ggcgcgccagtcctaggatgcctgtctgtgtacttccggcagcctccagacagtttcttccgcttcctgtaccaccgccgggtttgtattgacacggaacagggaactatcagcccgtcggcctccgggccctgcattctctagccatggaccgggaccttttgcggcagtcgctaaattgccacgggcgactcggaccgatg

SEQ ID NO: 13967 - DNA, 203 bp, Homo sapiens
  source 1..203: mol_type = other DNA
ggcgcgccagtccttgtattcctgtgagcatgagaccagtcttcaatgttagatcttgtttatttgtagtttccttttcaagtcagtggatctcagcgatgtacgctcaatgattccaatttttctgttcttgccttcaggttgtctattacactttcatgtcctctggacttaactctgtttcccatcgactcggaccgatg

SEQ ID NO: 13968 - DNA, 203 bp, Homo sapiens
  source 1..203: mol_type = other DNA
ggcgcgccagtcctggagatcgtgtgagcatgaggtaccctgctctacttagatcttgtttatttgtagtttccttggttgtgacaatagtctcagcgatgtacgctcaatgattccaatttttctgttcttgccttcaggttgtctattacactttcatgtcctctggacttaactctgtttcccatcgactcggaccgatg

SEQ ID NO: 13969 - DNA, 203 bp, Homo sapiens
  source 1..203: mol_type = other DNA
ggcgcgccagtccttgtccggttgtgagcatgaggtaccctgctctacttagatcttgtttatttgtagtttccttttcaagtcagtggatctcagcgatgtacgctcaatgattccaatttttctgttcttgccttcaggttgtcagcacgtagcagcagtcctctggacttaactctgtttcccatcgactcggaccgatg

SEQ ID NO: 13970 - DNA, 203 bp, Homo sapiens
  source 1..203: mol_type = other DNA
ggcgcgccagtcctagaggtcctgtgagcatgaggtaccctgctctacttagatcttgtttatttgtagtttccttttcaagtcagtggatctcagcgatgtacgctcaatgattccaatttttctgttcttgccttcaggttgtctattacactttcatgtcctctggacttaactctgtttcccatcgactcggaccgatg

SEQ ID NO: 13971 - DNA, 203 bp, Homo sapiens
  source 1..203: mol_type = other DNA
ggcgcgccagtcctcgttgtgttgtgagcatgaggtaccctgctctacttagatcttgtttatttgtagtttccttttcaagtcagtggatctcagcgatgtacgctcaatgattccacgcccctccacgccgccttcaggttgtctattacactttcatgtcctctggacttaactctgtttcccatcgactcggaccgatg

SEQ ID NO: 13972 - DNA, 203 bp, Homo sapiens
  source 1..203: mol_type = other DNA
ggcgcgccagtcctccctgccgtgtgatcttattaaaattaggttaaatttcgaggttaaaaatagttttaatattatacgttagaatctggtcttgtatatttatacttaccacacaagatggaccggagcagccctccaatatctagtgtaccctcgtgctcgctcaaacattaagtggtgttgtgcgactcggaccgatg

SEQ ID NO: 13973 - DNA, 203 bp, Homo sapiens
  source 1..203: mol_type = other DNA
ggcgcgccagtcctcgacggcatgtgatcttattaaaattaggttaaatttcgaggttaaaaatagttttaatattgctatagtcttagaggtcttgtatattttgctaactgcttacagatggaccggagcagccctccaatatctagtgtaccctcgtgctcgctcaaacattaagtggtgttgtgcgactcggaccgatg

SEQ ID NO: 13974 - DNA, 203 bp, Homo sapiens
  source 1..203: mol_type = other DNA
ggcgcgccagtcctataccggctgtgcagacatcctaatacatagcacttatttctcttgctttacggcaggtgaagtaagaagagccatcagaggggaaaagttattgtcctgctgcaactatccccaagctcataaagcacaggtaccatcacttcaatacctagccctagttcgttattgtttgccgactcggaccgatg

SEQ ID NO: 13975 - DNA, 203 bp, Homo sapiens
  source 1..203: mol_type = other DNA
ggcgcgccagtcctgagacgaatgtggattccatgcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagcccgactcggaccgatg

SEQ ID NO: 13976 - DNA, 203 bp, Homo sapiens
  source 1..203: mol_type = other DNA
ggcgcgccagtcctccaatctctgtgtattgtgtcgcgcgataaaggttagcatcgaatatcgttggagaattccaaattctacctgtgctaaccagattgaccatcacttgagtcatagtgcatgtagcgggagaccctatgggcgtgtctcaatttttatcgattattaagaaaaaacaggccagacgactcggaccgatg

SEQ ID NO: 13977 - DNA, 203 bp, Homo sapiens
  source 1..203: mol_type = other DNA
ggcgcgccagtcctgttggcattgtgtattgtgtttatattatggaactagcatcgaatatcgttggagaattccaaattctacctgtgcgtggactcaaacgaatcacttgagtcatagtgcatgtagcgggagaccctatgggcgtgtctcaatttttatcgattattaagaaaaaacaggccagacgactcggaccgatg

SEQ ID NO: 13978 - DNA, 203 bp, Homo sapiens
  source 1..203: mol_type = other DNA
ggcgcgccagtcctgtaagacatgtgtattgtgtttatattatggaactagcatcgaatatcgttggagaattccaaattctacctgtgctaaccagattgaccatcacttgagtcatagtgcatgtagcgggagaccctatgggcgtgtctcaatttttatcgattattaagagtggcagcaaagtccgactcggaccgatg

SEQ ID NO: 13979 - DNA, 203 bp, Homo sapiens
  source 1..203: mol_type = other DNA
ggcgcgccagtcctcccttgcatgtgtattgtgtttatattatggaactagcatcgaatatcgttggagaattccatggcaccgactacgtaaccagattgaccatcacttgagtcatagtgcatgtagcgggagaccctatgggcgtgtctcaatttttatcgattattaagaaaaaacaggccagacgactcggaccgatg

SEQ ID NO: 13980 - DNA, 203 bp, Homo sapiens
  source 1..203: mol_type = other DNA
ggcgcgccagtccttagaactatgttatctcggagttcggtgtcttttgacctgctgttgactgctcccagggggccctgacgccctggggcacttttgctctgcacaggaccacgctggggtttgccatggtgacataaaggggtgtagaggaaggaaggagcaagaccagcctgtagactgtgccccgactcggaccgatg

SEQ ID NO: 13981 - DNA, 203 bp, Homo sapiens
  source 1..203: mol_type = other DNA
ggcgcgccagtcctgaatcctctgtttcatttcaggaagatatatgcgtcaggaaaatttctatcttcttttgtattatcaaggagatatttggagcagagtcatttgctaagaagggataaaataaaaaatggcatattcttggcaaacggatccaaatcctaatgaatcacacgaaaagcagtatgcgactcggaccgatg

SEQ ID NO: 13982 - DNA, 203 bp, Homo sapiens
  source 1..203: mol_type = other DNA
ggcgcgccagtcctcttatgtgtgtttctggaaacatgatttgtttgatgtgttcaagattcagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13983 - DNA, 203 bp, Homo sapiens
  source 1..203: mol_type = other DNA
ggcgcgccagtcctaatcgtgttgtttctggaaattgacaaccgccagaccccgaggtcccgagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13984 - DNA, 203 bp, Homo sapiens
  source 1..203: mol_type = other DNA
ggcgcgccagtcctagcccagatgtttctggaaattgacaaccgccagtgtgttcaagattcagaccagtgtttcaagaacacggatgcagcagcagctcttctggcctctcacgccaaggccttatggcaatcctaccctcttgtgtccgtcgtcagtgaatctctgactcgaaaaggtactcagctcgactcggaccgatg

SEQ ID NO: 13985 - DNA, 203 bp, Homo sapiens
  source 1..203: mol_type = other DNA
ggcgcgccagtcctggagtagttgtttctggaaattgacaaccgccagtgtgttcaagattcagaccagtgtttcaagaacacggatgcagcagcagctcttctggcctctcacgccactgtaaacgttagttcctaccctcttgtgtccgtcgtcagtgaatctctgactcgaaaaggtactcagctcgactcggaccgatg

SEQ ID NO: 13986 - DNA, 203 bp, Homo sapiens
  source 1..203: mol_type = other DNA
ggcgcgccagtccttatcggattgtttctggaaattgacaaccgccagtgtgttcaagattcagaccagtgtttcaagaacacggatgcagcagcagctcttctggcctctcacgccatccaggggaccttgtcctaccctcttgtccaaacacctgcaaaatctctgactcgaaaaggtactcagctcgactcggaccgatg

SEQ ID NO: 13987 - DNA, 203 bp, Homo sapiens
  source 1..203: mol_type = other DNA
ggcgcgccagtcctgcagtcgatgtttctggaaattgacaaccgccagtgtgttcaagattcagaccagtgtttcaagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13988 - DNA, 203 bp, Homo sapiens
  source 1..203: mol_type = other DNA
ggcgcgccagtcctagtgctgctgtttctggaaattgacaaccgccagtgtgttcaagattcagaccagtgtttcaagaacacggatgcagcagcagctcttctggcctctcacgccatccaggggaccttgtcctaccctcttgtgtccgtcgtcagtgaatctctgactcgactttagcgattatacgactcggaccgatg

SEQ ID NO: 13989 - DNA, 203 bp, Homo sapiens
  source 1..203: mol_type = other DNA
ggcgcgccagtcctaacttgtctgtttctggaaattgacaaccgccagtgtgttcaagattcagaccagtgtttcaagaacacggatgcagcagcagctcttctggcctctcacgccatccaggggaccttgtcctaccctcttgtgtccgtcgtcagtgctatgtgttgaacgaaaggtactcagctcgactcggaccgatg

SEQ ID NO: 13990 - DNA, 203 bp, Homo sapiens
  source 1..203: mol_type = other DNA
ggcgcgccagtcctcttccacttgtttctggaaattgacaaccgccagtgtgttcaagattcagaccagtgtttcaagaacacggatgcagcagcagctcttctggcctctcacgccatccaggggaccttgtcctaccctcttgttatgtcgcggcaataatctctgactcgaaaaggtactcagctcgactcggaccgatg

SEQ ID NO: 13991 - DNA, 203 bp, Homo sapiens
  source 1..203: mol_type = other DNA
ggcgcgccagtcctaggtattgtgtttctggaaattgacaaccgccagtgtgttcaagattcagaccagtgtttcaagaacacggatgcagcagcagctcttcttattgtgagacgactccaggggaccttgtcctaccctcttgtgtccgtcgtcagtgaatctctgactcgaaaaggtactcagctcgactcggaccgatg

SEQ ID NO: 13992 - DNA, 203 bp, Homo sapiens
  source 1..203: mol_type = other DNA
ggcgcgccagtcctgtcctacatgtttctggaaattgacaaccgccagtgtgttcaagattcagaccagtgtttcacttggttccgacaggcagcagctcttctggcctctcacgccatccaggggaccttgtcctaccctcttgtgtccgtcgtcagtgaatctctgactcgaaaaggtactcagctcgactcggaccgatg

SEQ ID NO: 13993 - DNA, 203 bp, Homo sapiens
  source 1..203: mol_type = other DNA
ggcgcgccagtcctctctctcgtgtttctggaaattgacaaccgccagtgtgttcaagattcgagttgtgaacgagagaacacggatgcagcagcagctcttctggcctctcacgccatccaggggaccttgtcctaccctcttgtgtccgtcgtcagtgaatctctgactcgaaaaggtactcagctcgactcggaccgatg

SEQ ID NO: 13994 - DNA, 203 bp, Homo sapiens
  source 1..203: mol_type = other DNA
ggcgcgccagtcctggtgctcatgttttggcttgcgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagccgactcggaccgatg

SEQ ID NO: 13995 - DNA, 203 bp, Homo sapiens
  source 1..203: mol_type = other DNA
ggcgcgccagtcctgacgcgtattaacgtggagccaagtaaacctgaattctggatatctcagggagctggcgatcataaattcaagttagcaaaagaaaaaaaaattgaaatgcttctctagataatgcttaaaggaccctgcagcagttcttggtattggacatagcatctcagctgttgcctcctcgactcggaccgatg

SEQ ID NO: 13996 - DNA, 203 bp, Homo sapiens
  source 1..203: mol_type = other DNA
ggcgcgccagtcctggcttggtttaacgtggagccaagtaaacctgaattctggatatctcattttctaacttcggataaattcaagttagcaaaagaaaaaaaaattgaaatgcttctctagataatgcttgttctctgtaaatacagttcttggtattggacatagcatctcagctgttgcctcctcgactcggaccgatg

SEQ ID NO: 13997 - DNA, 203 bp, Homo sapiens
  source 1..203: mol_type = other DNA
ggcgcgccagtcctctactagattaagaaaaactagtactaataccatttgattatgccaattttctcgagaaatcattcaattgaccatagactgaaagcgttgttacctagttcttcagaagagatcttattagaattaatttatatgatctaattcccttaaaaactgaataccaaaaaacaaaacgactcggaccgatg

SEQ ID NO: 13998 - DNA, 203 bp, Homo sapiens
  source 1..203: mol_type = other DNA
ggcgcgccagtcctgactagggttaagaaaaacttaggacccaagtcctttaaacgtgcatgattgagatagtcagtggaacacagccggttgaatactagtgagtaaattaggagtagtagtattgaaccacctcatatcttatttcttctgaactgcattaaaatttgtacccaggatataacaaccgactcggaccgatg

SEQ ID NO: 13999 - DNA, 203 bp, Homo sapiens
  source 1..203: mol_type = other DNA
ggcgcgccagtcctcttgcgttttaagaaaaacttaggacccaggtccttgattatgccaattttctcgagaaatctcgggtcctcgttaagactgaaagcgttgttacctagttcttcagaagagatcttattagaattaatttatatgatctaattcccttaaaaactgaataccaaaaaacaaaacgactcggaccgatg

SEQ ID NO: 14000 - DNA, 203 bp, Homo sapiens
  source 1..203: mol_type = other DNA
ggcgcgccagtcctcgggtttgttaaggtgtcgtaacgtctcgtgacaccgggttcagttcagtcgagtggtggcgacccaatttaacacccattcttatataagaacacagtataatttaatcacaaaagacctcaaaaactgacacagcttgatccactcaacatataattgtaagattaataatacgactcggaccgatg

SEQ ID NO: 14001 - DNA, 203 bp, Homo sapiens
  source 1..203: mol_type = other DNA
ggcgcgccagtcctcatcccacttaaggtgtcgtccttagcgcaacacccgggttcagttcaaatatcgacctctaacccaatttaacacccattcttatataagaacacagtataatttaatcacaaaagacctcaaaaactgacacagcttgatccactcaacatataattgtaagattaataatacgactcggaccgatg

SEQ ID NO: 14002 - DNA, 203 bp, Homo sapiens
  source 1..203: mol_type = other DNA
ggcgcgccagtcctctcgaattttaatattcatttgtttaaatcttattttatttttaagctcaaactgcttaagacacttaggtggtaataaagtgaaataattttttgcaaaggggtttcctcgatttggagctttttttttcttccaccgtcatttctaactcttaaaaccaactcagttccatccgactcggaccgatg

SEQ ID NO: 14003 - DNA, 203 bp, Homo sapiens
  source 1..203: mol_type = other DNA
ggcgcgccagtcctggatgcttttacatgctgcgttcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 14004 - DNA, 203 bp, Homo sapiens
  source 1..203: mol_type = other DNA
ggcgcgccagtcctccttcctattacattgtacggctcaggaccgtggggagttggctgaaggacttggggagcccagaagctgccaccgaaccaagaaccacctctgtgcagaaaagcaaccaccttgttctctattctgctgcccgagacaaccacatcctcctcctcctacacccaaaggctccccgactcggaccgatg

SEQ ID NO: 14005 - DNA, 203 bp, Homo sapiens
  source 1..203: mol_type = other DNA
ggcgcgccagtcctatatgaacttacgaagaaagtgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 14006 - DNA, 203 bp, Homo sapiens
  source 1..203: mol_type = other DNA
ggcgcgccagtcctgcctaagcttagttcccaggaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgcgactcggaccgatg

SEQ ID NO: 14007 - DNA, 203 bp, Homo sapiens
  source 1..203: mol_type = other DNA
ggcgcgccagtccttgaatacgttatagcaaagttccatgggtccagccagccgcttccctgtgctgtgagtgtttccaccactccaggagacagcattcagagttgaccttgtgagagctggccataatttaattccatctctaggttttctgtcttattgtttcagaggcacatcgagaaccaacccgactcggaccgatg

SEQ ID NO: 14008 - DNA, 203 bp, Homo sapiens
  source 1..203: mol_type = other DNA
ggcgcgccagtccttcaactggttatgaatacagggaccgcctaagagggcgtgcgctcccgacatgccccgccgcgcgccattaaccgccagatttgaatcgcgggacccgttggcagaggtggcggcggcggcatgggtgccccgacgttgccccctgcctggcagccctttctcaaggaccaccgcgactcggaccgatg

SEQ ID NO: 14009 - DNA, 203 bp, Homo sapiens
  source 1..203: mol_type = other DNA
ggcgcgccagtcctataaatccttattgcatacccgtttttaataaaatacattgcataccctcttttaataaaaaatattgcatactttactcgttgcttgcgtcgttgcatacccaataaaagattattatattgcatacccgtttttaataaaatacattgcataccctcttttaataaaaaatacgactcggaccgatg

SEQ ID NO: 14010 - DNA, 203 bp, Homo sapiens
  source 1..203: mol_type = other DNA
ggcgcgccagtcctacgtcaggttatttctgttgtttttgttgtattgttgagtcttcttgtgttttgttgtctttctacaggttgttgtggttgttgcaattgtttaacttcatcaatgcgaggctgttgtgattgtggttcaactaaacttccttattgtattagcagggtcgtccacgttcaatacgactcggaccgatg

SEQ ID NO: 14011 - DNA, 203 bp, Homo sapiens
  source 1..203: mol_type = other DNA
ggcgcgccagtcctgctgggcgttatttctgttgtttttgttgtattgttgagtcttcttgtgttttgttgtcttttgtagaaaatggtaggttgttgcaattgtttaacttcatcaatgcgaggctgttgtgattgtggttcaactaaacttccttattacgaatttgaaaaggtccacgttcaatacgactcggaccgatg

SEQ ID NO: 14012 - DNA, 203 bp, Homo sapiens
  source 1..203: mol_type = other DNA
ggcgcgccagtcctacctatgattcagtacgccaactattgtttgcgggaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14013 - DNA, 203 bp, Homo sapiens
  source 1..203: mol_type = other DNA
ggcgcgccagtcctcacatacgttcagtacgccacaagcgacacaaatgaacacgccttctcagccccgccagcacgagcggggcgttacggcccagcccccgagcagtgcagcctcccgagtgcagagtgcagcccctgcccgccctggcccagctgcccatgtctaccctgctggatcccaagtaacgactcggaccgatg

SEQ ID NO: 14014 - DNA, 203 bp, Homo sapiens
  source 1..203: mol_type = other DNA
ggcgcgccagtcctagcttcccttcagtacgccacaagcgacacaaatgaacacgccttctcagccccgccagcacttctaccctagccgggcccagcccccgagcagtgcagcctcccgagtgcagagtgcagcccctgcccgccaccttgtttactttcatgtctaccctgctggatcccaagtaacgactcggaccgatg

SEQ ID NO: 14015 - DNA, 203 bp, Homo sapiens
  source 1..203: mol_type = other DNA
ggcgcgccagtcctcagattagttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgcccacgtgtgctgcccgactcggaccgatg

SEQ ID NO: 14016 - DNA, 203 bp, Homo sapiens
  source 1..203: mol_type = other DNA
ggcgcgccagtcctctcagctgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14017 - DNA, 203 bp, Homo sapiens
  source 1..203: mol_type = other DNA
ggcgcgccagtccttgacttctttcagtacgccacaagcgacacaaatgaacacgccttctcagccccgccagcacttctaccctagccgggcccagcccccgagcagtgcagcctccgagagaaccccgagagcccctgcccgccctggcccagctgcccatgtctaccctgctggatcccaagtaacgactcggaccgatg

SEQ ID NO: 14018 - DNA, 203 bp, Homo sapiens
  source 1..203: mol_type = other DNA
ggcgcgccagtcctgagaccggttcagtacgccacaagcgacacaaatgaacacgccttctcagccccgccagcacttctaccctagccgggcccagcccccgatgcaatacagtcgtcgagtgcagagtgcagcccctgcccgccctggcccagctgcccatgtctaccctgctggatcccaagtaacgactcggaccgatg

SEQ ID NO: 14019 - DNA, 203 bp, Homo sapiens
  source 1..203: mol_type = other DNA
ggcgcgccagtcctggcggctcttcagtacgccacaagcgacacaaatgaacacgccttctcctataaattctagattctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14020 - DNA, 203 bp, Homo sapiens
  source 1..203: mol_type = other DNA
ggcgcgccagtcctttcacatattcagtacgccacaagcgacacaaattcgtcttaaagaggagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 14021 - DNA, 203 bp, Homo sapiens
  source 1..203: mol_type = other DNA
ggcgcgccagtcctattcgtagttcatcattctcaaattcttaggacgcggcctgttctttgggaacgctctcggaattggccgcggaaaccgatctgcccgttgtgtttgtgaaacagagaaagataggcggccatggtccaaccttgaaggcttatcaggagggcagacttcaaaagctactaaaacgactcggaccgatg

SEQ ID NO: 14022 - DNA, 203 bp, Homo sapiens
  source 1..203: mol_type = other DNA
ggcgcgccagtcctcagctatcttcatcattctcaaattcttaggacggtcgggccctggaaggaacgctctcggaattggccgcggaaaccgatctgcccgttgtgtttgtgaaacagagaaagataggcggccatggtccaaccggatgcatacccttggagggcagacttcaaaagctactaaaacgactcggaccgatg

SEQ ID NO: 14023 - DNA, 203 bp, Homo sapiens
  source 1..203: mol_type = other DNA
ggcgcgccagtccttatccatgttcattggacactggtgcgagccggtgatgccactcaacaatttctccaacatcttaacatccctgaagatatatatacaatatatatattagtgtcataatgcttggccataacgattctatatcatccaaccataaaactatcttaataaggttatgggacaaacgactcggaccgatg

SEQ ID NO: 14024 - DNA, 203 bp, Homo sapiens
  source 1..203: mol_type = other DNA
ggcgcgccagtcctagcgtgttttcctcccaaggctaaactttctaataggacagccctacgtcgggggctcccggagcagggcgagagctcgcgtcgccggaaaggaagacgggaagaaagggcaggcggctcggcgggcgtcttctccactcctctgccgcgtccccgtggctgcagggagccggccgactcggaccgatg

SEQ ID NO: 14025 - DNA, 203 bp, Homo sapiens
  source 1..203: mol_type = other DNA
ggcgcgccagtcctcataacgcttcctcccaaggctaaactttctaattcccttctttgggctcgggggctcccgggatcaccgtctgcgtcgcgtcgccggaaaggaagacgggaagaaagggcaggcggctcggcgggcgtcttctccactcctctgccgcgtccccgtggctgcagggagccggccgactcggaccgatg

SEQ ID NO: 14026 - DNA, 203 bp, Homo sapiens
  source 1..203: mol_type = other DNA
ggcgcgccagtcctgcacaggattccttagtgactctaaataaagtaacagcagacatcgggctggggagtgactccgtgtgtgcccggccctcgtctcaccgcataaagtcttttgactcccttggatcacagtctttgcacactcggacttcaaaactagatgctcttagcaatcggagtttggaccgactcggaccgatg

SEQ ID NO: 14027 - DNA, 203 bp, Homo sapiens
  source 1..203: mol_type = other DNA
ggcgcgccagtcctgggtccgattccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagttatatctccacatacgactcggaccgatg

SEQ ID NO: 14028 - DNA, 203 bp, Homo sapiens
  source 1..203: mol_type = other DNA
ggcgcgccagtcctgtccgtcgttccttagtgactctaaataaagtaacagcagacatcgggctggggagtgactccgtgtgtgcccggccctcgtctcaccgcataaagtcttttgactcccttggatcacgagaacgattgtgacggacttcaaaactgttccagggccagtatcggagtttggaccgactcggaccgatg

SEQ ID NO: 14029 - DNA, 203 bp, Homo sapiens
  source 1..203: mol_type = other DNA
ggcgcgccagtcctgttgggtattccttagtgactctaaataaagtaagttttctggcacaactggggagtgactccgtgtgtgcccggccctcgtctcaccgcataaagtcttttgactcccttggatcacagtctttgcacactcggacttcaaaactgttccagggccagtatcggagtttggaccgactcggaccgatg

SEQ ID NO: 14030 - DNA, 203 bp, Homo sapiens
  source 1..203: mol_type = other DNA
ggcgcgccagtcctgcctcactttcgacgcaggaggcggggctgctcagtcctccaggcgtcggtactcagcggtgaaatccagcatagccttgcttgcctgtgcgcgcgtgcgcggacatggcctcaaacgattatacccaacaagcaacccaaagctatggggcctaccccacccagcccgggcagcgactcggaccgatg

SEQ ID NO: 14031 - DNA, 203 bp, Homo sapiens
  source 1..203: mol_type = other DNA
ggcgcgccagtccttgagcgtgttcgacgcaggaggcggggctgctcagtcctccaggcgtcggtactcagcggtgttggaacttcgttgcttgcttgcctgtgcgcgcgtgcgcggacatggcctcaaacgattatacccaacaacttctggtccctattggggcctaccccacccagcccgggcagcgactcggaccgatg

SEQ ID NO: 14032 - DNA, 203 bp, Homo sapiens
  source 1..203: mol_type = other DNA
ggcgcgccagtcctactcgctcttcgacgcaggaggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccatttttaaattatgtcgactcggaccgatg

SEQ ID NO: 14033 - DNA, 203 bp, Homo sapiens
  source 1..203: mol_type = other DNA
ggcgcgccagtcctctttattgttcgacgcaggaggcggggctgctcagtcctccaggcgtcggtactcagcggtgttggaacttcgttgcttgcttgcctgtgtctcttacgctattcatggcctcaaacgattatacccaacaagcaacccaaagctatggggcctaccccacccagcccgggcagcgactcggaccgatg

SEQ ID NO: 14034 - DNA, 203 bp, Homo sapiens
  source 1..203: mol_type = other DNA
ggcgcgccagtcctgggaagctttcgacgcaggaggcggggctgctcatgaaaggtctgcagggtactcagcggtgttggaacttcgttgcttgcttgcctgtgcgcgcgtgcgcggacatggcctcaaacgattatacccaacaagcaacccaaagctatggggcctaccccacccagcccgggcagcgactcggaccgatg

SEQ ID NO: 14035 - DNA, 203 bp, Homo sapiens
  source 1..203: mol_type = other DNA
ggcgcgccagtcctgatcttatttcgcagctgttgtggtgtgtcgtaacgggcaactctgcagcggaaccgactactttgggtgtccgtgtttccttttattcctatattggctgcttatggtgacaatcaaaaagttgttaccatatagctattggattggccatccggtgtgcaacagggcaattgcgactcggaccgatg

SEQ ID NO: 14036 - DNA, 203 bp, Homo sapiens
  source 1..203: mol_type = other DNA
ggcgcgccagtccttttcgtccttcgggctgggagcgtgctttccacgacggtgacacgcttccctggattggcagccagactgccttccgggtcactgccatggaggagccgcagtcagatcctagcgtcgagccccctctgagtatatgccaggacggagacctatggaaactacttcctgaaaaccgactcggaccgatg

SEQ ID NO: 14037 - DNA, 203 bp, Homo sapiens
  source 1..203: mol_type = other DNA
ggcgcgccagtcctatcctaagttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaacactgcttattcccgcgactcggaccgatg

SEQ ID NO: 14038 - DNA, 203 bp, Homo sapiens
  source 1..203: mol_type = other DNA
ggcgcgccagtcctacgccgacttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 14039 - DNA, 203 bp, Homo sapiens
  source 1..203: mol_type = other DNA
ggcgcgccagtcctacgtaccgttcgggctgggagcgtgctttccacgacggtgacacgcttccctggattggcagccagactgccttccgggtcactgccatggaggagccgcagtcagatcctagcgtcgagccccctctgagtcaggaaacattttcgcgtggcaccgccatacttcctgaaaaccgactcggaccgatg

SEQ ID NO: 14040 - DNA, 203 bp, Homo sapiens
  source 1..203: mol_type = other DNA
ggcgcgccagtccttagtttctttcgggctgggagcgtgctttccacgacggtgacacgctttagctcgcgtttctccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 14041 - DNA, 203 bp, Homo sapiens
  source 1..203: mol_type = other DNA
ggcgcgccagtcctggccaaatttcgggctgggagcgtgctttccacgcgtaaactctatgcccctggattggcagccagactgccttccgggtcactgccatggaggagccgcagtcagatcctagcgtcgagccccctctgagtcaggaaacattttcagacctatggaaactacttcctgaaaaccgactcggaccgatg

SEQ ID NO: 14042 - DNA, 203 bp, Homo sapiens
  source 1..203: mol_type = other DNA
ggcgcgccagtccttgtgtgggttctacatgtagaattaagttacaaaaaaacatgggacaagtgaaaatgtctcttcaagggattcacctgagtgatctatcatacaagcatgctatattaaaagagtctcagtatacaataaagagagatgtaggcacaacaacagcagtgacaccctcatcattgcgactcggaccgatg

SEQ ID NO: 14043 - DNA, 203 bp, Homo sapiens
  source 1..203: mol_type = other DNA
ggcgcgccagtcctttctgttgttctcatgctatagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagcgactcggaccgatg

SEQ ID NO: 14044 - DNA, 203 bp, Homo sapiens
  source 1..203: mol_type = other DNA
ggcgcgccagtcctgtgtcgtcttctctagtgcagtgcctggagatgaccaccaaacggaaaatcatcggccgtctggtgccatgccgataaaatttgatatccgaagaaatcatctcagttttagattactcccactgcagtcttcagcaggtgccaaaggaggtctttaacttcgaacgaacattacgactcggaccgatg

SEQ ID NO: 14045 - DNA, 203 bp, Homo sapiens
  source 1..203: mol_type = other DNA
ggcgcgccagtcctgacctgaattctctagtgcagtgcctggagatgaccaccaaacggaaaatcccgttgtaactggtgccatgccgatgtttccgaggtgaagaagaaatcatctcagttttagatccacataactgcagtcttcagcaggtgccaaaggaggtctttaacttcgaacgaacattacgactcggaccgatg

SEQ ID NO: 14046 - DNA, 203 bp, Homo sapiens
  source 1..203: mol_type = other DNA
ggcgcgccagtcctcccggaacttctctagtgcagtgcctggagatgaccaccaaacggaaaatcccgttgtaactggtgccatgccgatgtttccgaggtgaagaagaaatcatctcagttttagattactcccactgcagtcttcagcaggtgccaaaggaggtctttaacttcgaacgaacattacgactcggaccgatg

SEQ ID NO: 14047 - DNA, 203 bp, Homo sapiens
  source 1..203: mol_type = other DNA
ggcgcgccagtcctgcgcaacgttctctagtgcagtgcctggagatgagttgatggacctggatcatcggccgtctggtgccatgccgatgtttccgaggtgaagaagaaatcatctcagttttagattactcccactgcagtcttcagcaggtgccaaaggaggtctttaacttcgaacgaacattacgactcggaccgatg

SEQ ID NO: 14048 - DNA, 203 bp, Homo sapiens
  source 1..203: mol_type = other DNA
ggcgcgccagtcctctacgcggttctgctacagaacaactcccttggtacaataaaaaagacgagtatttacttttcattgaaagaatggagcttgcttgatatttcactagataaagaatttaaggcgagtatctatctttgttccttcgttactaacggagtctgcccttggaaacatcaggcacccgactcggaccgatg

SEQ ID NO: 14049 - DNA, 203 bp, Homo sapiens
  source 1..203: mol_type = other DNA
ggcgcgccagtcctgtggcttattctgctacagaacaactcccttggtacaataaaaaagacgagtatttacttttcattgaaagaatggagcttgcttgatatttcactagataaagaatttaaggcgagtatctatctttgttctccttggcaactgagagtctgcccttggaaacatcaggcacccgactcggaccgatg

SEQ ID NO: 14050 - DNA, 203 bp, Homo sapiens
  source 1..203: mol_type = other DNA
ggcgcgccagtcctgtgcagagttctgctacagaacaactcccttggtacaataaaaaagacgagtatttacttttcattgaaagaatggagcttgcttgatatttcactagataaaggtgagcttagttacatctatctttgttctccttggcaactgagagtctgcccttggaaacatcaggcacccgactcggaccgatg

SEQ ID NO: 14051 - DNA, 203 bp, Homo sapiens
  source 1..203: mol_type = other DNA
ggcgcgccagtcctaacactacttctgctacagaactgggtatttggtacaataaaaaagacgagtatttacttttcattgaaagaatggagcttgcttgatatttcactagataaagaatttaaggcgagtatctatctttgttccatagccgcgatgagagtctgcccttggaaacatcaggcacccgactcggaccgatg

SEQ ID NO: 14052 - DNA, 203 bp, Homo sapiens
  source 1..203: mol_type = other DNA
ggcgcgccagtcctccatacggttctgctacagaactgggtatttggtacaataaaaaagacgagtatttacttttcattgaaagaatggagcttgcttgatatttcactagataaagaatttaaggcgagtatctatctttgttctccttggcaactgagagtctgcccttggaaacatcaggcacccgactcggaccgatg

SEQ ID NO: 14053 - DNA, 203 bp, Homo sapiens
  source 1..203: mol_type = other DNA
ggcgcgccagtcctcaattgtgttctggcacctacctacctgcttcccctacctttccccttagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 14054 - DNA, 203 bp, Homo sapiens
  source 1..203: mol_type = other DNA
ggcgcgccagtccttcgtgcggttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 14055 - DNA, 203 bp, Homo sapiens
  source 1..203: mol_type = other DNA
ggcgcgccagtccttattgtgcttctggcacctacctacctgcttcccgctggggggtggggagttggcccagagtcttaagattggggcagggtggagaggtgggctcttcctgcttcccactcatcttatcctcggtggattgtagatccgaattcgagatccaaaccaaggaggaaaggatatcacgactcggaccgatg

SEQ ID NO: 14056 - DNA, 203 bp, Homo sapiens
  source 1..203: mol_type = other DNA
ggcgcgccagtcctcctcaaacttctggcacctacctacctgcttcccgctggggggtggggtccctcaagttgcacttaagattggggcagggtggagaggtgggctcttcctgcttcccactcatcttatagctttctttccccagatccgaattcgagatccaaaccaaggaggaaaggatatcacgactcggaccgatg

SEQ ID NO: 14057 - DNA, 203 bp, Homo sapiens
  source 1..203: mol_type = other DNA
ggcgcgccagtcctgtagaactttctgtccctccacccgtccccttccccaccctctggcccccaccttcttggaggcgacaacccccggcctagtgctcccaagatttttcccgcaggttgcgaagggaagcaaacttggtggcaacttgcctcccggtgcgggcgtctctcccccaccgtctcaaccgactcggaccgatg

SEQ ID NO: 14058 - DNA, 203 bp, Homo sapiens
  source 1..203: mol_type = other DNA
ggcgcgccagtccttctcctgattctgtccctccacccgtccccttccccaccctctggcccccaccttcttggaggcgacaacccccgggaggcattagaagggatttttcccgcagacattcgcaaacgacaaacttggtggcaacttgcctcccggtgcgggcgtctctcccccaccgtctcaaccgactcggaccgatg

SEQ ID NO: 14059 - DNA, 203 bp, Homo sapiens
  source 1..203: mol_type = other DNA
ggcgcgccagtcctagcgacctttctgtccctccacccgtccccttccccaccctctggcccccaccttcttggaggcgacaacccccgggaggcattagaagggatttttcccgcaggttgcgaagggaagcaaacttggtggcaacttgcctcccggtatctcgtatcgcaacccaccgtctcaaccgactcggaccgatg

SEQ ID NO: 14060 - DNA, 203 bp, Homo sapiens
  source 1..203: mol_type = other DNA
ggcgcgccagtccttgaggcctttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctccaaactatagcatgacgactcggaccgatg

SEQ ID NO: 14061 - DNA, 203 bp, Homo sapiens
  source 1..203: mol_type = other DNA
ggcgcgccagtccttgcctccattctgtccctcccgatcaggtacaagccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaaccgactcggaccgatg

SEQ ID NO: 14062 - DNA, 203 bp, Homo sapiens
  source 1..203: mol_type = other DNA
ggcgcgccagtcctcgcattacttcttcttccagaacacctctgaaagcttggtcaagggtacattttttttcattttcactgccaggtaactgactgaaggcagtcaacaacggcttgatatttttgttattcaaggcttctctgacgacgagaacgggtcgcgtccgcgcctccggcaaactgaaacgactcggaccgatg

SEQ ID NO: 14063 - DNA, 203 bp, Homo sapiens
  source 1..203: mol_type = other DNA
ggcgcgccagtcctgagctagtttcttcttccagaacacctctgaaagcttggtcaagggtacattttttttcattttcactgccaggtatacccgacctccaggtcaacaacggcttgatatttttgttattcaaggcttctctggtagatttcgtaaatcgcgtccgcgcctccggcaaactgaaacgactcggaccgatg

SEQ ID NO: 14064 - DNA, 203 bp, Homo sapiens
  source 1..203: mol_type = other DNA
ggcgcgccagtcctagaagccgttcttcttccagttgcttagctcgcccttggtcaagggtacattttttttcattttcactgccaggtaactgactgaaggcagtcaacaacggcttgatatttttgttattcaaggcttctctggtagatttcgtaaatcgcgtccgcgcctccggcaaactgaaacgactcggaccgatg

SEQ ID NO: 14065 - DNA, 203 bp, Homo sapiens
  source 1..203: mol_type = other DNA
ggcgcgccagtcctgtactttgttctttaataccgaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagcgactcggaccgatg

SEQ ID NO: 14066 - DNA, 203 bp, Homo sapiens
  source 1..203: mol_type = other DNA
ggcgcgccagtcctagtccgccttgaaaaggttacccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgcccgactcggaccgatg

SEQ ID NO: 14067 - DNA, 203 bp, Homo sapiens
  source 1..203: mol_type = other DNA
ggcgcgccagtccttgaaaccattgaaattggctggcactgctgttgttaatttaagaccagatcaattaaatgatttagtttattctctgcccactttcctataattattagttcgcgatacgcgtaaagagatttttgttggtgatagtcttgtaaatacttgttagatctcattaaatctaaactcgactcggaccgatg

SEQ ID NO: 14068 - DNA, 203 bp, Homo sapiens
  source 1..203: mol_type = other DNA
ggcgcgccagtcctgtttggacttgaagtgaagcattctatgaatgtgagctgaagaaatgaggacctcagttgggtgcaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 14069 - DNA, 203 bp, Homo sapiens
  source 1..203: mol_type = other DNA
ggcgcgccagtcctgcagattcttgaagtgaagcattctatgaatgtggagactttgcggcgatgaaatgaaataatgcaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 14070 - DNA, 203 bp, Homo sapiens
  source 1..203: mol_type = other DNA
ggcgcgccagtccttactaccattgcaatcaggtagctcgcggctcacgctgagagggacacgcagtgacgagcggccgaagcagctttgcggtgagagcacgctgggccgggggccgggcgggagcctggtggcgggtaacgccggactcgagggttttgtagtgcatccctgagcatgagcacagacgactcggaccgatg

SEQ ID NO: 14071 - DNA, 203 bp, Homo sapiens
  source 1..203: mol_type = other DNA
ggcgcgccagtcctgattagatttgcatagaatggcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgattcgactcggaccgatg

SEQ ID NO: 14072 - DNA, 203 bp, Homo sapiens
  source 1..203: mol_type = other DNA
ggcgcgccagtccttcttacttttgcctgttccactaggaatattgtttgcaaggcacaaggtgtcttttggtagtgagcgcgctctgcgcatgcgcaggtccaacattactgaggcacccagcagccgactaagttgcattccttgaatcttcgcagaaaagacaattcttttaatcagagttagtacgactcggaccgatg

SEQ ID NO: 14073 - DNA, 203 bp, Homo sapiens
  source 1..203: mol_type = other DNA
ggcgcgccagtcctctcagagattgctgcatttcccacacggccataatgttactcccagccaatagaaagtgagcttcttgacaagtgccaaaatggcgatgcctaccacctagaactggattgtgcgctccatttctttcacctcaaagctggccgccaccgctgccacctgctcagagtgaaatacgactcggaccgatg

SEQ ID NO: 14074 - DNA, 203 bp, Homo sapiens
  source 1..203: mol_type = other DNA
ggcgcgccagtcctagcagcttttgctgcatttctattggttggcgtttgttactcccagccaatagaaagtgagcccaccccgccatgccaaaatggcgatgcctaccacctagaactggattgtgcgctccatttctttcacctcaaagctggccgccaccgctgccacctgctcagagtgaaatacgactcggaccgatg

SEQ ID NO: 14075 - DNA, 203 bp, Homo sapiens
  source 1..203: mol_type = other DNA
ggcgcgccagtcctctgcaatattgctgcatttctattggttggcgtttgttactcccagccaatagaaagtgagcttcttgacaagtgccaaaatggcgatgcctaccacctagaactggattgtgcgctctcgacagaggtgtccaaagctggccgccaccgctgccacctgctcagagtgaaatacgactcggaccgatg

SEQ ID NO: 14076 - DNA, 203 bp, Homo sapiens
  source 1..203: mol_type = other DNA
ggcgcgccagtcctcggatcgcttgctgcatttctattggttggcgtttgttactcccagccaatagaaagtgagcttcttgacaagtgcttggtcaagccctgctaccacctagaactggattgtgcgctccatttctttcacctcaaagctggccgccaccgctgccacctgctcagagtgaaatacgactcggaccgatg

SEQ ID NO: 14077 - DNA, 203 bp, Homo sapiens
  source 1..203: mol_type = other DNA
ggcgcgccagtcctctctgatcttgcttactctcgccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcccgactcggaccgatg

SEQ ID NO: 14078 - DNA, 203 bp, Homo sapiens
  source 1..203: mol_type = other DNA
ggcgcgccagtcctgattcgccttggacaaatcaaaattataatttggttcagggcctccctccagcgacggccgaactgggctagccatgcccatagtaggactagcaaaacggagggactagccatagtggcgagctccctgggatcaaccgtggtctagtacaggacagtcgtcagtagttcgaccgactcggaccgatg

SEQ ID NO: 14079 - DNA, 203 bp, Homo sapiens
  source 1..203: mol_type = other DNA
ggcgcgccagtcctcgatagatttggacaaatcaaaattataatttggttcagggcctccctccagcgacggccgaactgggctagccatgcccatagtaggactagcaaaacggagggactagccatagtggcgagctccctgggtggtctaagtcctgagtacaggacagtctggttccaactctgcgactcggaccgatg

SEQ ID NO: 14080 - DNA, 203 bp, Homo sapiens
  source 1..203: mol_type = other DNA
ggcgcgccagtcctatccactattggacaaatcaaaattataatttggttcagggcctccctccagcgacggccgaactgggctagccatgcccatagtaggactagcaaaacggagggactagccatagtggcgagctccctgggtggtctaagtcctgcagtttaattgtatgtcagtagttcgaccgactcggaccgatg

SEQ ID NO: 14081 - DNA, 203 bp, Homo sapiens
  source 1..203: mol_type = other DNA
ggcgcgccagtcctttcatcgcttggacaaatcaaaattataatttggttcagggcctccctccagcgacggccgaactgggctagccatgcccatagtaggactagcaaaacggaggttgagctggaccgtgcgagctccctgggtggtctaagtcctgagtacaggacagtcgtcagtagttcgaccgactcggaccgatg

SEQ ID NO: 14082 - DNA, 203 bp, Homo sapiens
  source 1..203: mol_type = other DNA
ggcgcgccagtcctaggtaactttggagagttattgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcgactcggaccgatg

SEQ ID NO: 14083 - DNA, 203 bp, Homo sapiens
  source 1..203: mol_type = other DNA
ggcgcgccagtcctgcattgtattggagtgaatgggaccccaggcagcagcgagtgacaggacgtctggacccgcgcgccgctagcagctctgccgggccgcggcggtgatcgatggggagcggctggagcggacccagcgagtgagggcgcacagccgggacgccgaggcggcgggcgggagacccgcgactcggaccgatg

SEQ ID NO: 14084 - DNA, 203 bp, Homo sapiens
  source 1..203: mol_type = other DNA
ggcgcgccagtcctaatcacttttggatctttggcctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 14085 - DNA, 203 bp, Homo sapiens
  source 1..203: mol_type = other DNA
ggcgcgccagtcctacaagcgcttgggagcgccagttccgtctgtgtgttcgagtggacaaaatggcgaagatcgccaagactcacgaagatattgaagcacagattcgagaaattcaaggcaagaaggcagaatccatgcttcggcaaggagtgggcctcgattctacaggttattatgaccaggaacgactcggaccgatg

SEQ ID NO: 14086 - DNA, 203 bp, Homo sapiens
  source 1..203: mol_type = other DNA
ggcgcgccagtccttctctgagttgggagcgccagttccgtctgtgtgttcgagtggacaaaatggcgaagatcgccaagactcacgaagatattgaagcacagattcgagaaattcaaggcaagaaggcagctcttgatgaagctgttacttatctgggcgattctacaggttattatgaccaggaacgactcggaccgatg

SEQ ID NO: 14087 - DNA, 203 bp, Homo sapiens
  source 1..203: mol_type = other DNA
ggcgcgccagtcctagttcctcttgggagcgccagttccgtctgtgtgttcgagtggacaaaatggcgaagatcgccaagactcacgaagtgtgccctcacttaattcgagaaattcaaggcaagaaggcagctcttgatgaagctcaaggagtgggcctcgattctacaggttattatgaccaggaacgactcggaccgatg

SEQ ID NO: 14088 - DNA, 203 bp, Homo sapiens
  source 1..203: mol_type = other DNA
ggcgcgccagtcctcctggacattgggagcgccagttccgtctgtgtgttcgagtggacaaagcctacgccggtaacaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 14089 - DNA, 203 bp, Homo sapiens
  source 1..203: mol_type = other DNA
ggcgcgccagtcctttacctacttgggcagagggactcttacaatgtagattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagcccgactcggaccgatg

SEQ ID NO: 14090 - DNA, 203 bp, Homo sapiens
  source 1..203: mol_type = other DNA
ggcgcgccagtcctggcacacgttgggcagagggcggggcggcggagggattgcggcggcccgcagcgggataacccaattatgtgtagggtggctccttgcacagcagctgcacgcgccgtggctccggatctcttcgtctttgcagcgtagcccgagtcggtcagcgccggaggacctcagcagcccgactcggaccgatg

SEQ ID NO: 14091 - DNA, 203 bp, Homo sapiens
  source 1..203: mol_type = other DNA
ggcgcgccagtcctcccatttgttgggcagagggcggggcggcggagggattgcggcggcccgcagcgggataaccttgaggctgaggcagtggctccttgcacagcagctgcacgcgccgtggctccggatctcttcgtctttgcagcgtagcccgagtataatcctatgcagggacctcagcagcccgactcggaccgatg

SEQ ID NO: 14092 - DNA, 203 bp, Homo sapiens
  source 1..203: mol_type = other DNA
ggcgcgccagtcctgggccggcttgggcagagggcggggcggcggagggattgcggcggcccgcagcgggataaccttgaggctgaggcagtggctccttgcacagcagctgcacgcgccgtggctccggatctcttcgtctttgcgtaaactgtacccgcggtcagcgccggaggacctcagcagcccgactcggaccgatg

SEQ ID NO: 14093 - DNA, 203 bp, Homo sapiens
  source 1..203: mol_type = other DNA
ggcgcgccagtccttggagtagttgggcagagggcggggcggcggagggattgcggcggcccgcagcgggataaccttgaggctgaggcagtggctccttgcacagcagctgcacgcgtaaatttcatttcactcttcgtctttgcagcgtagcccgagtcggtcagcgccggaggacctcagcagcccgactcggaccgatg

SEQ ID NO: 14094 - DNA, 203 bp, Homo sapiens
  source 1..203: mol_type = other DNA
ggcgcgccagtcctgtcgtcaattgggcagagggcggggcggcggagggattgcggcggcccgcagcgggataaccttgaggctgaggcatatcaattggatttagcagctgcacgcgccgtggctccggatctcttcgtctttgcagcgtagcccgagtcggtcagcgccggaggacctcagcagcccgactcggaccgatg

SEQ ID NO: 14095 - DNA, 203 bp, Homo sapiens
  source 1..203: mol_type = other DNA
ggcgcgccagtcctctactgcgttggtgggggagccctgccctcctggacttaataagtgaggcactagaacgatcatgaacttctgaagggacccagctttctttgtgtgctccaagtgatttgcacaaataataatatatatatttattgaaggagagaatcagagcaagtgataatcaagttactcgactcggaccgatg

SEQ ID NO: 14096 - DNA, 203 bp, Homo sapiens
  source 1..203: mol_type = other DNA
ggcgcgccagtccttgggcaacttggttttatttattcctccttcaacaaaagaaagccccagcgctctagagctcagctgacgggaaagggggtgcgcagcctcgagtttgagagctacccggagctccaagacaggggtgggttccagctgcccgcacgccccgaccttccatcgtaggccggacccgactcggaccgatg

SEQ ID NO: 14097 - DNA, 203 bp, Homo sapiens
  source 1..203: mol_type = other DNA
ggcgcgccagtccttggtgtccttggttttatttcaagaagtcgatcaaaaagaaagccccagcgctctagagctcagctgacgggaaagggggtgcgcagcctcgagtttgagagctacccggagctccaaaggtaactgttccaccagctgcccgcacgccccgaccttccatcgtaggccggacccgactcggaccgatg

SEQ ID NO: 14098 - DNA, 203 bp, Homo sapiens
  source 1..203: mol_type = other DNA
ggcgcgccagtcctactccagcttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccacacatccaaatggtcgactcggaccgatg

SEQ ID NO: 14099 - DNA, 203 bp, Homo sapiens
  source 1..203: mol_type = other DNA
ggcgcgccagtccttggcattcttgtattgctcttttttatatgttgttgtactggttgtggttctgcatgttttagtaaatgtcataattgttgtgatgagtatggtggtcatcatgattttgttatcaaaacatctcatgatgattagaatctcttgtcagatctcattaaacgcggttaccgggccgactcggaccgatg

SEQ ID NO: 14100 - DNA, 203 bp, Homo sapiens
  source 1..203: mol_type = other DNA
ggcgcgccagtccttttgaaatttgtggggtagttcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgcgactcggaccgatg

SEQ ID NO: 14101 - DNA, 203 bp, Homo sapiens
  source 1..203: mol_type = other DNA
ggcgcgccagtcctccggctgattgtgttggcaaatcaggcagcgcgtctgattcaattgtgttttacttgtcattatttttttagtaggacattatatcaaccagtttataaaatttttcttgcttaccaagattatatgcaaatagcacctgttccagctgaagtactaaatgtctaaactaaacgcgactcggaccgatg

SEQ ID NO: 14102 - DNA, 203 bp, Homo sapiens
  source 1..203: mol_type = other DNA
ggcgcgccagtcctccaattaattgtgttggcaatgacctttattaaactgattcaattgtggggccaaaccacaaatttttttagtaggacattatatcaaccagtttataaaatttttcttgcttaccaagattatatgcaaatagcacctgttccagctgaagtactaaatgtctaaactaaacgcgactcggaccgatg

SEQ ID NO: 14103 - DNA, 203 bp, Homo sapiens
  source 1..203: mol_type = other DNA
ggcgcgccagtcctccacttggttgtgttggcaatgacctttattaaactgattcaattgtgttttacttgtcattatttttttagtaggacattatatcaaccagtttataaaatttttcttgcttaccaagattatatgcaaatagcacctgttccagagatccctgactgggtctaaactaaacgcgactcggaccgatg

SEQ ID NO: 14104 - DNA, 203 bp, Homo sapiens
  source 1..203: mol_type = other DNA
ggcgcgccagtcctgattgcgtttgttaagagaggcaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactcggaccgatg

SEQ ID NO: 14105 - DNA, 203 bp, Homo sapiens
  source 1..203: mol_type = other DNA
ggcgcgccagtcctagcgaaacttgttagatcttaggccgcatcgctatttataaaaacatccactccctgtaatctatgcttgtgggcgtagatttttcatagtggtgtttatattcatttctgctgttaacagctttcagccagggacgtgttgtatcctaggcagtggcccgcccataggtcacacgactcggaccgatg

SEQ ID NO: 14106 - DNA, 203 bp, Homo sapiens
  source 1..203: mol_type = other DNA
ggcgcgccagtccttccggtcattgttagatctttttgtaatctaaacccatcgtccggtcacactccctgtaatctatgcttgtgggcgtagatttttcatagtggtgtttatattcatttctgctgttaacagctttcagccagggacgtgttgtatcctaggcagtggcccgcccataggtcacacgactcggaccgatg

SEQ ID NO: 14107 - DNA, 203 bp, Homo sapiens
  source 1..203: mol_type = other DNA
ggcgcgccagtccttaaacgcgttgttagatctttttgtaatctaaactttataaaaacatccactccctgtaatctatgcttgtgggcgtagatttttcatagtggtgtttatattcatttctgctgttaacagctttcagccagtattagccaagcagctaggcagtggcccgcccataggtcacacgactcggaccgatg

SEQ ID NO: 14108 - DNA, 203 bp, Homo sapiens
  source 1..203: mol_type = other DNA
ggcgcgccagtcctggaagaacttgtttttcccgcgaaactcggcggctgagcgtggaggttcttgtctcccctggtttgtgaagtgcggaaaaccagaggcgcttgtcgtgatttcatcgacgatcctggcattttctacagcgacagcttcgggggcgacgcccaggccgacgaggggcaggcccgcgactcggaccgatg

SEQ ID NO: 14109 - DNA, 203 bp, Homo sapiens
  source 1..203: mol_type = other DNA
ggcgcgccagtcctaggtccatttgtttttcccgtcgccggtaagacttgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcgactcggaccgatg

SEQ ID NO: 14110 - DNA, 203 bp, Homo sapiens
  source 1..203: mol_type = other DNA
ggcgcgccagtcctttccctggtttaaaaacagaaaatgcaaagttggactgaaaatatccccacaagctgtttttatctgcttaaggcttccaaacttaccttaatttggtaagaaaataagctgccctatttttctttcttcttctcttacaactggaagcagccatttccccaaaccaccaccatcgactcggaccgatg

SEQ ID NO: 14111 - DNA, 203 bp, Homo sapiens
  source 1..203: mol_type = other DNA
ggcgcgccagtcctggccacggtttacttctgtccgacagcgtgacgacgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14112 - DNA, 203 bp, Homo sapiens
  source 1..203: mol_type = other DNA
ggcgcgccagtcctccggtgtatttacttctgtctcgtctgccccaacattcgtggcacaaatgggtaaggcgaggcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14113 - DNA, 203 bp, Homo sapiens
  source 1..203: mol_type = other DNA
ggcgcgccagtcctgggcatcatttacttctgtctcgtctgccccaaccgctagcctcggctgcccgttccacgctcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14114 - DNA, 203 bp, Homo sapiens
  source 1..203: mol_type = other DNA
ggcgcgccagtccttaccgcagtttacttctgtctcgtctgccccaaccgctagcctcggcttgggtaaggcgaggaatttaacccgggagctccgagagcggcagcttcgcgcgcggtgcgctcggcctatgcctgccccgaggggcgtctggtaggcaccccgccctctcccgcagctcgaccccccgactcggaccgatg

SEQ ID NO: 14115 - DNA, 203 bp, Homo sapiens
  source 1..203: mol_type = other DNA
ggcgcgccagtccttaagtctatttacttctgtctcgtctgccccaaccgctagcctcggcttgggtaaggcgaggcggaattaaaccccgctccgagagcggcagcttcgcgcgcggcaattcttagtccggcctgccccgaggggcgtctggtaggcaccccgccctctcccgcagctcgaccccccgactcggaccgatg

SEQ ID NO: 14116 - DNA, 203 bp, Homo sapiens
  source 1..203: mol_type = other DNA
ggcgcgccagtcctcacggatgtttacttctgtctcgtctgccccaaccgctagcctcggcttgggtaaggcgaggcggaattaaaccccgctccgagagcggcagcttcgcgcgcggtgcgctcggcctataaggcttagtccttgcgtctggtaggcaccccgccctctcccgcagctcgaccccccgactcggaccgatg

SEQ ID NO: 14117 - DNA, 203 bp, Homo sapiens
  source 1..203: mol_type = other DNA
ggcgcgccagtccttaaagtaatttacttctgtctcgtctgccccaaccgctagcctcggcttgggtaaggcgaggcggaattaaaccccgctccgagagcggcagcttcgcgcgcggtgcgctcggcctatgcctgccccgagggaaagtaaaggcaacccccgccctctcccgcagctcgaccccccgactcggaccgatg

SEQ ID NO: 14118 - DNA, 203 bp, Homo sapiens
  source 1..203: mol_type = other DNA
ggcgcgccagtccttgcaccggtttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgaccccccgactcggaccgatg

SEQ ID NO: 14119 - DNA, 203 bp, Homo sapiens
  source 1..203: mol_type = other DNA
ggcgcgccagtcctacttgggttttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcagatatgttcggggtgcagctcgaccccccgactcggaccgatg

SEQ ID NO: 14120 - DNA, 203 bp, Homo sapiens
  source 1..203: mol_type = other DNA
ggcgcgccagtcctcgacacagtttacttctgtctcgtctgccccaaccgctagcctcggcttgggtaaggcgaggcggaattaaaccccgctccgagagcggcgatactcaaacatatgcgctcggcctatgcctgccccgaggggcgtctggtaggcaccccgccctctcccgcagctcgaccccccgactcggaccgatg

SEQ ID NO: 14121 - DNA, 203 bp, Homo sapiens
  source 1..203: mol_type = other DNA
ggcgcgccagtcctgcgcccagtttagaagaggataaaagaatcagagctggaatgaaacacacaagaggaccaagtgcctttattccagagaaggaagttgtccaagcaaacacagtggatgaacgtactaactttcttgtggaagaatactctacatccggtcgtctggacaacatcacacaggtccgactcggaccgatg

SEQ ID NO: 14122 - DNA, 203 bp, Homo sapiens
  source 1..203: mol_type = other DNA
ggcgcgccagtcctctgggtcgtttagaattagaatgtttcttagcgggaacccccactcaattatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 14123 - DNA, 203 bp, Homo sapiens
  source 1..203: mol_type = other DNA
ggcgcgccagtccttcaggacgtttagaattagaatgtttcttagcggtcgtgtagttatttttatgtcataagtgccctgccgcgcctatcctataacaaaagtctgttgcttgtgtttcacattttggatttcctaatataatgttctctttttagaaaaggtggacaagtcctattttcaagagacgactcggaccgatg

SEQ ID NO: 14124 - DNA, 203 bp, Homo sapiens
  source 1..203: mol_type = other DNA
ggcgcgccagtcctttctcggctttataacggtcgctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaatgaccctcgactcggaccgatg

SEQ ID NO: 14125 - DNA, 203 bp, Homo sapiens
  source 1..203: mol_type = other DNA
ggcgcgccagtcctctccaacctttatcgaaggaggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggcgactcggaccgatg

SEQ ID NO: 14126 - DNA, 203 bp, Homo sapiens
  source 1..203: mol_type = other DNA
ggcgcgccagtcctgtgcgaattttcaacaccagcgaacggcgacagatcattttggtgggattctcagattggccgcaactggagcccatcctgtttgtctttatttttattttctactccctaactctctttggcaacaccatcatcatcgctctctcctggctagaccttcggctgcacacacctcgactcggaccgatg

SEQ ID NO: 14127 - DNA, 203 bp, Homo sapiens
  source 1..203: mol_type = other DNA
ggcgcgccagtcctagcgcgagtttcaacaccagttttgaagatggcttcattttggtgggattctcagattggccgcaactggagcccaagactagctataggatttttattttctactccctaactctctttggcaacaccatcatcatcgctctctcctggctagaccttcggctgcacacacctcgactcggaccgatg

SEQ ID NO: 14128 - DNA, 203 bp, Homo sapiens
  source 1..203: mol_type = other DNA
ggcgcgccagtcctttatgtgatttcaacaccagttttgaagatggcttcattttggtgggattctcagattggccgcaactggagcccatcctgtttgtctttatttttattttctactccctaactctctaaacttgataatcaatcatcgctctctcctggctagaccttcggctgcacacacctcgactcggaccgatg

SEQ ID NO: 14129 - DNA, 203 bp, Homo sapiens
  source 1..203: mol_type = other DNA
ggcgcgccagtcctatgtgagatttcaacaccagttttgaagatggcttcattttggtgggattctcagattggccgcaactggagcccatcctgtttgtctttatttttattttctactccctaactctctttggcaacaccatcatcatcgctctctcctggctagaccttccctacaggtattgccgactcggaccgatg

SEQ ID NO: 14130 - DNA, 203 bp, Homo sapiens
  source 1..203: mol_type = other DNA
ggcgcgccagtcctctttggcgtttcaacaccagttttgaagatggcttcattttggtgggattctcagattggccgcaactggagcccatcctgtttgtctttatttttattttctactccctaactctctttggcaacaccatcccttattggggtcactggctagaccttcggctgcacacacctcgactcggaccgatg

SEQ ID NO: 14131 - DNA, 203 bp, Homo sapiens
  source 1..203: mol_type = other DNA
ggcgcgccagtcctaattcgtttttcaagggataagaaaccctgcgacaaaacctcctccttttccaagcggctgccgaagatggcggaggtgcaggtcctggtgcttgatggtcgaggccatctcctgggccgcctggcggccatttgacaccttataggaagtacctggctttcctccgcaagcggcgactcggaccgatg

SEQ ID NO: 14132 - DNA, 203 bp, Homo sapiens
  source 1..203: mol_type = other DNA
ggcgcgccagtcctagtattaatttcaagggatagctgggtggtatgtaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggcgactcggaccgatg

SEQ ID NO: 14133 - DNA, 203 bp, Homo sapiens
  source 1..203: mol_type = other DNA
ggcgcgccagtcctggtgtttctttcagcagcagaaagctatgccaagagtttgaaagaaagcaataaaattaacttttcttcattaggactcacagatgaagaaaaagaggctgcagaacactttctaaatgtgagtgacgacagtcaaaatgattatgagtaattaaaaaaggcattaggccacgtcgactcggaccgatg

SEQ ID NO: 14134 - DNA, 203 bp, Homo sapiens
  source 1..203: mol_type = other DNA
ggcgcgccagtcctaggaacggtttcagcagcagaaagctatgccaagagtttgaaagaaagcaataaaattaacttttcttcattaggactcacagatgaagaaaaagaggctgcagtggtaaaatagttagtgagtgacgacagtcaaaatgattatgagtaattaaaaaagtgggacaagtcaaacgactcggaccgatg

SEQ ID NO: 14135 - DNA, 203 bp, Homo sapiens
  source 1..203: mol_type = other DNA
ggcgcgccagtcctcacaagactttcatttgcaagttggagaacgagtatggccggctgacctgctttgccttgctggaccctagatatcacactctgaacaaggtcttgaagcatgaaaaaacaccgctgttccgtaaccaggtcatcattcctctggtgttgtctccagaccgagatgaagatctccgactcggaccgatg

SEQ ID NO: 14136 - DNA, 203 bp, Homo sapiens
  source 1..203: mol_type = other DNA
ggcgcgccagtccttgtcgttttttcatttgcaagttggagaacgagtatggccggctgacctgctttgccttgctttctggacagctgaacactctgaacaaggtcttgaagcatgaaaaaacaccgctgttccgtaaccaggtcggaggcgtcggtaagttgtctccagaccgagatgaagatctccgactcggaccgatg

SEQ ID NO: 14137 - DNA, 203 bp, Homo sapiens
  source 1..203: mol_type = other DNA
ggcgcgccagtcctttagccgatttccacacctggttgctgactaattatccgaagacacaagcatacttctgcctgctggggagcctggggactttccacaccctaactgacacacattccacagctggttctttccgcctcagaaggtacctaaccaagttcctctttcagaggttatttcaggcccgactcggaccgatg

SEQ ID NO: 14138 - DNA, 203 bp, Homo sapiens
  source 1..203: mol_type = other DNA
ggcgcgccagtcctctcccaaatttccacacctggttgctgactaattgagatgcatgctttgcatacttctgcctgctggggagcctggggactttccacacctccctaaggtggggttccacagctggttctttccgcctcagaaggtacctaaccaagttcctctttcagaggttatttcaggcccgactcggaccgatg

SEQ ID NO: 14139 - DNA, 203 bp, Homo sapiens
  source 1..203: mol_type = other DNA
ggcgcgccagtcctgtgtttagtttccacacctgtacatgattactgggagatgcatgctttgcatacttctgcctgctggggagcctggggactttccacaccctaactgacacacattccacagctggttctttccgcctcagaaggtacctaaccaagttcctctttcagaggttatttcaggcccgactcggaccgatg

SEQ ID NO: 14140 - DNA, 203 bp, Homo sapiens
  source 1..203: mol_type = other DNA
ggcgcgccagtcctatgggctgtttctgatcagttaccaatctgtacatcaacacacaacaccaacagaagaccaacaaacaaaccaactcacccatccaaccaaacatctatacgccaatcagccaatccaaaactagccacccggaaaaaatagatactatagttacaaaaactatgcttatccgacgactcggaccgatg

SEQ ID NO: 14141 - DNA, 203 bp, Homo sapiens
  source 1..203: mol_type = other DNA
ggcgcgccagtcctggaggcagtttgcaattttaagccagtgtttgggtttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggcgactcggaccgatg

SEQ ID NO: 14142 - DNA, 203 bp, Homo sapiens
  source 1..203: mol_type = other DNA
ggcgcgccagtcctctttaagctttgcaattttatattttgcaaatattttgagagacattgatttttctccccgtgctcccccgttcttccctgcggagtgcgctgcgccgcccagctaacaacaaaaatcgaggtgatccctccctcctgcctgcccgccagcctgacctgtgcccggctcgcgggcgactcggaccgatg

SEQ ID NO: 14143 - DNA, 203 bp, Homo sapiens
  source 1..203: mol_type = other DNA
ggcgcgccagtcctaggcgtactttgcaattttatattttgcaaatattttgagagacattgatttttctccccgtgctcccccgttcttccctgcggagtgcggaaacttagtggttcctgtcgccccccggaggtgatccctccctcctgcctgcccgccagcctgacctgtgcccggctcgcgggcgactcggaccgatg

SEQ ID NO: 14144 - DNA, 203 bp, Homo sapiens
  source 1..203: mol_type = other DNA
ggcgcgccagtcctccgggccctttgcctgctgccttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatcgactcggaccgatg

SEQ ID NO: 14145 - DNA, 203 bp, Homo sapiens
  source 1..203: mol_type = other DNA
ggcgcgccagtcctttcgtctgtttgccttggttaagccccatagaaacgaggcgtcacgtgccgaaaatccctttgcgtttcacagaaccatcctaaccatgggtgtagtatgggaactacaagccccttagattaggatctctcgtagagggataggtgtgccattcaaatccagggagtactctgcgactcggaccgatg

SEQ ID NO: 14146 - DNA, 203 bp, Homo sapiens
  source 1..203: mol_type = other DNA
ggcgcgccagtcctgacggcggtttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 14147 - DNA, 203 bp, Homo sapiens
  source 1..203: mol_type = other DNA
ggcgcgccagtcctcaggaaattttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatctcacatactggacccgactcggaccgatg

SEQ ID NO: 14148 - DNA, 203 bp, Homo sapiens
  source 1..203: mol_type = other DNA
ggcgcgccagtccttatgcttctttgccttggttaagccccatagaaacgaggcgtcacgtggattcttcagggccgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 14149 - DNA, 203 bp, Homo sapiens
  source 1..203: mol_type = other DNA
ggcgcgccagtcctgtgtgctatttgccttggttttagtatggtatctcgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctgcgactcggaccgatg

SEQ ID NO: 14150 - DNA, 203 bp, Homo sapiens
  source 1..203: mol_type = other DNA
ggcgcgccagtcctcaagttgatttgcttctcactttacattacgtaggtcatcggagcatgatagtaataattttggtgttgtaactagttttactacttatggtaatactgtttctgaggctgtgtctagattagttgaatcagcttctgaatttattgtttggcgtgcagaggcacttaataagtcgactcggaccgatg

SEQ ID NO: 14151 - DNA, 203 bp, Homo sapiens
  source 1..203: mol_type = other DNA
ggcgcgccagtccttgaatgtatttgcttctcactttacattacgtagtcacgatatttcccatagtaataattttggtgttgtaactagacaggactaagtgcgtaatactgtttctgaggctgtgtctagattagttgaatcagcttctgaatttattgtttggcgtgcagaggcacttaataagtcgactcggaccgatg

SEQ ID NO: 14152 - DNA, 203 bp, Homo sapiens
  source 1..203: mol_type = other DNA
ggcgcgccagtcctcgataacgtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactccgactcggaccgatg

SEQ ID NO: 14153 - DNA, 203 bp, Homo sapiens
  source 1..203: mol_type = other DNA
ggcgcgccagtcctgccgccactttgtctttactaggccaccgtctcgtcagcgttacggagtattttgtccgcctgccgccgccgtcccagatattaatcacggagttccagggagaaggaacttgtgaaatgggggagccggctggggttgccggcacgccacttatcgagattagcccgggactccgactcggaccgatg

SEQ ID NO: 14154 - DNA, 203 bp, Homo sapiens
  source 1..203: mol_type = other DNA
ggcgcgccagtcctccaacggctttgtctttactctcagtatccaaactcagcgttacggagtattttgtccgcctgccgccgccgtcccagatattaatcacggagttccagggagaaggaacttgtgaaatgggggagccggctggggttgccggcaccatggagtcaccttttagcccgggactccgactcggaccgatg

SEQ ID NO: 14155 - DNA, 203 bp, Homo sapiens
  source 1..203: mol_type = other DNA
ggcgcgccagtcctaacattggtttgtgtgtttggactagcggcaccatttgttcgtcacttgtcgacagcgccctgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 14156 - DNA, 203 bp, Homo sapiens
  source 1..203: mol_type = other DNA
ggcgcgccagtccttgttgtaatttgtgtgtttgtttgttaccttgtgagacaattaacaaggtcgacagcgccctgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 14157 - DNA, 203 bp, Homo sapiens
  source 1..203: mol_type = other DNA
ggcgcgccagtcctggtttcggtttgtgtgtttgtttgttaccttgtgtttgttcgtcacttcgtttgtaacaatcgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 14158 - DNA, 203 bp, Homo sapiens
  source 1..203: mol_type = other DNA
ggcgcgccagtcctttattcggtttgtgtgtttgtttgttaccttgtgtttgttcgtcacttgtcgacagcgccctgcgaattggtgtacccacaccgcgcggcgatgtgggctcggcttggagagtcttttgcctccagtgtcttccgtttgtactcgtcctcctctccctctccggccgggatgggcgactcggaccgatg

SEQ ID NO: 14159 - DNA, 203 bp, Homo sapiens
  source 1..203: mol_type = other DNA
ggcgcgccagtccttcgagagatttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtaacatgtcgaggtcccggccgggatgggcgactcggaccgatg

SEQ ID NO: 14160 - DNA, 203 bp, Homo sapiens
  source 1..203: mol_type = other DNA
ggcgcgccagtcctgaaagctgtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctcttgtaaacaagcccacgactcggaccgatg

SEQ ID NO: 14161 - DNA, 203 bp, Homo sapiens
  source 1..203: mol_type = other DNA
ggcgcgccagtcctcatttaaatttgtgtgtttgtttgttaccttgtgtttgttcgtcacttgtcgacagcgccctgcgaattggtgtacccacaccgcgcggcttgcgaataatactttggagagtcttttgcctccagtgtcttgtaaagcctacgagcctcctctccctctccggccgggatgggcgactcggaccgatg

SEQ ID NO: 14162 - DNA, 203 bp, Homo sapiens
  source 1..203: mol_type = other DNA
ggcgcgccagtcctaatcgaactttgttcaccacatcagtcaccctttattctggtcccatgcgtcctctgcccaagaaacacgtagaacccatggcagtgcgacagctgcttcttggcaactccaccatgatcaggcacacttgtcccatgtctgtcccgttgagccggcaagtcaaggaagttgctcgactcggaccgatg

SEQ ID NO: 14163 - DNA, 203 bp, Homo sapiens
  source 1..203: mol_type = other DNA
ggcgcgccagtccttcattccttttgttcaccaccattcctggtgcccattctggtcccatgatagagagtgaagcgaaacacgtagaacccatggcagtgcgacagctgcttcttggcaactccaccatgatcaggcacacttgtcccatgtctgtcccgttgagccggcaagtcaaggaagttgctcgactcggaccgatg

SEQ ID NO: 14164 - DNA, 203 bp, Homo sapiens
  source 1..203: mol_type = other DNA
ggcgcgccagtcctgtaaaccgtttgttcaccaccattcctggtgcccattctggtcccatgcgtcctctgcccaagaaacacgtagaacccatggcagtgcgaagcacctgagactacaactccaccatgatcaggcacacttgtcccatgtctgtcccgttgagccggcaagtcaaggaagttgctcgactcggaccgatg

SEQ ID NO: 14165 - DNA, 203 bp, Homo sapiens
  source 1..203: mol_type = other DNA
ggcgcgccagtccttctcagtctttgttcaccaccattcctggtgcccattctggtcccatgcgtcctctgcccaagaaacacgtagaacccatggcagtgcgacagctgcttcttggcaactccaccatgatcaggcacacttgtttgtccctgaaaaggttgagccggcaagtcaaggaagttgctcgactcggaccgatg

SEQ ID NO: 14166 - DNA, 203 bp, Homo sapiens
  source 1..203: mol_type = other DNA
ggcgcgccagtcctcgaagatgtttgttcaccaccattcctggtgcccattctggtcccatgcgtcctctgcccaagaaacacgtagaacccatggcagtgcgacagctgcttcttggtggacggggacgcttcaggcacacttgtcccatgtctgtcccgttgagccggcaagtcaaggaagttgctcgactcggaccgatg

SEQ ID NO: 14167 - DNA, 203 bp, Homo sapiens
  source 1..203: mol_type = other DNA
ggcgcgccagtccttcctcttatttgttcaccaccattcctggtgcccattctggtcccatgcgtcctctgcccaatttggttcctacttccatggcagtgcgacagctgcttcttggcaactccaccatgatcaggcacacttgtcccatgtctgtcccgttgagccggcaagtcaaggaagttgctcgactcggaccgatg

SEQ ID NO: 14168 - DNA, 203 bp, Homo sapiens
  source 1..203: mol_type = other DNA
ggcgcgccagtccttgatggcgtttgttcaccaccattcctggtgccccggagtaagttcgccgtcctctgcccaagaaacacgtagaacccatggcagtgcgacagctgcttcttggcaactccaccatgatcaggcacacttgtcccatgtctgtcccgttgagccggcaagtcaaggaagttgctcgactcggaccgatg

SEQ ID NO: 14169 - DNA, 203 bp, Homo sapiens
  source 1..203: mol_type = other DNA
ggcgcgccagtcctagtcatctttttacagatatgtctgctatgtggggacgataagtcgagttccccgggataagcctcactcgtcccctctcggggggcggaacacccacctgctagccccgctgctctctttgctttcctcctcgcttcggtctcccccaactcctagcatcccctcctatcgctcgactcggaccgatg

SEQ ID NO: 14170 - DNA, 203 bp, Homo sapiens
  source 1..203: mol_type = other DNA
ggcgcgccagtccttgtaattattttacttctgaacgaaatggagaaagatcgggtagtaggcttcagacttgaacaagaaactgggtctcactatgttgcccaggttgatattgaactcctggactcaagcaaccctccctctttggcctctgaaagtactgggattacaagcataagccaccgggccgactcggaccgatg

SEQ ID NO: 14171 - DNA, 203 bp, Homo sapiens
  source 1..203: mol_type = other DNA
ggcgcgccagtcctacatctgcttttagatttaagtaagtttgaatgtaaacataaagccactgttgttgttacaccagctcgcgccctcgtaaatgatatggttttgagtttgattaagagtggtaggttgttgttacgcaataatggtcgttttggtggttttagtaatcatttagtctcaactaacgactcggaccgatg

SEQ ID NO: 14172 - DNA, 203 bp, Homo sapiens
  source 1..203: mol_type = other DNA
ggcgcgccagtcctaagaatgcttttagatttaagtaagtttgaatgtaaacataaagccactgttgttgttacacttaaagatagtgatgtaaatgatatggttttgagtttgattaagagtggtaggttgttgttacgcaataagctcgtgaagttccgttttagtaatcatttagtctcaactaacgactcggaccgatg

SEQ ID NO: 14173 - DNA, 203 bp, Homo sapiens
  source 1..203: mol_type = other DNA
ggcgcgccagtcctcgtggttattttagatttaagtaagtttgaatgtaaacataaagccactgttgttgttacacttaaagatagtgatgtaaatgatatggttttgagtttgattattctcccaccagacttgttacgcaataatggtcgttttggtggttttagtaatcatttagtctcaactaacgactcggaccgatg

SEQ ID NO: 14174 - DNA, 203 bp, Homo sapiens
  source 1..203: mol_type = other DNA
ggcgcgccagtccttcatagtgttttataataatcgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagcgactcggaccgatg

SEQ ID NO: 14175 - DNA, 203 bp, Homo sapiens
  source 1..203: mol_type = other DNA
ggcgcgccagtccttaacgcccttttgaagtattatttttatgaatcaagccctggaaaaggacaagatatttgaaatgctctcgtaaagtaatggagaacttcacagttgctactcctgtgataggtttatcttagtttcattgtggtataaatggaatagcaggtgttgtcaggtacaaggtttgtcgactcggaccgatg

SEQ ID NO: 14176 - DNA, 203 bp, Homo sapiens
  source 1..203: mol_type = other DNA
ggcgcgccagtcctgaggcaccttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtcgactcggaccgatg

SEQ ID NO: 14177 - DNA, 203 bp, Homo sapiens
  source 1..203: mol_type = other DNA
ggcgcgccagtcctcaccaaggttttgaagtattatttttatgaatcaagccctggaaaaggcgccaggccccttctgaaatagcacccataatggagaacttcacagttgctactcctgtgataggtttatcttagtttcattgtggtataaatggaatagcaggtgttgtcaggtacaaggtttgtcgactcggaccgatg

SEQ ID NO: 14178 - DNA, 203 bp, Homo sapiens
  source 1..203: mol_type = other DNA
ggcgcgccagtcctttgtcaccttttgaagtattccgcaacaagcaacagccctggaaaaggacaagatatttgaatgaaatagcacccataatggagaacttcacagttgctactcctgtgataggtttatcttagtttcattgtggtataaatggaatagcaggtgttgtcaggtacaaggtttgtcgactcggaccgatg

SEQ ID NO: 14179 - DNA, 203 bp, Homo sapiens
  source 1..203: mol_type = other DNA
ggcgcgccagtcctgctcagcttttttcatctaacctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgacgactcggaccgatg

SEQ ID NO: 14180 - DNA, 203 bp, Homo sapiens
  source 1..203: mol_type = other DNA
ggcgcgccagtcctaggctcttctaacaatttccggcgggtgagattttcccggcgggtattctatagccggcgggtggcaaaataccggcgggttaggaggagccggcgggtgaacaaattccggcgggttacatttagccggcgggtatgaaaattccggcgggtaatgtatatccggcgggttttcgactcggaccgatg

SEQ ID NO: 14181 - DNA, 203 bp, Homo sapiens
  source 1..203: mol_type = other DNA
ggcgcgccagtcctagtaaagttgagaaaaacaccggccgtcattaagaaaccggccgtttcgtagtgaccggccgttggaaggagaccggccgtttcagcttgaccggccgtttgttacttaccggccgttttttgaaaaccggccgtacaaggtagaccggccgtatatccaaaaccggccgtgatcgactcggaccgatg

SEQ ID NO: 14182 - DNA, 203 bp, Homo sapiens
  source 1..203: mol_type = other DNA
ggcgcgccagtcctagctctgtatagaaaaactatgaagaacattaagaagatctttctttcgtagtgttcttttactggaaggagtactcccatttcagcttgtactcccaattgttactttactccccctttttgaaatactcccacacaaggtagtactcccttatatccaaatactcccttgatcgactcggaccgatg

SEQ ID NO: 14183 - DNA, 203 bp, Homo sapiens
  source 1..203: mol_type = other DNA
ggcgcgccagtccttgacgattctagaaaaactatgaagaacattaagaagatctttctttcgtagtgttcttttactggaaggagtattccaatttcagcttgttggattaattgttacttaaattgtcctttttgaaaccggcgggtacaaggtagccggcgggtatatccaaaccggcgggtgatcgactcggaccgatg

SEQ ID NO: 14184 - DNA, 203 bp, Homo sapiens
  source 1..203: mol_type = other DNA
ggcgcgccagtcctaggcttacaaagaaaaactatgaagaacattaagaagatctttctttcgtagtgttcttttactggaaggagtattccaatttcagcttgttggattaattgttacttaaattgtcctttttgaaattaattcacacaaggtagccggcgggtatatccaaaccggcgggtgatcgactcggaccgatg

SEQ ID NO: 14185 - DNA, 203 bp, Homo sapiens
  source 1..203: mol_type = other DNA
ggcgcgccagtcctacttaagcctagaaaaactatgaagaacattaagaagatctttctttcgtagtgttcttttactggaaggagtattccaatttcagcttgttggattaattgttacttaaattgtcctttttgaaattaattcacacaaggtagcgtcaattcctttacaaaataaattttgatcgactcggaccgatg

SEQ ID NO: 14186 - DNA, 203 bp, Homo sapiens
  source 1..203: mol_type = other DNA
ggcgcgccagtccttggtgagccaagaaaaactatgaagaacattaagaagatctttctttcgtagtgttcttttactggaaggagtattccaatttcagcttgttggattaattgttacttaaattgtcctttttgaaattaattcacacaaggtagtactcccttatatccaaatactcccttgatcgactcggaccgatg

SEQ ID NO: 14187 - DNA, 203 bp, Homo sapiens
  source 1..203: mol_type = other DNA
ggcgcgccagtccttagtttgcaaagaaaaactatgaagaacattaagaagatctttctttcgtagtgttcttttactggaaggagtattccaatttcagcttgttggattaattgttacttaaattgtcctttttgaaattaattcacacaaggtagtttaaatttatatccaaattcttggcaaatcgactcggaccgatg

SEQ ID NO: 14188 - DNA, 203 bp, Homo sapiens
  source 1..203: mol_type = other DNA
ggcgcgccagtcctaacgaaagagagacagggaacctgagcaaccaggcaaagaagacacctagggatcgtcaattcctttaagaccgtcaattcctttaataccgtcaattcctttaccatcgtcaattcctttatccccgtcaattcctttacagacgtcaattcctttaagccctagataactagcgactcggaccgatg

SEQ ID NO: 14189 - DNA, 203 bp, Homo sapiens
  source 1..203: mol_type = other DNA
ggcgcgccagtcctaacagacagtagacagggaacctgagcaaccaggcaaagaagacacctagggatggaagacctccactagacaaagaccagtgcgcataccacggaatcgagaaccatcacggaatcgagaatccccacggaatcgagaacagacacggaatcgagaaagccctagataactagcgactcggaccgatg

SEQ ID NO: 14190 - DNA, 203 bp, Homo sapiens
  source 1..203: mol_type = other DNA
ggcgcgccagtccttgtaaaccgtagacagggaacctgagcaaccaggcaaagaagacacctagggatggaagacctccactagacaaagaccagtgcgcatactactcccagaagggccattactcccgagaatgtccctactcccaacacgtcagatactcccaggttctagcctactcccactagcgactcggaccgatg

SEQ ID NO: 14191 - DNA, 203 bp, Homo sapiens
  source 1..203: mol_type = other DNA
ggcgcgccagtcctctaagattctagacagggaacctgagcaaccaggcaaagaagacacctagggatggaagacctccactagacaaagaccagtgcgcatactgtaaagagaagggccattgggcaagagaatgtcccccggcgggtcacgtcagaccggcgggtgttctagccccggcgggttagcgactcggaccgatg

SEQ ID NO: 14192 - DNA, 203 bp, Homo sapiens
  source 1..203: mol_type = other DNA
ggcgcgccagtcctaccaacctttagacagggaacctgagcaaccaggcaaagaagacacctagggatggaagacctccactagacaaagaccagtgcgcatactgtaaagagaagggccattgggcaagagaatgtccccgaaaaaaacacgtcagaccggcgggtgttctagccccggcgggttagcgactcggaccgatg

SEQ ID NO: 14193 - DNA, 203 bp, Homo sapiens
  source 1..203: mol_type = other DNA
ggcgcgccagtccttacaaaggttagacagggaacctgagcaaccaggcaaagaagacacctagggatggaagacctccactagacaaagaccagtgcgcatactgtaaagagaagggccattgggcaagagaatgtccccgaaaaaaacacgtcagagaagccaaggttctagccctagataactagcgactcggaccgatg

SEQ ID NO: 14194 - DNA, 203 bp, Homo sapiens
  source 1..203: mol_type = other DNA
ggcgcgccagtccttagtcagactagacagggaacctgagcaaccaggcaaagaagacacctagggatggaagacctccactagacaaagaccagtgcgcatactgtaaagagaagggccattgggcaagagaatgtccctactcccaacacgtcagatactcccaggttctagcctactcccactagcgactcggaccgatg

SEQ ID NO: 14195 - DNA, 203 bp, Homo sapiens
  source 1..203: mol_type = other DNA
ggcgcgccagtcctcagctgaggtagacagggaacctgagcaaccaggcaaagaagacacctagggatggaagacctccactagacaaagaccagtgcgcatactgtaaagagaagggccattgggcaagagaatgtcccttcttggcaaacgtcagattcttggcaaatctagccttcttggcaaagcgactcggaccgatg

SEQ ID NO: 14196 - DNA, 203 bp, Homo sapiens
  source 1..203: mol_type = other DNA
ggcgcgccagtccttgcttaagcaagacagggaacctgagcaaccaggcaaagaagacacctagggatggaagacctccactagacaccggccgttgcgcatacaccggccgtaagggccataccggccgtgaatgtcccaccggccgtcacgtcagaaccggccgtgttctagccaccggccgttagcgactcggaccgatg

SEQ ID NO: 14197 - DNA, 203 bp, Homo sapiens
  source 1..203: mol_type = other DNA
ggcgcgccagtcctaaccttcttgagacagggaacctgagcaaccaggcaaagaagacacctagggatggaagacctccactagacccggcgggttgcgcatacccggcgggtaagggccatccggcgggtgaatgtcccccggcgggtcacgtcagaccggcgggtgttctagccccggcgggttagcgactcggaccgatg

SEQ ID NO: 14198 - DNA, 203 bp, Homo sapiens
  source 1..203: mol_type = other DNA
ggcgcgccagtcctaatggtagttagacagggaacctgagcaaccaggcaaagaagacacctagggatggaagacctccactagaccgtcaattcctttaataccgtcaattcctttaccatcgtcaattcctttatccccgtcaattcctttacagacgtcaattcctttaagccctagataactagcgactcggaccgatg

SEQ ID NO: 14199 - DNA, 203 bp, Homo sapiens
  source 1..203: mol_type = other DNA
ggcgcgccagtccttaacagagttagacagggaacctgagcaaccaggcaaagaagacacctagggatggaagacctccactagacttcttggcaaacgcatacttcttggcaaagggccatttcttggcaaaatgtcccttcttggcaaacgtcagattcttggcaaatctagccttcttggcaaagcgactcggaccgatg

SEQ ID NO: 14200 - DNA, 203 bp, Homo sapiens
  source 1..203: mol_type = other DNA
ggcgcgccagtcctcactagcttaagacagggaacctgagcaaccaggcatactccccacctagggattactcccctccactagactactcccagtgcgcatactactcccagaagggccattactcccgagaatgtccctactcccaacacgtcagatactcccaggttctagcctactcccactagcgactcggaccgatg

SEQ ID NO: 14201 - DNA, 203 bp, Homo sapiens
  source 1..203: mol_type = other DNA
ggcgcgccagtccttagcttgctgagacagggaacctgagcaaccaggcattcttggcaaatagggatttcttggcaaaactagacttcttggcaaacgcatacttcttggcaaagggccatttcttggcaaaatgtcccttcttggcaaacgtcagattcttggcaaatctagccttcttggcaaagcgactcggaccgatg

SEQ ID NO: 14202 - DNA, 203 bp, Homo sapiens
  source 1..203: mol_type = other DNA
ggcgcgccagtcctcaggactcgtagacagggccggcgggtaaccaggcaccggcgggtcctagggatccggcgggtccactagacccggcgggttgcgcatacccggcgggtaagggccatccggcgggtgaatgtcccccggcgggtcacgtcagaccggcgggtgttctagccccggcgggttagcgactcggaccgatg

SEQ ID NO: 14203 - DNA, 203 bp, Homo sapiens
  source 1..203: mol_type = other DNA
ggcgcgccagtcctcagactgctgagacagggcgtcaattcctttaggcacgtcaattcctttaggatcgtcaattcctttaagaccgtcaattcctttaataccgtcaattcctttaccatcgtcaattcctttatccccgtcaattcctttacagacgtcaattcctttaagccctagataactagcgactcggaccgatg

SEQ ID NO: 14204 - DNA, 203 bp, Homo sapiens
  source 1..203: mol_type = other DNA
ggcgcgccagtccttgcagtagctagacagggtactcccgcaaccaggcatactccccacctagggattactcccctccactagactactcccagtgcgcatactactcccagaagggccattactcccgagaatgtccctactcccaacacgtcagatactcccaggttctagcctactcccactagcgactcggaccgatg

SEQ ID NO: 14205 - DNA, 203 bp, Homo sapiens
  source 1..203: mol_type = other DNA
ggcgcgccagtcctagactgtgctagacagggttcttggcaaaccaggcattcttggcaaatagggatttcttggcaaaactagacttcttggcaaacgcatacttcttggcaaagggccatttcttggcaaaatgtcccttcttggcaaacgtcagattcttggcaaatctagccttcttggcaaagcgactcggaccgatg

SEQ ID NO: 14206 - DNA, 203 bp, Homo sapiens
  source 1..203: mol_type = other DNA
ggcgcgccagtcctaaaactctcaagcagccgcacggaatcgagaacacacacggaatcgagaaaagccacggaatcgagaatgtgcacggaatcgagaattcccacggaatcgagaatgcgcacggaatcgagaaaaagcacggaatcgagaaacaccacggaatcgagaatgcagcatgtcttcaacgactcggaccgatg

SEQ ID NO: 14207 - DNA, 203 bp, Homo sapiens
  source 1..203: mol_type = other DNA
ggcgcgccagtcctagtagctaaaagcagccgcgtcaattcctttacacacgtcaattcctttaaagccgtcaattcctttatgtgcgtcaattcctttattcccgtcaattcctttatgcgcgtcaattcctttaaaagcgtcaattcctttaacaccgtcaattcctttatgcagcatgtcttcaacgactcggaccgatg

SEQ ID NO: 14208 - DNA, 203 bp, Homo sapiens
  source 1..203: mol_type = other DNA
ggcgcgccagtcctcaactgctaaagcagccgggaacagctctgaccacacacggaatcgagaaaagccacggaatcgagaatgtgcacggaatcgagaattcccacggaatcgagaatgcgcacggaatcgagaaaaagcacggaatcgagaaacaccacggaatcgagaatgcagcatgtcttcaacgactcggaccgatg

SEQ ID NO: 14209 - DNA, 203 bp, Homo sapiens
  source 1..203: mol_type = other DNA
ggcgcgccagtcctaatggactggagcagccgggaacagctctgaccacacgtcaattcctttaaagccgtcaattcctttatgtgcgtcaattcctttattcccgtcaattcctttatgcgcgtcaattcctttaaaagcgtcaattcctttaacaccgtcaattcctttatgcagcatgtcttcaacgactcggaccgatg

SEQ ID NO: 14210 - DNA, 203 bp, Homo sapiens
  source 1..203: mol_type = other DNA
ggcgcgccagtcctatgaggactgagcagccgggaacagctctgaccacagtggttccggggagaagccacggaatcgagaatgtgcacggaatcgagaattcccacggaatcgagaatgcgcacggaatcgagaaaaagcacggaatcgagaaacaccacggaatcgagaatgcagcatgtcttcaacgactcggaccgatg

SEQ ID NO: 14211 - DNA, 203 bp, Homo sapiens
  source 1..203: mol_type = other DNA
ggcgcgccagtccttaactggactagcagccgggaacagctctgaccacagtggttccggggagaagccgtcaattcctttatgtgcgtcaattcctttattcccgtcaattcctttatgcgcgtcaattcctttaaaagcgtcaattcctttaacaccgtcaattcctttatgcagcatgtcttcaacgactcggaccgatg

SEQ ID NO: 14212 - DNA, 203 bp, Homo sapiens
  source 1..203: mol_type = other DNA
ggcgcgccagtccttcgctacgttagcagccgggaacagctctgaccacagtggttccggggagaagcctttccaggacccatgtgtaggcacaactgttttccctgatcaggatacttgcggcactcaacagaggaaagaaattcctaagggaacacccggcgggtagtactgcaccggcgggtcaacgactcggaccgatg

SEQ ID NO: 14213 - DNA, 203 bp, Homo sapiens
  source 1..203: mol_type = other DNA
ggcgcgccagtcctttaaagtgtaagcagccgggaacagctctgaccacagtggttccggggagaagcctttccaggacccatgtgtaggcacaactgttttccctgatcaggatacttgcggcactcaacagaggaaagaaattcctaagggaacacttcttggcaaatactgcattcttggcaaaacgactcggaccgatg

SEQ ID NO: 14214 - DNA, 203 bp, Homo sapiens
  source 1..203: mol_type = other DNA
ggcgcgccagtcctacgttcaagtagcagccgggaacagctctgaccacagtggttccggggagaagcctttccaggacccatgtgtaggcacaactgttttccctgatcaggatacttgcggcactcaacagaggaaagcacggaatcgagaaacaccacggaatcgagaatgcagcatgtcttcaacgactcggaccgatg

SEQ ID NO: 14215 - DNA, 203 bp, Homo sapiens
  source 1..203: mol_type = other DNA
ggcgcgccagtcctatggatacaaagcagccgggaacagctctgaccacagtggttccggggagaagcctttccaggacccatgtgtaggcacaactgttttccctgatcaggatacttgcggcactcaacagaggaaagcgtcaattcctttaacaccgtcaattcctttatgcagcatgtcttcaacgactcggaccgatg

SEQ ID NO: 14216 - DNA, 203 bp, Homo sapiens
  source 1..203: mol_type = other DNA
ggcgcgccagtccttgtgcagtgtagcagccgggaacagctctgaccacagtggttccggggagaagcctttccaggacccatgtgtaggcacaactgttttccctgatcaggatacttgcggcactcaacagaggaaagtactccctaagggaacactactcccaaagtactgcatactcccttcaacgactcggaccgatg

SEQ ID NO: 14217 - DNA, 203 bp, Homo sapiens
  source 1..203: mol_type = other DNA
ggcgcgccagtccttaaggttaggagcagccgggaacagctctgaccacattcttggcaaagagaagcttcttggcaaaccatgtgttcttggcaaagttttccttcttggcaaaacttgcgttcttggcaaaaggaaagttcttggcaaaggaacacttcttggcaaatactgcattcttggcaaaacgactcggaccgatg

SEQ ID NO: 14218 - DNA, 203 bp, Homo sapiens
  source 1..203: mol_type = other DNA
ggcgcgccagtcctttgcaaaaggagcagccgtactcccctctgaccacatactccccggggagaagctactcccggacccatgtgtactcccaactgttttcctactcccggatacttgcgtactcccacagaggaaagtactccctaagggaacactactcccaaagtactgcatactcccttcaacgactcggaccgatg

SEQ ID NO: 14219 - DNA, 203 bp, Homo sapiens
  source 1..203: mol_type = other DNA
ggcgcgccagtcctacatggtaggagcagccgttcttggcaaagaccacattcttggcaaagagaagcttcttggcaaaccatgtgttcttggcaaagttttccttcttggcaaaacttgcgttcttggcaaaaggaaagttcttggcaaaggaacacttcttggcaaatactgcattcttggcaaaacgactcggaccgatg

SEQ ID NO: 14220 - DNA, 203 bp, Homo sapiens
  source 1..203: mol_type = other DNA
ggcgcgccagtccttagctaagtgagcctcctcacggaatcgagaacctacacggaatcgagaaaggacacggaatcgagaattaacacggaatcgagaagagccacggaatcgagaacaagcacggaatcgagaaccctcacggaatcgagaacaatcacggaatcgagaatgaccagtcacagattcgactcggaccgatg

SEQ ID NO: 14221 - DNA, 203 bp, Homo sapiens
  source 1..203: mol_type = other DNA
ggcgcgccagtccttccagtgcatagcctcctcgtcaattcctttacctacgtcaattcctttaaggacgtcaattcctttattaacgtcaattcctttagagccgtcaattcctttacaagcgtcaattcctttaccctcgtcaattcctttacaatcgtcaattcctttatgaccagtcacagattcgactcggaccgatg

SEQ ID NO: 14222 - DNA, 203 bp, Homo sapiens
  source 1..203: mol_type = other DNA
ggcgcgccagtcctacctcaagtgagcctcctgttgcacggtcttgcctaaccggccgtctccaaggaaccggccgtcataattaaaccggccgtatgtcgagcaccggccgtaagaccaagaccggccgtaagcgccctaccggccgtacatccaataccggccgtatgtttgacaccggccgtattcgactcggaccgatg

SEQ ID NO: 14223 - DNA, 203 bp, Homo sapiens
  source 1..203: mol_type = other DNA
ggcgcgccagtcctctaaggtccaagcctcctgttgcacggtcttgcctaaggtgaagcctccaaggaagccattagcataattaaacaaccaccatgtcgagcaaaaaggcaaagaccaagaccaccaagaagcgccctaccggccgtacatccaataccggccgtatgtttgacaccggccgtattcgactcggaccgatg

SEQ ID NO: 14224 - DNA, 203 bp, Homo sapiens
  source 1..203: mol_type = other DNA
ggcgcgccagtcctagtctttcatagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatcacggaatcgagaatgaccagtcacagattcgactcggaccgatg

SEQ ID NO: 14225 - DNA, 203 bp, Homo sapiens
  source 1..203: mol_type = other DNA
ggcgcgccagtcctctgactaggtagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatgtgtttgccatgtttgaccagtcacagattcgactcggaccgatg

SEQ ID NO: 14226 - DNA, 203 bp, Homo sapiens
  source 1..203: mol_type = other DNA
ggcgcgccagtcctctgacggtgaagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatgtgtttgccatgtttgacccggcgggtattcgactcggaccgatg

SEQ ID NO: 14227 - DNA, 203 bp, Homo sapiens
  source 1..203: mol_type = other DNA
ggcgcgccagtcctctttcttcagagcctcctgttgcacggtcttgcctaaggtgaagcctccaaggaagccattagcataattaaacaaccaccatgtcgagcaaaaaggcaaagaccaagaccggccgtaagcgccctaccggccgtacatccaataccggccgtatgtttgacaccggccgtattcgactcggaccgatg

SEQ ID NO: 14228 - DNA, 203 bp, Homo sapiens
  source 1..203: mol_type = other DNA
ggcgcgccagtccttgtccaagaaagcctcctgttgcacggtcttgcctaaggtgaagcctccaaggaagccattagcataattaaacaaccaccatgtcgagcaaaaaggcaaagaccaagccggcgggtaagcgccctccggcgggtacatccaatccggcgggtatgtttgacccggcgggtattcgactcggaccgatg

SEQ ID NO: 14229 - DNA, 203 bp, Homo sapiens
  source 1..203: mol_type = other DNA
ggcgcgccagtccttacagttaagagcctcctgttgcacggtcttgcctaaggtgaagcctccaaggaagccattagcataattaaacaaccaccatgtcgagccgtcaattcctttacaagcgtcaattcctttaccctcgtcaattcctttacaatcgtcaattcctttatgaccagtcacagattcgactcggaccgatg

SEQ ID NO: 14230 - DNA, 203 bp, Homo sapiens
  source 1..203: mol_type = other DNA
ggcgcgccagtcctatccttgccaagcctcctgttgcacggtcttgcctaaggtgaagcctccaaggaagccattagcataattaacacggaatcgagaagagccacggaatcgagaacaagcacggaatcgagaaccctcacggaatcgagaacaatcacggaatcgagaatgaccagtcacagattcgactcggaccgatg

SEQ ID NO: 14231 - DNA, 203 bp, Homo sapiens
  source 1..203: mol_type = other DNA
ggcgcgccagtcctcttaaggcgtagcctcctgttgcacggtcttgcctaaggtgaagcctccaaggacacggaatcgagaattaacacggaatcgagaagagccacggaatcgagaacaagcacggaatcgagaaccctcacggaatcgagaacaatcacggaatcgagaatgaccagtcacagattcgactcggaccgatg

SEQ ID NO: 14232 - DNA, 203 bp, Homo sapiens
  source 1..203: mol_type = other DNA
ggcgcgccagtcctatcacaaaggagcctcctgttgcacggtcttgcctatactcccgcctccaaggatactcccagcataattaatactcccccatgtcgagctactccccaaagaccaagtactcccagaagcgcccttactccccaacatccaattactcccccatgtttgactactcccagattcgactcggaccgatg

SEQ ID NO: 14233 - DNA, 203 bp, Homo sapiens
  source 1..203: mol_type = other DNA
ggcgcgccagtcctagaaaggtttaggcgcttacagtgcaccaagatggccgcccccgtggatctagagctgaagaaggccttcacagagcttcaagccaaagttactcccactcaacagaatactcccctcgcagacattactcccgaacagctaaatactcccaaaaagcatgctactcccacagacgactcggaccgatg

SEQ ID NO: 14234 - DNA, 203 bp, Homo sapiens
  source 1..203: mol_type = other DNA
ggcgcgccagtcctcaaccggtataggcgcttacagtgcaccaagatggccgcccccgtggatctagagctgaagaaggccttcacagagcttcaagccaaagttattgacactcaacagaaggtgaagctcgcagacatacagattgaacagctaaacacggaatcgagaaatgcacatcttacagacgactcggaccgatg

SEQ ID NO: 14235 - DNA, 203 bp, Homo sapiens
  source 1..203: mol_type = other DNA
ggcgcgccagtccttgacgaccagaggcgcttacagtgcaccaagatggccgcccccgtggatctagagctgaagaaggccttcacagagcttcaagccaaagttattgacactcaacagaaggtgaagctcgcagacatacagattgaacagctaaatactcccaaaaagcatgctactcccacagacgactcggaccgatg

SEQ ID NO: 14236 - DNA, 203 bp, Homo sapiens
  source 1..203: mol_type = other DNA
ggcgcgccagtcctctggtacttgaggcgcttacagtgcaccaagatggccgcccccgtggatctagagctgaagaaggccttcacagagcttcaagccaaagttattgacactcaacagaaggtgaagctcgcagacatacagattgaacagctaaattcttggcaaaagcatgcttcttggcaaaacgactcggaccgatg

SEQ ID NO: 14237 - DNA, 203 bp, Homo sapiens
  source 1..203: mol_type = other DNA
ggcgcgccagtccttggtaggataaggcgcttacagtgcaccaagatggccgcccccgtggatctagagctgaagaaggccttcacagagcttcaagccaaagttattgacactcaacagaaggtgaagctcgcagacatccggcgggtacagctaaaccggcgggtaaagcatgcccggcgggtagacgactcggaccgatg

SEQ ID NO: 14238 - DNA, 203 bp, Homo sapiens
  source 1..203: mol_type = other DNA
ggcgcgccagtccttctttgagctaggcgcttacagtgcaccaagatggccgcccccgtggatctagagctgaagaaggccttcacagagcttcaagccaaagttattgacactcaacagaaggtgaagctcgcagacatcgtcaattcctttataaacgtcaattcctttaatgcacatcttacagacgactcggaccgatg

SEQ ID NO: 14239 - DNA, 203 bp, Homo sapiens
  source 1..203: mol_type = other DNA
ggcgcgccagtcctagtctcaaaaaggcgcttacagtgcaccaagatggccgcccccgtggatctagagctgaagaaggccttcacagagcttcaagccaaagttattgacactcaacagaaggtgaagctcgcagacattactcccgaacagctaaatactcccaaaaagcatgctactcccacagacgactcggaccgatg

SEQ ID NO: 14240 - DNA, 203 bp, Homo sapiens
  source 1..203: mol_type = other DNA
ggcgcgccagtcctctcaaaactaaggcgcttacagtgcaccaagatggccgcccccgtggatctagagctgaagaaggccttcacagagcttcaagccaaagttattgacactcaacagaaggtgaagctcgcagacatttcttggcaaaagctaaattcttggcaaaagcatgcttcttggcaaaacgactcggaccgatg

SEQ ID NO: 14241 - DNA, 203 bp, Homo sapiens
  source 1..203: mol_type = other DNA
ggcgcgccagtcctaatacagcgaaggcgcttacagtgcaccaagatggccgcccccgtggatctagagctgaagaaggccttcacagagcttcaagccaaagttattgacactcaacagaatactcccctcgcagacattactcccgaacagctaaatactcccaaaaagcatgctactcccacagacgactcggaccgatg

SEQ ID NO: 14242 - DNA, 203 bp, Homo sapiens
  source 1..203: mol_type = other DNA
ggcgcgccagtcctagctgctgtgaggcgcttacagtgcaccaagatggccgcccccgtggatctagatactcccaaggccttcactactccccaagccaaagttactcccactcaacagaatactcccctcgcagacattactcccgaacagctaaatactcccaaaaagcatgctactcccacagacgactcggaccgatg

SEQ ID NO: 14243 - DNA, 203 bp, Homo sapiens
  source 1..203: mol_type = other DNA
ggcgcgccagtcctatcagattcaaggcgcttacagtgcaccaagatggccgtcaattcctttatagacgtcaattcctttatcaccgtcaattcctttaaagtcgtcaattcctttaagaacgtcaattcctttaacatcgtcaattcctttataaacgtcaattcctttaatgcacatcttacagacgactcggaccgatg

SEQ ID NO: 14244 - DNA, 203 bp, Homo sapiens
  source 1..203: mol_type = other DNA
ggcgcgccagtccttgttactggaaggcgcttacagtgcaccaagatggcttcttggcaaaatctagattcttggcaaaccttcacttcttggcaaaccaaagtttcttggcaaaaacagaattcttggcaaacagacatttcttggcaaaagctaaattcttggcaaaagcatgcttcttggcaaaacgactcggaccgatg

SEQ ID NO: 14245 - DNA, 203 bp, Homo sapiens
  source 1..203: mol_type = other DNA
ggcgcgccagtcctagtatggtcaaggcgcttccggcgggtcaagatggcccggcgggtggatctagaccggcgggtggccttcacccggcgggtagccaaagtccggcgggttcaacagaaccggcgggtcgcagacatccggcgggtacagctaaaccggcgggtaaagcatgcccggcgggtagacgactcggaccgatg

SEQ ID NO: 14246 - DNA, 203 bp, Homo sapiens
  source 1..203: mol_type = other DNA
ggcgcgccagtcctacgcttacttaggctgccaccggccgtcccccagctaccggccgtgtccctctcaccggccgtctccatccgaccggccgttgcccagggaccggccgtagatgtcgcaccggccgtgcctgtgtcaccggccgttcgttggccaccggccgtccaccagagaccggccgttgacgactcggaccgatg

SEQ ID NO: 14247 - DNA, 203 bp, Homo sapiens
  source 1..203: mol_type = other DNA
ggcgcgccagtcctccttacttgtaggctgcccacggaatcgagaaagctcacggaatcgagaatctccacggaatcgagaatccgcacggaatcgagaaacggcacggaatcgagaatcgccacggaatcgagaatgtccacggaatcgagaaggcccacggaatcgagaaagaggacagacgttgacgactcggaccgatg

SEQ ID NO: 14248 - DNA, 203 bp, Homo sapiens
  source 1..203: mol_type = other DNA
ggcgcgccagtcctaggttacttgaggctgccccggcgggtcccccagctccggcgggtgtccctctcccggcgggtctccatccgccggcgggttgcccacggccggcgggtagatgtcgcccggcgggtgcctgtgtcccggcgggttcgttggccccggcgggtccaccagagccggcgggttgacgactcggaccgatg

SEQ ID NO: 14249 - DNA, 203 bp, Homo sapiens
  source 1..203: mol_type = other DNA
ggcgcgccagtccttgaggtttagaggctgcccgtcaattcctttaagctcgtcaattcctttatctccgtcaattcctttatccgcgtcaattcctttaacggcgtcaattcctttatcgccgtcaattcctttatgtccgtcaattcctttaggcccgtcaattcctttaagaggacagacgttgacgactcggaccgatg

SEQ ID NO: 14250 - DNA, 203 bp, Homo sapiens
  source 1..203: mol_type = other DNA
ggcgcgccagtcctaaccgttaggaggctgccggcttaggacccccagctaccggccgtgtccctctcaccggccgtctccatccgaccggccgttgcccagggaccggccgtagatgtcgcaccggccgtgcctgtgtcaccggccgttcgttggccaccggccgtccaccagagaccggccgttgacgactcggaccgatg

SEQ ID NO: 14251 - DNA, 203 bp, Homo sapiens
  source 1..203: mol_type = other DNA
ggcgcgccagtcctcactgaggtgaggctgccggcttaggacccccagctccgacgtaagtccctctccacggaatcgagaatccgcacggaatcgagaaacggcacggaatcgagaatcgccacggaatcgagaatgtccacggaatcgagaaggcccacggaatcgagaaagaggacagacgttgacgactcggaccgatg

SEQ ID NO: 14252 - DNA, 203 bp, Homo sapiens
  source 1..203: mol_type = other DNA
ggcgcgccagtcctaacctcagttaggctgccggcttaggacccccagctccgacgtaagtccctctcgtgcgccacctccatccgaccggccgttgcccagggaccggccgtagatgtcgcaccggccgtgcctgtgtcaccggccgttcgttggccaccggccgtccaccagagaccggccgttgacgactcggaccgatg

SEQ ID NO: 14253 - DNA, 203 bp, Homo sapiens
  source 1..203: mol_type = other DNA
ggcgcgccagtcctctacactgagaggctgccggcttaggacccccagctccgacgtaagtccctctcgtgcgccacctccatccgcacggaatcgagaaacggcacggaatcgagaatcgccacggaatcgagaatgtccacggaatcgagaaggcccacggaatcgagaaagaggacagacgttgacgactcggaccgatg

SEQ ID NO: 14254 - DNA, 203 bp, Homo sapiens
  source 1..203: mol_type = other DNA
ggcgcgccagtcctcttcactctcaggctgccggcttaggacccccagctccgacgtaagtccctctcgtgcgccacctccatccgctgcccctctgcccacgggccgggctcagatgtcgcaccggccgtgcctgtgtcaccggccgttcgttggccaccggccgtccaccagagaccggccgttgacgactcggaccgatg

SEQ ID NO: 14255 - DNA, 203 bp, Homo sapiens
  source 1..203: mol_type = other DNA
ggcgcgccagtccttgtaacggtcaggctgccggcttaggacccccagctccgacgtaagtccctctcgtgcgccacctccatccgctgcccctctgcccacgggccgggctcagatgtcgccacggaatcgagaatgtccacggaatcgagaaggcccacggaatcgagaaagaggacagacgttgacgactcggaccgatg

SEQ ID NO: 14256 - DNA, 203 bp, Homo sapiens
  source 1..203: mol_type = other DNA
ggcgcgccagtcctgactcgtctaaggctgccggcttaggacccccagctccgacgtaagtccctctcgtgcgccacctccatccgctgcccctctgcccacgggccgggctcagatgtcgcccggcgggtgcctgtgtcccggcgggttcgttggccccggcgggtccaccagagccggcgggttgacgactcggaccgatg

SEQ ID NO: 14257 - DNA, 203 bp, Homo sapiens
  source 1..203: mol_type = other DNA
ggcgcgccagtcctcaggactgtcaggctgccggcttaggacccccagctccgacgtaagtccctctcgtgcgccacctccatccgctgcccctctgcccacgggccgggctcagatgtcgccctctggtcgcctgtgtcaccggccgttcgttggccaccggccgtccaccagagaccggccgttgacgactcggaccgatg

SEQ ID NO: 14258 - DNA, 203 bp, Homo sapiens
  source 1..203: mol_type = other DNA
ggcgcgccagtcctgacgcttgaaaggctgccggcttaggacccccagctccgacgtaagtccctctcgtgcgccacctccatccgctgcccctctgcccacgggccgggctcagatgtcgccctctggtcgcctgtgtccacggaatcgagaaggcccacggaatcgagaaagaggacagacgttgacgactcggaccgatg

SEQ ID NO: 14259 - DNA, 203 bp, Homo sapiens
  source 1..203: mol_type = other DNA
ggcgcgccagtcctgacctttgtcaggctgccggcttaggacccccagctccgacgtaagtccctctcgtgcgccacctccatccgctgcccctctgcccacgggccgggctcagatgtcgccctctggtcgcctgtgtcttctcaccatcgttggccccggcgggtccaccagagccggcgggttgacgactcggaccgatg

SEQ ID NO: 14260 - DNA, 203 bp, Homo sapiens
  source 1..203: mol_type = other DNA
ggcgcgccagtccttcagaacgtcaggctgccggcttaggacccccagctccgacgtaagtccctctcgtgcgccacctccatccgctgcccctctgcccacgggccgggctcagatgtcgccctctggtcgcctgtgtcttctcaccatcgttggcctactcccccccaccagagtactcccgttgacgactcggaccgatg

SEQ ID NO: 14261 - DNA, 203 bp, Homo sapiens
  source 1..203: mol_type = other DNA
ggcgcgccagtcctacagctagtcaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagagaccggccgttgacgactcggaccgatg

SEQ ID NO: 14262 - DNA, 203 bp, Homo sapiens
  source 1..203: mol_type = other DNA
ggcgcgccagtcctgaccggtcataggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagagccggcgggttgacgactcggaccgatg

SEQ ID NO: 14263 - DNA, 203 bp, Homo sapiens
  source 1..203: mol_type = other DNA
ggcgcgccagtcctatgacagctcaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgacgactcggaccgatg

SEQ ID NO: 14264 - DNA, 203 bp, Homo sapiens
  source 1..203: mol_type = other DNA
ggcgcgccagtcctgaaccttgctaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagagtactcccgttgacgactcggaccgatg

SEQ ID NO: 14265 - DNA, 203 bp, Homo sapiens
  source 1..203: mol_type = other DNA
ggcgcgccagtcctgagctcaagaaggctgccggcttaggacccccagctccgacgtaagtccctctcgtgcgccacctccatccgctgcccctctgcccacgggccgggctcagatgtcgccctctggtcgcctgtgtcttctcaccatcgttggccttcttggcaaaaccagagttcttggcaaaacgactcggaccgatg

SEQ ID NO: 14266 - DNA, 203 bp, Homo sapiens
  source 1..203: mol_type = other DNA
ggcgcgccagtcctatccaagctcaggctgccggcttaggacccccagctccgacgtaagtccctctcgtgcgccacctccatccgctgcccctctgcccacgggccgggctcagatgtcgccgtcaattcctttatgtccgtcaattcctttaggcccgtcaattcctttaagaggacagacgttgacgactcggaccgatg

SEQ ID NO: 14267 - DNA, 203 bp, Homo sapiens
  source 1..203: mol_type = other DNA
ggcgcgccagtcctgagctgagtaaggctgccggcttaggacccccagctccgacgtaagtccctctcgtgcgccacctccatccgctgcccctctgcccacgggccgggctcagatgtcgctactccctcgcctgtgtctactccccatcgttggcctactcccccccaccagagtactcccgttgacgactcggaccgatg

SEQ ID NO: 14268 - DNA, 203 bp, Homo sapiens
  source 1..203: mol_type = other DNA
ggcgcgccagtcctgagctgtatcaggctgccggcttaggacccccagctccgacgtaagtccctctcgtgcgccacctccatccgctgcccctctgcccacggtactccctcagatgtcgctactccctcgcctgtgtctactccccatcgttggcctactcccccccaccagagtactcccgttgacgactcggaccgatg

SEQ ID NO: 14269 - DNA, 203 bp, Homo sapiens
  source 1..203: mol_type = other DNA
ggcgcgccagtcctgaacctctgtaggctgccggcttaggacccccagctccgacgtaagtccctctcgtgcgccacctccatccgctgcccctctgcccacggttcttggcaaaatgtcgcttcttggcaaactgtgtcttcttggcaaagttggccttcttggcaaaaccagagttcttggcaaaacgactcggaccgatg

SEQ ID NO: 14270 - DNA, 203 bp, Homo sapiens
  source 1..203: mol_type = other DNA
ggcgcgccagtcctgagcagtttgaggctgccggcttaggacccccagctccgacgtaagtccctctcgtgcgccacctccatccgtactccctctgcccacggtactccctcagatgtcgctactccctcgcctgtgtctactccccatcgttggcctactcccccccaccagagtactcccgttgacgactcggaccgatg

SEQ ID NO: 14271 - DNA, 203 bp, Homo sapiens
  source 1..203: mol_type = other DNA
ggcgcgccagtcctgactgagctcaggctgccggcttaggacccccagctccgacgtaagtccctctcgtgcgccacctccatccgttcttggcaaacccacggttcttggcaaaatgtcgcttcttggcaaactgtgtcttcttggcaaagttggccttcttggcaaaaccagagttcttggcaaaacgactcggaccgatg

SEQ ID NO: 14272 - DNA, 203 bp, Homo sapiens
  source 1..203: mol_type = other DNA
ggcgcgccagtcctgagttaccgtaggctgccggcttaggacccccagctccgacgtaagtccctctcttcttggcaaaccatccgttcttggcaaacccacggttcttggcaaaatgtcgcttcttggcaaactgtgtcttcttggcaaagttggccttcttggcaaaaccagagttcttggcaaaacgactcggaccgatg

SEQ ID NO: 14273 - DNA, 203 bp, Homo sapiens
  source 1..203: mol_type = other DNA
ggcgcgccagtcctcaaaaccgtcaggctgccggcttaggacccccagctcgtcaattcctttatctccgtcaattcctttatccgcgtcaattcctttaacggcgtcaattcctttatcgccgtcaattcctttatgtccgtcaattcctttaggcccgtcaattcctttaagaggacagacgttgacgactcggaccgatg

SEQ ID NO: 14274 - DNA, 203 bp, Homo sapiens
  source 1..203: mol_type = other DNA
ggcgcgccagtcctgacctctgctaggctgccggcttaggacccccagcttactcccaagtccctctctactcccacctccatccgtactccctctgcccacggtactccctcagatgtcgctactccctcgcctgtgtctactccccatcgttggcctactcccccccaccagagtactcccgttgacgactcggaccgatg

SEQ ID NO: 14275 - DNA, 203 bp, Homo sapiens
  source 1..203: mol_type = other DNA
ggcgcgccagtcctgactcagagaaggctgccggcttaggacccccagctttcttggcaaaccctctcttcttggcaaaccatccgttcttggcaaacccacggttcttggcaaaatgtcgcttcttggcaaactgtgtcttcttggcaaagttggccttcttggcaaaaccagagttcttggcaaaacgactcggaccgatg

SEQ ID NO: 14276 - DNA, 203 bp, Homo sapiens
  source 1..203: mol_type = other DNA
ggcgcgccagtcctgacggtcattaggctgcctactcccgacccccagcttactcccaagtccctctctactcccacctccatccgtactccctctgcccacggtactccctcagatgtcgctactccctcgcctgtgtctactccccatcgttggcctactcccccccaccagagtactcccgttgacgactcggaccgatg

SEQ ID NO: 14277 - DNA, 203 bp, Homo sapiens
  source 1..203: mol_type = other DNA
ggcgcgccagtcctcttcaacgtcatatttgaaccggccgttgtatgattaccggccgtgagacaggaaccggccgtaagatggcaaccggccgttctaattagaccggccgttaattttctaccggccgtagtttgttcaccggccgtaacctgcttaccggccgtatcagaaagaccggccgtggacgactcggaccgatg

SEQ ID NO: 14278 - DNA, 203 bp, Homo sapiens
  source 1..203: mol_type = other DNA
ggcgcgccagtcctccaactggtcatatttgacacggaatcgagaagattcacggaatcgagaaaggacacggaatcgagaaggcacacggaatcgagaattagcacggaatcgagaattctcacggaatcgagaagttccacggaatcgagaagcttcacggaatcgagaaaaagacatccttcggacgactcggaccgatg

SEQ ID NO: 14279 - DNA, 203 bp, Homo sapiens
  source 1..203: mol_type = other DNA
ggcgcgccagtcctcatgaccttaatatttgattcttggcaaatatgattttcttggcaaagacaggattcttggcaaagatggcattcttggcaaataattagttcttggcaaaattttctttcttggcaaatttgttcttcttggcaaacctgcttttcttggcaaacagaaagttcttggcaaaacgactcggaccgatg

SEQ ID NO: 14280 - DNA, 203 bp, Homo sapiens
  source 1..203: mol_type = other DNA
ggcgcgccagtcctacggtcatgaatatttgattttttgcatgtatgattaccggccgtgagacaggaaccggccgtaagatggcaaccggccgttctaattagaccggccgttaattttctaccggccgtagtttgttcaccggccgtaacctgcttaccggccgtatcagaaagaccggccgtggacgactcggaccgatg

SEQ ID NO: 14281 - DNA, 203 bp, Homo sapiens
  source 1..203: mol_type = other DNA
ggcgcgccagtcctttgagtgagtatatttgattttttgcatgtatgattataccatgagagacaggattaatatagaagatggcaaggcaaatttctaattagaccggccgttaattttctaccggccgtagtttgttcaccggccgtaacctgcttaccggccgtatcagaaagaccggccgtggacgactcggaccgatg

SEQ ID NO: 14282 - DNA, 203 bp, Homo sapiens
  source 1..203: mol_type = other DNA
ggcgcgccagtcctgaacagtctcatatttgattttttgcatgtatgattataccatgagagacaggattaatatagaagatggcaaggcaaatttctaattagagggaatattaattttctacaaaataaagtttgttcatcaatacaaacctgcttcacggaatcgagaaaaagacatccttcggacgactcggaccgatg

SEQ ID NO: 14283 - DNA, 203 bp, Homo sapiens
  source 1..203: mol_type = other DNA
ggcgcgccagtccttaaactcatgatatttgattttttgcatgtatgattataccatgagagacaggattaatatagaagatggcaaggcaaatttctaattagagggaatattaattttctacaaaataaagtttgttcccggcgggtaacctgcttccggcgggtatcagaaagccggcgggtggacgactcggaccgatg

SEQ ID NO: 14284 - DNA, 203 bp, Homo sapiens
  source 1..203: mol_type = other DNA
ggcgcgccagtccttcactacactatatttgattttttgcatgtatgattataccatgagagacaggattaatatagaagatggcaaggcaaatttctaattagagggaatattaattttctcgtcaattcctttagttccgtcaattcctttagcttcgtcaattcctttaaaagacatccttcggacgactcggaccgatg

SEQ ID NO: 14285 - DNA, 203 bp, Homo sapiens
  source 1..203: mol_type = other DNA
ggcgcgccagtccttgtagtgaatatatttgattttttgcatgtatgattttcttggcaaagacaggattcttggcaaagatggcattcttggcaaataattagttcttggcaaaattttctttcttggcaaatttgttcttcttggcaaacctgcttttcttggcaaacagaaagttcttggcaaaacgactcggaccgatg

SEQ ID NO: 14286 - DNA, 203 bp, Homo sapiens
  source 1..203: mol_type = other DNA
ggcgcgccagtcctaactacactgatgatcttaagtagataagtgctgttaccggccgttcaacagaaaccggccgttacgtctttaccggccgtaagaacacaaccggccgtatgctctcaaccggccgttttttatttaccggccgtggaaagctcaccggccgttacgaatagaccggccgttatcgactcggaccgatg

SEQ ID NO: 14287 - DNA, 203 bp, Homo sapiens
  source 1..203: mol_type = other DNA
ggcgcgccagtcctactacaactgatgatcttaagtagataagtgctgttcgtcaattcctttaagaacgtcaattcctttactttcgtcaattcctttacacacgtcaattcctttactcacgtcaattcctttaatttcgtcaattcctttagctccgtcaattcctttaatagccaaccctttatcgactcggaccgatg

SEQ ID NO: 14288 - DNA, 203 bp, Homo sapiens
  source 1..203: mol_type = other DNA
ggcgcgccagtcctacgttaactaatgatcttaagtagataagtgctgttgcttgtagttcaacagaaagctttgagtacgtctttccggcgggtaagaacacaccggcgggtatgctctcaccggcgggttttttatttccggcgggtggaaagctcccggcgggttacgaatagccggcgggttatcgactcggaccgatg

SEQ ID NO: 14289 - DNA, 203 bp, Homo sapiens
  source 1..203: mol_type = other DNA
ggcgcgccagtccttaagagtattatgatcttaagtagataagtgctgttgcttgtagttcaacagaaagctttgagtacgtctttcgtcaattcctttacacacgtcaattcctttactcacgtcaattcctttaatttcgtcaattcctttagctccgtcaattcctttaatagccaaccctttatcgactcggaccgatg

SEQ ID NO: 14290 - DNA, 203 bp, Homo sapiens
  source 1..203: mol_type = other DNA
ggcgcgccagtccttttactgtgtatgatcttaagtagataagtgctgttgcttgtagttcaacagaaagctttgagtacgtctttcttgcgagaaagaacacatgcattcttatgctctcaattctattatttttattttgggcgaaaggaaagctctactcccagtacgaatagtactccctttatcgactcggaccgatg

SEQ ID NO: 14291 - DNA, 203 bp, Homo sapiens
  source 1..203: mol_type = other DNA
ggcgcgccagtcctaggactgtgaatgatcttaagtagataagtgctgttgcttgtagttcaacagaaagctttgagtacgtctttcttgcgagaaagaacacatgcattcttatgctctcaattctattatttttattttgggcgaaaggaaagctctcacgcgagtacgaatagaccggccgttatcgactcggaccgatg

SEQ ID NO: 14292 - DNA, 203 bp, Homo sapiens
  source 1..203: mol_type = other DNA
ggcgcgccagtccttaaactttggatgatcttaagtagataagtgctgttgcttgtagttcaacagaaagctttgagtacgtctttcttgcgagaaagaacacatgcattcttatgctctcaattctattatttttatttttcttggcaaaaaagctcttcttggcaaacgaatagttcttggcaaatcgactcggaccgatg

SEQ ID NO: 14293 - DNA, 203 bp, Homo sapiens
  source 1..203: mol_type = other DNA
ggcgcgccagtcctactgctttggatgatcttaagtagataagtgctgttgcttgtagttcaacagaaagctttgagtacgtctttcttgcgagaaagaacacatgcattcttatgctctcaccggcgggttttttatttccggcgggtggaaagctcccggcgggttacgaatagccggcgggttatcgactcggaccgatg

SEQ ID NO: 14294 - DNA, 203 bp, Homo sapiens
  source 1..203: mol_type = other DNA
ggcgcgccagtcctaacctttggtatgatcttaagtagataagtgctgttgcttgtagttcaacagaaagctttgagtacgtctttcttgcgagaaagaacacatgcattcttatgctctcacgtcaattcctttaatttcgtcaattcctttagctccgtcaattcctttaatagccaaccctttatcgactcggaccgatg

SEQ ID NO: 14295 - DNA, 203 bp, Homo sapiens
  source 1..203: mol_type = other DNA
ggcgcgccagtcctagtccaggttatgatcttaagtagataagtgctgttgcttgtagttcaacagaaagctttgagtacgtctttttcttggcaaagaacacattcttggcaaagctctcattcttggcaaatttatttttcttggcaaaaaagctcttcttggcaaacgaatagttcttggcaaatcgactcggaccgatg

SEQ ID NO: 14296 - DNA, 203 bp, Homo sapiens
  source 1..203: mol_type = other DNA
ggcgcgccagtccttctaacactaatgatcttaagtagataagtgctgttgcttgtagttcaacagaaccggcgggttacgtctttccggcgggtaagaacacaccggcgggtatgctctcaccggcgggttttttatttccggcgggtggaaagctcccggcgggttacgaatagccggcgggttatcgactcggaccgatg

SEQ ID NO: 14297 - DNA, 203 bp, Homo sapiens
  source 1..203: mol_type = other DNA
ggcgcgccagtcctacgactgttcatgatcttaagtagataagtgctgtttactcccgttcaacagaatactcccagtacgtcttttactcccgaaagaacacatactcccttatgctctcatactccctatttttattttactcccaaggaaagctctactcccagtacgaatagtactccctttatcgactcggaccgatg

SEQ ID NO: 14298 - DNA, 203 bp, Homo sapiens
  source 1..203: mol_type = other DNA
ggcgcgccagtcctgagaactggtatgatcttaccggccgtagtgctgttaccggccgttcaacagaaaccggccgttacgtctttaccggccgtaagaacacaaccggccgtatgctctcaaccggccgttttttatttaccggccgtggaaagctcaccggccgttacgaatagaccggccgttatcgactcggaccgatg

SEQ ID NO: 14299 - DNA, 203 bp, Homo sapiens
  source 1..203: mol_type = other DNA
ggcgcgccagtccttaccactaggatgatcttcacggaatcgagaatgttcacggaatcgagaaagaacacggaatcgagaactttcacggaatcgagaacacacacggaatcgagaactcacacggaatcgagaaatttcacggaatcgagaagctccacggaatcgagaaatagccaaccctttatcgactcggaccgatg

SEQ ID NO: 14300 - DNA, 203 bp, Homo sapiens
  source 1..203: mol_type = other DNA
ggcgcgccagtcctatcagtggtcatgatcttccggcgggtagtgctgttccggcgggttcaacagaaccggcgggttacgtctttccggcgggtaagaacacaccggcgggtatgctctcaccggcgggttttttatttccggcgggtggaaagctcccggcgggttacgaatagccggcgggttatcgactcggaccgatg

SEQ ID NO: 14301 - DNA, 203 bp, Homo sapiens
  source 1..203: mol_type = other DNA
ggcgcgccagtcctcacagtggttatgatcttcgtcaattcctttatgttcgtcaattcctttaagaacgtcaattcctttactttcgtcaattcctttacacacgtcaattcctttactcacgtcaattcctttaatttcgtcaattcctttagctccgtcaattcctttaatagccaaccctttatcgactcggaccgatg

SEQ ID NO: 14302 - DNA, 203 bp, Homo sapiens
  source 1..203: mol_type = other DNA
ggcgcgccagtccttgtagtggtaatgatctttactccctaagtgctgtttactcccgttcaacagaatactcccagtacgtcttttactcccgaaagaacacatactcccttatgctctcatactccctatttttattttactcccaaggaaagctctactcccagtacgaatagtactccctttatcgactcggaccgatg

SEQ ID NO: 14303 - DNA, 203 bp, Homo sapiens
  source 1..203: mol_type = other DNA
ggcgcgccagtcctttggtgactgatttgacccgaggcttcttagaagaattcttggcaaatccaagtttcttggcaaaatgtgctttcttggcaaaagaatgattcttggcaaaaaaaattttcttggcaaattttattttcttggcaaagctgaaattcttggcaaacgaaatcttcttggcaaaacgactcggaccgatg

SEQ ID NO: 14304 - DNA, 203 bp, Homo sapiens
  source 1..203: mol_type = other DNA
ggcgcgccagtcctacgtactcgtatttgacccgaggcttcttagaagaattttttaacattccaagtttatctaatagatgtgctatgaagagaacagaatgaaccggccgtaaaaaaattaccggccgtatttttattaccggccgtgagctgaaaaccggccgtggcgaaatcaccggccgtaaacgactcggaccgatg

SEQ ID NO: 14305 - DNA, 203 bp, Homo sapiens
  source 1..203: mol_type = other DNA
ggcgcgccagtcctttcaaccggtatttgacccgaggcttcttagaagaattttttaacattccaagtttatctaatagatgtgctatgaagagaacagaatgacacggaatcgagaaaattcacggaatcgagaatattcacggaatcgagaagaaacacggaatcgagaaaatcaaaattcataaacgactcggaccgatg

SEQ ID NO: 14306 - DNA, 203 bp, Homo sapiens
  source 1..203: mol_type = other DNA
ggcgcgccagtcctccatgaagatatttgacccgaggcttcttagaagaattttttaacattccaagtttatctaatagatgtgctatgaagagaacagaatgatactcccttaaaaaaatttactcccttatttttatttactcccatgagctgaaatactcccgtggcgaaatctactcccataaacgactcggaccgatg

SEQ ID NO: 14307 - DNA, 203 bp, Homo sapiens
  source 1..203: mol_type = other DNA
ggcgcgccagtccttcgtcacaagatttgacccgaggcttcttagaagaattttttaacattccaagtttatctaatagatgtgctatgaagagaacagaatgatgggactttaaaaaaattaccggccgtatttttattaccggccgtgagctgaaaaccggccgtggcgaaatcaccggccgtaaacgactcggaccgatg

SEQ ID NO: 14308 - DNA, 203 bp, Homo sapiens
  source 1..203: mol_type = other DNA
ggcgcgccagtcctagaccgagttatttgacccgaggcttcttagaagaattttttaacattccaagtttatctaatagatgtgctatgaagagaacagaatgatgggactttaaaaaaatttttacagttatttttattcgtcaattcctttagaaacgtcaattcctttaaatcaaaattcataaacgactcggaccgatg

SEQ ID NO: 14309 - DNA, 203 bp, Homo sapiens
  source 1..203: mol_type = other DNA
ggcgcgccagtccttaaaccactaatttgacccgaggcttcttagaagaattttttaacattccaagtttatctaatagatgtgcttactcccgaacagaatgatactcccttaaaaaaatttactcccttatttttatttactcccatgagctgaaatactcccgtggcgaaatctactcccataaacgactcggaccgatg

SEQ ID NO: 14310 - DNA, 203 bp, Homo sapiens
  source 1..203: mol_type = other DNA
ggcgcgccagtcctgattctgaggatttgaccttcttggcaaaagaagaattcttggcaaatccaagtttcttggcaaaatgtgctttcttggcaaaagaatgattcttggcaaaaaaaattttcttggcaaattttattttcttggcaaagctgaaattcttggcaaacgaaatcttcttggcaaaacgactcggaccgatg

SEQ ID NO: 14311 - DNA, 203 bp, Homo sapiens
  source 1..203: mol_type = other DNA
ggcgcgccagtcctcctcaagcttcaaagagcagttctgtcaaagaaaacaacataaatcaggtacagaatttcagagtgggatataccggccgtagtgtgaagaccggccgtcattaaaccaccggccgttagaactgaaccggccgtaagaaaattaccggccgtttaaaactgaccggccgtatccgactcggaccgatg

SEQ ID NO: 14312 - DNA, 203 bp, Homo sapiens
  source 1..203: mol_type = other DNA
ggcgcgccagtcctatgtgcacaacaaagagcagttctgtcaaagaaaacaacataaatcaggtacagaatttcagagtgggatatcagatctttagtgtgaagatacatctacattaaaccaggaatcactagaactgacacggaatcgagaaaattcacggaatcgagaaactgtgaaggttgatccgactcggaccgatg

SEQ ID NO: 14313 - DNA, 203 bp, Homo sapiens
  source 1..203: mol_type = other DNA
ggcgcgccagtcctcaaaggtgttcaaagagcagttctgtcaaagaaaacaacataaatcaggtacagaatttcagagtgggatatcagatctttagtgtgaagatacatctacattaaaccaggaatcactagaactgacatttggacaagaaaattccggcgggtttaaaactgccggcgggtatccgactcggaccgatg

SEQ ID NO: 14314 - DNA, 203 bp, Homo sapiens
  source 1..203: mol_type = other DNA
ggcgcgccagtcctgagaagtactcaaagagcagttctgtcaaagaaaacccggcgggtcaggtacagccggcgggtgtgggatatccggcgggtagtgtgaagccggcgggtcattaaaccccggcgggttagaactgaccggcgggtaagaaaattccggcgggtttaaaactgccggcgggtatccgactcggaccgatg

SEQ ID NO: 14315 - DNA, 203 bp, Homo sapiens
  source 1..203: mol_type = other DNA
ggcgcgccagtcctgaccaacttacaaagagccgtcaattcctttaaaaccgtcaattcctttaacagcgtcaattcctttaatatcgtcaattcctttagaagcgtcaattcctttaaacccgtcaattcctttactgacgtcaattcctttaaattcgtcaattcctttaactgtgaaggttgatccgactcggaccgatg

SEQ ID NO: 14316 - DNA, 203 bp, Homo sapiens
  source 1..203: mol_type = other DNA
ggcgcgccagtcctgaggtagtttcaccggccgttgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14317 - DNA, 203 bp, Homo sapiens
  source 1..203: mol_type = other DNA
ggcgcgccagtcctgacgttgtatcaccggccgttgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14318 - DNA, 203 bp, Homo sapiens
  source 1..203: mol_type = other DNA
ggcgcgccagtccttttgagtcgtcattggctcgtcaattcctttattgacgtcaattcctttaatagcgtcaattcctttaatcccgtcaattcctttactatcgtcaattcctttattggcgtcaattcctttaattacgtcaattcctttactctcgtcaattcctttacactcaatacagcaaacgactcggaccgatg

SEQ ID NO: 14319 - DNA, 203 bp, Homo sapiens
  source 1..203: mol_type = other DNA
ggcgcgccagtccttttgtaagcacattggctgcttatggtgacaattgacaaattgttaccatatagcgtcaattcctttaatcccgtcaattcctttactatcgtcaattcctttattggcgtcaattcctttaattacgtcaattcctttactctcgtcaattcctttacactcaatacagcaaacgactcggaccgatg

SEQ ID NO: 14320 - DNA, 203 bp, Homo sapiens
  source 1..203: mol_type = other DNA
ggcgcgccagtcctctgcagtacacattggctgcttatggtgacaattgacaaattgttaccatatagctattggattggccatccggtgacaaacagagctatcgtcaattcctttattggcgtcaattcctttaattacgtcaattcctttactctcgtcaattcctttacactcaatacagcaaacgactcggaccgatg

SEQ ID NO: 14321 - DNA, 203 bp, Homo sapiens
  source 1..203: mol_type = other DNA
ggcgcgccagtccttctacagcatcattggctgcttatggtgacaattgacaaattgttaccatatagctattggattggccatccggtgacaaacagagctattgtttacttgtttgttggcacggaatcgagaaattacacggaatcgagaactctcacggaatcgagaacactcaatacagcaaacgactcggaccgatg

SEQ ID NO: 14322 - DNA, 203 bp, Homo sapiens
  source 1..203: mol_type = other DNA
ggcgcgccagtccttgtgctgtagcattggctgcttatggtgacaattgacaaattgttaccatatagctattggattggccatccggtgacaaacagagctattgtttacttgtttgttggcgtcaattcctttaattacgtcaattcctttactctcgtcaattcctttacactcaatacagcaaacgactcggaccgatg

SEQ ID NO: 14323 - DNA, 203 bp, Homo sapiens
  source 1..203: mol_type = other DNA
ggcgcgccagtcctgaatctcactcattggctgcttatggtgacaattgacaaattgttaccatatagctattggattggccatccggtgacaaacagagctattgtttacttgtttgttggtttcataccattaaattacaaggtcttagaaactctcaactttattttgacactcaatacagcaaacgactcggaccgatg

SEQ ID NO: 14324 - DNA, 203 bp, Homo sapiens
  source 1..203: mol_type = other DNA
ggcgcgccagtcctagtgctgtcacattggctgcttatggtgacaattgacaaattgttaccatatagctattggattggccatccggtgacaaacagagctattgtttacttgtttgttggtttcataccattaaattacaaggtcttagaaactctcaactttattttgacactccggcgggtaaacgactcggaccgatg

SEQ ID NO: 14325 - DNA, 203 bp, Homo sapiens
  source 1..203: mol_type = other DNA
ggcgcgccagtcctgacgttgaggcattggctgcttatggtgacaattgacaaattgttaccatatagctattggattggccatccggtgacaaacagagctattgtttacttgtttgttggtttcataccattaaattacaaggtcttagaaactctccggcgggttttgacactccggcgggtaaacgactcggaccgatg

SEQ ID NO: 14326 - DNA, 203 bp, Homo sapiens
  source 1..203: mol_type = other DNA
ggcgcgccagtcctaatcagttttcattggctgcttatggtgacaattgacaaattgttaccatatagctattggattggccatccggtgacaaacagagctattgtttacttgtttgttggtttcataccattaaattacaaggtcttagaaactctttcttggcaaatgacactttcttggcaaaacgactcggaccgatg

SEQ ID NO: 14327 - DNA, 203 bp, Homo sapiens
  source 1..203: mol_type = other DNA
ggcgcgccagtcctctcaaggccacattggctgcttatggtgacaattgacaaattgttaccatatagctattggattggccatccggtgacaaacagagctattgtttacttgtttgttggtttcataccattaaattacgtcaattcctttactctcgtcaattcctttacactcaatacagcaaacgactcggaccgatg

SEQ ID NO: 14328 - DNA, 203 bp, Homo sapiens
  source 1..203: mol_type = other DNA
ggcgcgccagtcctcagtttctgcccacggaatcgagaatcactagcaacctcaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14329 - DNA, 203 bp, Homo sapiens
  source 1..203: mol_type = other DNA
ggcgcgccagtcctaatgtacagcccatgatgcctcgctcccatcagccgaccggccgtccacatgaaaccggccgtcaagaagcgaccggccgtattgatgaaaccggccgtgaaatagacaccggccgtgaacaagccaccggccgtattttgaaaaccggccgtaaatataacaccggccgtcaacgactcggaccgatg

SEQ ID NO: 14330 - DNA, 203 bp, Homo sapiens
  source 1..203: mol_type = other DNA
ggcgcgccagtcctctaagagtgcccatgatgcctcgctcccatcagccgccgccgccgccacatgaaaaagaacagcaagaagcgattgaacacattgatgaagtacaaaatgaaatagacaccggccgtgaacaagccaccggccgtattttgaaaaccggccgtaaatataacaccggccgtcaacgactcggaccgatg

SEQ ID NO: 14331 - DNA, 203 bp, Homo sapiens
  source 1..203: mol_type = other DNA
ggcgcgccagtcctacgttcttgcccatgatgcctcgctcccatcagccgccgccgccgccacatgaaaaagaacagcaagaagcgattgaacacattgatgaagtacaaaatgaaatagacagacttaatgaacaagccagtgaggagattttgaaacgtcaattcctttataacaaactccgccaacgactcggaccgatg

SEQ ID NO: 14332 - DNA, 203 bp, Homo sapiens
  source 1..203: mol_type = other DNA
ggcgcgccagtcctaaagtgttgcccatgatgcctcgctcccatcagccgccgccgccgccacatgaaaaagaacagcaagaagcgattgaacacattgatgaagtacaaaatgaaatagacagacttaatgaacaagccagtgaggagattttgaaagtagaacagaaatataacccggcgggtcaacgactcggaccgatg

SEQ ID NO: 14333 - DNA, 203 bp, Homo sapiens
  source 1..203: mol_type = other DNA
ggcgcgccagtccttagtttgagcccatgatgcctcgctcccatcagccgccgccgccgccacatgaaaaagaacagcaagaagcgattgaacacattgatgaagtacaaaatgaaatagacagacttaatgaacaagcctactcccagattttgaaatactcccagaaatataactactcccgccaacgactcggaccgatg

SEQ ID NO: 14334 - DNA, 203 bp, Homo sapiens
  source 1..203: mol_type = other DNA
ggcgcgccagtcctaggtttgtgcccatgatgcctcgctcccatcagccgccgccgccgccacatgaaaaagaacagcaagaagcgccggcgggtattgatgaaccggcgggtgaaatagacccggcgggtgaacaagccccggcgggtattttgaaaccggcgggtaaatataacccggcgggtcaacgactcggaccgatg

SEQ ID NO: 14335 - DNA, 203 bp, Homo sapiens
  source 1..203: mol_type = other DNA
ggcgcgccagtcctagaagcaggcccatgatgcctcgctcccatcagccgccgccgccgccacatgaacgtcaattcctttaagcgcgtcaattcctttatgaacgtcaattcctttaagaccgtcaattcctttaagcccgtcaattcctttagaaacgtcaattcctttataacaaactccgccaacgactcggaccgatg

SEQ ID NO: 14336 - DNA, 203 bp, Homo sapiens
  source 1..203: mol_type = other DNA
ggcgcgccagtcctgctagtctgtccatgatgcctcgctcccatcagccgcgtcaattcctttatgaacgtcaattcctttaagcgcgtcaattcctttatgaacgtcaattcctttaagaccgtcaattcctttaagcccgtcaattcctttagaaacgtcaattcctttataacaaactccgccaacgactcggaccgatg

SEQ ID NO: 14337 - DNA, 203 bp, Homo sapiens
  source 1..203: mol_type = other DNA
ggcgcgccagtcctgcttgagcttcccactatcacggaatcgagaaagttcacggaatcgagaacgaacacggaatcgagaaccaccacggaatcgagaagctacacggaatcgagaaaaaacacggaatcgagaacccgcacggaatcgagaaccttcacggaatcgagaaggtggtagctgcaacccgactcggaccgatg

SEQ ID NO: 14338 - DNA, 203 bp, Homo sapiens
  source 1..203: mol_type = other DNA
ggcgcgccagtcctgcctcttaagcccactatccggcgggtctccgagttccggcgggtatggccgaaccggcgggttggggccacccggcgggtgccgtgctaccggcgggtaggggaaaaccggcgggtgtgaccccgccggcgggtccctcccttccggcgggtagtgtggtgccggcgggtacccgactcggaccgatg

SEQ ID NO: 14339 - DNA, 203 bp, Homo sapiens
  source 1..203: mol_type = other DNA
ggcgcgccagtcctgctcgtcaggcccactattgttgtgggctccgagttcctctagggatggccgaaaggcagccatggggccaccacggaatcgagaagctacacggaatcgagaaaaaacacggaatcgagaacccgcacggaatcgagaaccttcacggaatcgagaaggtggtagctgcaacccgactcggaccgatg

SEQ ID NO: 14340 - DNA, 203 bp, Homo sapiens
  source 1..203: mol_type = other DNA
ggcgcgccagtcctgcctaactctcccactattgttgtgggctccgagttcctctagggatggccgaaaggcagccatggggccacccaggcggcgccgtgctacacggaatcgagaaaaaacacggaatcgagaacccgcacggaatcgagaaccttcacggaatcgagaaggtggtagctgcaacccgactcggaccgatg

SEQ ID NO: 14341 - DNA, 203 bp, Homo sapiens
  source 1..203: mol_type = other DNA
ggcgcgccagtcctgcacagtagccccactattgttgtgggctccgagttcctctagggatggccgaaaggcagccatggggccacccaggcggcgccgtgctacaggcggcaaggggaaaaatccttcgggtgaccccgcgtcaattcctttaccttcgtcaattcctttaggtggtagctgcaacccgactcggaccgatg

SEQ ID NO: 14342 - DNA, 203 bp, Homo sapiens
  source 1..203: mol_type = other DNA
ggcgcgccagtcctgcaccttcaacccactattgttgtgggctccgagttcctctagggatggccgaaaggcagccatggggccacccaggcggcgccgtgctacaggcggcaaggggaaaaatccttcgggtgaccccgggtggcattccctcccttaccggccgtagtgtggtgaccggccgtacccgactcggaccgatg

SEQ ID NO: 14343 - DNA, 203 bp, Homo sapiens
  source 1..203: mol_type = other DNA
ggcgcgccagtcctgctactctagcccactattgttgtgggctccgagttcctctagggatggccgaaaggcagccatggggccacccaggcggcgccgtgctacaggcggcaaggggaaaaatccttcgggtgaccccgggtggcattccctcccttagcagcatgagtgtggtgtactccccaacccgactcggaccgatg

SEQ ID NO: 14344 - DNA, 203 bp, Homo sapiens
  source 1..203: mol_type = other DNA
ggcgcgccagtcctgctcaagttgcccactattgttgtgggctccgagttcctctagggatggccgaaaggcagccatggggccacccaggcggcgccgtgctacaggcggcaaggggaaaaatccttcgggtgaccccgggtggcattccctccctttactccctgagtgtggtgtactccccaacccgactcggaccgatg

SEQ ID NO: 14345 - DNA, 203 bp, Homo sapiens
  source 1..203: mol_type = other DNA
ggcgcgccagtcctgcctagtagtcccactattgttgtgggctccgagttcctctagggatggccgaaaggcagccatggggccacccaggcggcgccgtgctacaggcggcaaggggaaaaatccttcgggtgaccccgggtggcattccctcccttttcttggcaaatgtggtgttcttggcaaaccgactcggaccgatg

SEQ ID NO: 14346 - DNA, 203 bp, Homo sapiens
  source 1..203: mol_type = other DNA
ggcgcgccagtcctgctctgcaagcccactattgttgtgggctccgagttcctctagggatggccgaaaggcagccatggggccacccaggcggcgccgtgctacaggcggcaaggggaaaaatccttcgggtgaccccgtactcccttccctccctttactccctgagtgtggtgtactccccaacccgactcggaccgatg

SEQ ID NO: 14347 - DNA, 203 bp, Homo sapiens
  source 1..203: mol_type = other DNA
ggcgcgccagtcctgctcacctggcccactattgttgtgggctccgagttcctctagggatggccgaaaggcagccatggggccacccaggcggcgccgtgctacaggcggcaaggggaaaatactcccgggtgaccccgtactcccttccctccctttactccctgagtgtggtgtactccccaacccgactcggaccgatg

SEQ ID NO: 14348 - DNA, 203 bp, Homo sapiens
  source 1..203: mol_type = other DNA
ggcgcgccagtcctgctcttaagacccactattgttgtgggctccgagttcctctagggatggccgaaaggcagccatggggccacccaggcggcgccgtgctacgtcaattcctttaaaaacgtcaattcctttacccgcgtcaattcctttaccttcgtcaattcctttaggtggtagctgcaacccgactcggaccgatg

SEQ ID NO: 14349 - DNA, 203 bp, Homo sapiens
  source 1..203: mol_type = other DNA
ggcgcgccagtcctgcagtatgcacccactattgttgtgggctccgagttcctctagggatggccgaaaggcagccatggggccacccaggcggcgccgtgctatactccccaaggggaaaatactcccgggtgaccccgtactcccttccctccctttactccctgagtgtggtgtactccccaacccgactcggaccgatg

SEQ ID NO: 14350 - DNA, 203 bp, Homo sapiens
  source 1..203: mol_type = other DNA
ggcgcgccagtcctagagccttcacccactattgttgtgggctccgagttcctctagggatggccgaacgtcaattcctttaccaccgtcaattcctttagctacgtcaattcctttaaaaacgtcaattcctttacccgcgtcaattcctttaccttcgtcaattcctttaggtggtagctgcaacccgactcggaccgatg

SEQ ID NO: 14351 - DNA, 203 bp, Homo sapiens
  source 1..203: mol_type = other DNA
ggcgcgccagtcctgaagccttttcccactattgttgtgggctccgagttcgtcaattcctttacgaacgtcaattcctttaccaccgtcaattcctttagctacgtcaattcctttaaaaacgtcaattcctttacccgcgtcaattcctttaccttcgtcaattcctttaggtggtagctgcaacccgactcggaccgatg

SEQ ID NO: 14352 - DNA, 203 bp, Homo sapiens
  source 1..203: mol_type = other DNA
ggcgcgccagtcctacaagtgctccccactatttcttggcaaaccgagttttcttggcaaaggccgaattcttggcaaagggccacttcttggcaaacgtgctattcttggcaaagggaaaattcttggcaaagaccccgttcttggcaaactcccttttcttggcaaatgtggtgttcttggcaaaccgactcggaccgatg

SEQ ID NO: 14353 - DNA, 203 bp, Homo sapiens
  source 1..203: mol_type = other DNA
ggcgcgccagtcctaaagaaggatcccggcgggttgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14354 - DNA, 203 bp, Homo sapiens
  source 1..203: mol_type = other DNA
ggcgcgccagtcctctctggactgcccggcgggttgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14355 - DNA, 203 bp, Homo sapiens
  source 1..203: mol_type = other DNA
ggcgcgccagtccttcaacgtaggccgcccgccacggaatcgagaacccccacggaatcgagaacccccacggaatcgagaaccttcacggaatcgagaactcgcacggaatcgagaaggctcacggaatcgagaagtgacacggaatcgagaaactccacggaatcgagaacagaacactgctcgaccgactcggaccgatg

SEQ ID NO: 14356 - DNA, 203 bp, Homo sapiens
  source 1..203: mol_type = other DNA
ggcgcgccagtcctgagttctgtcccgcccgcccctattgttccgcccccaccggccgtcccttccccaccggccgtgctccccttaccggccgtgtcgcctcgaccggccgttttttggctaccggccgtaaccagtgaaccggccgttgaccactcaccggccgtctccccagaaccggccgtgaccgactcggaccgatg

SEQ ID NO: 14357 - DNA, 203 bp, Homo sapiens
  source 1..203: mol_type = other DNA
ggcgcgccagtcctagctgtacacccgcccgcccctattgttccgccccccgtcaattcctttacccccgtcaattcctttaccttcgtcaattcctttactcgcgtcaattcctttaggctcgtcaattcctttagtgacgtcaattcctttaactccgtcaattcctttacagaacactgctcgaccgactcggaccgatg

SEQ ID NO: 14358 - DNA, 203 bp, Homo sapiens
  source 1..203: mol_type = other DNA
ggcgcgccagtcctgtagtgctaaccgcccgcccctattgttccgcccccggcctcccgcccttccccccggcgggtgctccccttccggcgggtgtcgcctcgccggcgggttttttggctccggcgggtaaccagtgaccggcgggttgaccactcccggcgggtctccccagaccggcgggtgaccgactcggaccgatg

SEQ ID NO: 14359 - DNA, 203 bp, Homo sapiens
  source 1..203: mol_type = other DNA
ggcgcgccagtcctgtgctctcgtccgcccgcccctattgttccgcccccggcctcccgcccttccccttcccgcccgctccccttaccggccgtgtcgcctcgaccggccgttttttggctaccggccgtaaccagtgaaccggccgttgaccactcaccggccgtctccccagaaccggccgtgaccgactcggaccgatg

SEQ ID NO: 14360 - DNA, 203 bp, Homo sapiens
  source 1..203: mol_type = other DNA
ggcgcgccagtcctctgtgtacacccgcccgcccctattgttccgcccccggcctcccgcccttccccttcccgcccgctcccctttactccccagtcgcctcgtactcccagtttttggcttactcccccaaccagtgatactccccttgaccactctactcccagctccccagatactccctcgaccgactcggaccgatg

SEQ ID NO: 14361 - DNA, 203 bp, Homo sapiens
  source 1..203: mol_type = other DNA
ggcgcgccagtcctgtgaatgttgccgcccgcccctattgttccgcccccggcctcccgcccttccccttcccgcccgctccccttttcccctcagtcgcctcgaccggccgttttttggctaccggccgtaaccagtgaaccggccgttgaccactcaccggccgtctccccagaaccggccgtgaccgactcggaccgatg

SEQ ID NO: 14362 - DNA, 203 bp, Homo sapiens
  source 1..203: mol_type = other DNA
ggcgcgccagtcctgaccgagaacccgcccgcccctattgttccgcccccggcctcccgcccttccccttcccgcccgctccccttttcccctcagtcgcctcgcgcctgcagtttttggctccggcgggtaaccagtgaccggcgggttgaccactcccggcgggtctccccagaccggcgggtgaccgactcggaccgatg

SEQ ID NO: 14363 - DNA, 203 bp, Homo sapiens
  source 1..203: mol_type = other DNA
ggcgcgccagtcctgttactggacccgcccgcccctattgttccgcccccggcctcccgcccttccccttcccgcccgctccccttttcccctcagtcgcctcgcgcctgcagtttttggctttcacccccaaccagtgaaccggccgttgaccactcaccggccgtctccccagaaccggccgtgaccgactcggaccgatg

SEQ ID NO: 14364 - DNA, 203 bp, Homo sapiens
  source 1..203: mol_type = other DNA
ggcgcgccagtcctgtctacccagccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaccggcgggtgaccgactcggaccgatg

SEQ ID NO: 14365 - DNA, 203 bp, Homo sapiens
  source 1..203: mol_type = other DNA
ggcgcgccagtcctgttgtaactgccgcccgcccctattgttccgcccccggcctcccgcccttccccttcccgcccgctccccttttcccctcagtcgcctcgcgcctgcagtttttggctttcacccccaaccagtgaccaaagacttgaccactccacggaatcgagaacagaacactgctcgaccgactcggaccgatg

SEQ ID NO: 14366 - DNA, 203 bp, Homo sapiens
  source 1..203: mol_type = other DNA
ggcgcgccagtcctgtggttgactccgcccgcccctattgttccgcccccggcctcccgcccttccccttcccgcccgctccccttttcccctcagtcgcctcgcgcctgcagtttttggctttcacccccaaccagtgaccaaagacttgaccactctactcccagctccccagatactccctcgaccgactcggaccgatg

SEQ ID NO: 14367 - DNA, 203 bp, Homo sapiens
  source 1..203: mol_type = other DNA
ggcgcgccagtcctatgagttgacccgcccgcccctattgttccgcccccggcctcccgcccttccccttcccgcccgctccccttttcccctcagtcgcctcgcgcctgcagtttttggctttcacccccaaccagtgaccaaagacttgaccactcttcttggcaaaccccagattcttggcaaaccgactcggaccgatg

SEQ ID NO: 14368 - DNA, 203 bp, Homo sapiens
  source 1..203: mol_type = other DNA
ggcgcgccagtcctgtgaatcagtccgcccgcccctattgttccgcccccggcctcccgcccttccccttcccgcccgctccccttttcccctcagtcgcctcgtactcccagtttttggcttactcccccaaccagtgatactccccttgaccactctactcccagctccccagatactccctcgaccgactcggaccgatg

SEQ ID NO: 14369 - DNA, 203 bp, Homo sapiens
  source 1..203: mol_type = other DNA
ggcgcgccagtcctctgacaaaacccgcccgcccctattgttccgccccctactccccgcccttcccctactcccccgctcccctttactccccagtcgcctcgtactcccagtttttggcttactcccccaaccagtgatactccccttgaccactctactcccagctccccagatactccctcgaccgactcggaccgatg

SEQ ID NO: 14370 - DNA, 203 bp, Homo sapiens
  source 1..203: mol_type = other DNA
ggcgcgccagtcctcagtaactacccgcccgcccctattgttccgcccccttcttggcaaacttccccttcttggcaaatccccttttcttggcaaacgcctcgttcttggcaaatttggctttcttggcaaaccagtgattcttggcaaaaccactcttcttggcaaaccccagattcttggcaaaccgactcggaccgatg

SEQ ID NO: 14371 - DNA, 203 bp, Homo sapiens
  source 1..203: mol_type = other DNA
ggcgcgccagtcctgtcacagttgccgcccgcccggcgggttccgcccccccggcgggtcccttccccccggcgggtgctccccttccggcgggtgtcgcctcgccggcgggttttttggctccggcgggtaaccagtgaccggcgggttgaccactcccggcgggtctccccagaccggcgggtgaccgactcggaccgatg

SEQ ID NO: 14372 - DNA, 203 bp, Homo sapiens
  source 1..203: mol_type = other DNA
ggcgcgccagtcctgagaccagacccgcccgccgtcaattcctttacccccgtcaattcctttacccccgtcaattcctttaccttcgtcaattcctttactcgcgtcaattcctttaggctcgtcaattcctttagtgacgtcaattcctttaactccgtcaattcctttacagaacactgctcgaccgactcggaccgatg

SEQ ID NO: 14373 - DNA, 203 bp, Homo sapiens
  source 1..203: mol_type = other DNA
ggcgcgccagtcctgtcaagcgttccgcccgctactcccgttccgccccctactccccgcccttcccctactcccccgctcccctttactccccagtcgcctcgtactcccagtttttggcttactcccccaaccagtgatactccccttgaccactctactcccagctccccagatactccctcgaccgactcggaccgatg

SEQ ID NO: 14374 - DNA, 203 bp, Homo sapiens
  source 1..203: mol_type = other DNA
ggcgcgccagtcctccagagaaacccgcccgcttcttggcaaacgcccccttcttggcaaacttccccttcttggcaaatccccttttcttggcaaacgcctcgttcttggcaaatttggctttcttggcaaaccagtgattcttggcaaaaccactcttcttggcaaaccccagattcttggcaaaccgactcggaccgatg

SEQ ID NO: 14375 - DNA, 203 bp, Homo sapiens
  source 1..203: mol_type = other DNA
ggcgcgccagtcctgtagaccgacccgtcaattcctttatcactagcaacctcaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14376 - DNA, 203 bp, Homo sapiens
  source 1..203: mol_type = other DNA
ggcgcgccagtcctgttcaagaaccgagatgccatgtggacgagggcgtgcacggaatcgagaataaccacggaatcgagaacttgcacggaatcgagaagttacacggaatcgagaaagtacacggaatcgagaagttgcacggaatcgagaaaccacacggaatcgagaactgctgtacatggcaccgactcggaccgatg

SEQ ID NO: 14377 - DNA, 203 bp, Homo sapiens
  source 1..203: mol_type = other DNA
ggcgcgccagtcctgtcctgtcagcgagatgccatgtggacgagggcgtgcccacggtgtatcttaacccaggcgggggccgcttgggtgaaatagggttgttaccggcgggtttgggagtaccggcgggtagggtgttgccggcgggtgctacaccaccggcgggtaaactctgcccggcgggtcaccgactcggaccgatg

SEQ ID NO: 14378 - DNA, 203 bp, Homo sapiens
  source 1..203: mol_type = other DNA
ggcgcgccagtcctttcacttgaccgagatgccatgtggacgagggcgtgcccacggtgtatcttaacccaggcgggggccgcttgggtgaaatagggttgttacgtcaattcctttaagtacgtcaattcctttagttgcgtcaattcctttaaccacgtcaattcctttactgctgtacatggcaccgactcggaccgatg

SEQ ID NO: 14379 - DNA, 203 bp, Homo sapiens
  source 1..203: mol_type = other DNA
ggcgcgccagtcctgtctctgttacgagatgccatgtggacgagggcgtgcccacggtgtatcttaacccaggcgggggccgcttgggtgaaatagggttgttatacaagcctttgggagtaaccggccgtagggtgttgaccggccgtgctacaccaaccggccgtaaactctgcaccggccgtcaccgactcggaccgatg

SEQ ID NO: 14380 - DNA, 203 bp, Homo sapiens
  source 1..203: mol_type = other DNA
ggcgcgccagtcctgtgagagcctcgagatgccatgtggacgagggcgtgcccacggtgtatcttaacccaggcgggggccgcttgggtgaaatagggttgttatacaagcctttgggagtacacggaatcgagaagttgcacggaatcgagaaaccacacggaatcgagaactgctgtacatggcaccgactcggaccgatg

SEQ ID NO: 14381 - DNA, 203 bp, Homo sapiens
  source 1..203: mol_type = other DNA
ggcgcgccagtcctgtccactagtcgagatgccatgtggacgagggcgtgcccacggtgtatcttaacccaggcgggggccgcttgggtgaaatagggttgttatacaagcctttgggagtacagcctgatagggtgttgcagagacctgctacaccaccggcgggtaaactctgcccggcgggtcaccgactcggaccgatg

SEQ ID NO: 14382 - DNA, 203 bp, Homo sapiens
  source 1..203: mol_type = other DNA
ggcgcgccagtcctgtgaccaaagcgagatgccatgtggacgagggcgtgcccacggtgtatcttaacccaggcgggggccgcttgggtgaaatagggttgttatacaagcctttgggagtacagcctgatagggtgttgcagagacctgctacaccacgtcaattcctttactgctgtacatggcaccgactcggaccgatg

SEQ ID NO: 14383 - DNA, 203 bp, Homo sapiens
  source 1..203: mol_type = other DNA
ggcgcgccagtcctgagtagataccgagatgccatgtggacgagggcgtgcccacggtgtatcttaacccaggcgggggccgcttgggtgaaatagggttgttatacaagcctttgggagtacagcctgatagggtgttgcagagacctgctacaccactagtataaaaactctgcccggcgggtcaccgactcggaccgatg

SEQ ID NO: 14384 - DNA, 203 bp, Homo sapiens
  source 1..203: mol_type = other DNA
ggcgcgccagtcctgtgaccggttcgagatgccatgtggacgagggcgtgcccacggtgtatcttaacccaggcgggggccgcttgggtgaaatagggttgttatacaagcctttgggagtacagcctgatagggtgttgcagagacctgctacaccattcttggcaaaactctgcttcttggcaaaccgactcggaccgatg

SEQ ID NO: 14385 - DNA, 203 bp, Homo sapiens
  source 1..203: mol_type = other DNA
ggcgcgccagtcctgtcaacgtaccgagatgccatgtggacgagggcgtgcccacggtgtatcttaacccaggcgggggccgcttgggtgaaatagggttgttatacaagcctttgggagtacgtcaattcctttagttgcgtcaattcctttaaccacgtcaattcctttactgctgtacatggcaccgactcggaccgatg

SEQ ID NO: 14386 - DNA, 203 bp, Homo sapiens
  source 1..203: mol_type = other DNA
ggcgcgccagtcctgcagtcagaccgagatgccatgtggacgagggcgtgcccacggtgtatcttaaccgtcaattcctttacttgcgtcaattcctttagttacgtcaattcctttaagtacgtcaattcctttagttgcgtcaattcctttaaccacgtcaattcctttactgctgtacatggcaccgactcggaccgatg

SEQ ID NO: 14387 - DNA, 203 bp, Homo sapiens
  source 1..203: mol_type = other DNA
ggcgcgccagtcctagtatgcaaccgagatgccatgtggacgagggcgtgcccacggtgtatcttaacttcttggcaaaccgcttgttcttggcaaagttgttattcttggcaaagggagtattcttggcaaaggtgttgttcttggcaaatacaccattcttggcaaaactctgcttcttggcaaaccgactcggaccgatg

SEQ ID NO: 14388 - DNA, 203 bp, Homo sapiens
  source 1..203: mol_type = other DNA
ggcgcgccagtccttgaatcctaccgagatgccatgtggacgagggcgtgttcttggcaaatcttaacttcttggcaaaccgcttgttcttggcaaagttgttattcttggcaaagggagtattcttggcaaaggtgttgttcttggcaaatacaccattcttggcaaaactctgcttcttggcaaaccgactcggaccgatg

SEQ ID NO: 14389 - DNA, 203 bp, Homo sapiens
  source 1..203: mol_type = other DNA
ggcgcgccagtcctcagaagttaccgccgggcaccggccgtgagcgtgagaccggccgtgcgttgcgtaccggccgttctgtgagcaccggccgtatacaccataccggccgttcaccctccaccggccgtaaaatttataccggccgtgttatcattaccggccgttggtggcagaccggccgtaggcgactcggaccgatg

SEQ ID NO: 14390 - DNA, 203 bp, Homo sapiens
  source 1..203: mol_type = other DNA
ggcgcgccagtccttgtcttggaccgccgggccacggaatcgagaatgagcacggaatcgagaagcgtcacggaatcgagaagagccacggaatcgagaaccatcacggaatcgagaactcccacggaatcgagaattatcacggaatcgagaacattcacggaatcgagaagcagacatgtccaaggcgactcggaccgatg

SEQ ID NO: 14391 - DNA, 203 bp, Homo sapiens
  source 1..203: mol_type = other DNA
ggcgcgccagtcctgttaacagaccgccgggcccggcgggtgagcgtgagccggcgggtgcgttgcgtccggcgggttctgtgagcccggcgggtatacaccatccggcgggttcaccctccccggcgggtaaaatttatccggcgggtgttatcattccggcgggttggtggcagccggcgggtaggcgactcggaccgatg

SEQ ID NO: 14392 - DNA, 203 bp, Homo sapiens
  source 1..203: mol_type = other DNA
ggcgcgccagtccttgcaagtaaccgccgggcctacagcgggagcgtgagaccggccgtgcgttgcgtaccggccgttctgtgagcaccggccgtatacaccataccggccgttcaccctccaccggccgtaaaatttataccggccgtgttatcattaccggccgttggtggcagaccggccgtaggcgactcggaccgatg

SEQ ID NO: 14393 - DNA, 203 bp, Homo sapiens
  source 1..203: mol_type = other DNA
ggcgcgccagtccttaagtaggaccgccgggcctacagcgggagcgtgagcacggaatcgagaagcgtcacggaatcgagaagagccacggaatcgagaaccatcacggaatcgagaactcccacggaatcgagaattatcacggaatcgagaacattcacggaatcgagaagcagacatgtccaaggcgactcggaccgatg

SEQ ID NO: 14394 - DNA, 203 bp, Homo sapiens
  source 1..203: mol_type = other DNA
ggcgcgccagtcctgtaactacagcgccgggcctacagcgggagcgtgagcgtcaattcctttagcgtcgtcaattcctttagagccgtcaattcctttaccatcgtcaattcctttactcccgtcaattcctttattatcgtcaattcctttacattcgtcaattcctttagcagacatgtccaaggcgactcggaccgatg

SEQ ID NO: 14395 - DNA, 203 bp, Homo sapiens
  source 1..203: mol_type = other DNA
ggcgcgccagtcctgttcagagaacgccgggcctacagcgggagcgtgaggaaagccgtgcgttgcgtaccggccgttctgtgagcaccggccgtatacaccataccggccgttcaccctccaccggccgtaaaatttataccggccgtgttatcattaccggccgttggtggcagaccggccgtaggcgactcggaccgatg

SEQ ID NO: 14396 - DNA, 203 bp, Homo sapiens
  source 1..203: mol_type = other DNA
ggcgcgccagtcctatcggtgaaccgccgggcctacagcgggagcgtgaggaaagccgtgcgttgcgtcgtcaattcctttagagccgtcaattcctttaccatcgtcaattcctttactcccgtcaattcctttattatcgtcaattcctttacattcgtcaattcctttagcagacatgtccaaggcgactcggaccgatg

SEQ ID NO: 14397 - DNA, 203 bp, Homo sapiens
  source 1..203: mol_type = other DNA
ggcgcgccagtcctctaagttcaccgccgggcctacagcgggagcgtgaggaaagccgtgcgttgcgttactccccatctgtgagctactcccgtatacaccattactcccgctcaccctcctactcccaaaaaatttattactcccaagttatcatttactcccaatggtggcagtactccccaaggcgactcggaccgatg

SEQ ID NO: 14398 - DNA, 203 bp, Homo sapiens
  source 1..203: mol_type = other DNA
ggcgcgccagtcctcaagaatcatcgccgggcctacagcgggagcgtgaggaaagccgtgcgttgcgttccaaggcatctgtgagcccgcggagtatacaccatcacggaatcgagaactcccacggaatcgagaattatcacggaatcgagaacattcacggaatcgagaagcagacatgtccaaggcgactcggaccgatg

SEQ ID NO: 14399 - DNA, 203 bp, Homo sapiens
  source 1..203: mol_type = other DNA
ggcgcgccagtcctcaacgagttacgccgggcctacagcgggagcgtgaggaaagccgtgcgttgcgttccaaggcatctgtgagcccgcggagtatacaccatcgtcaattcctttactcccgtcaattcctttattatcgtcaattcctttacattcgtcaattcctttagcagacatgtccaaggcgactcggaccgatg

SEQ ID NO: 14400 - DNA, 203 bp, Homo sapiens
  source 1..203: mol_type = other DNA
ggcgcgccagtcctccaacgatctcgccgggcctacagcgggagcgtgaggaaagccgtgcgttgcgttccaaggcatctgtgagcccgcggagtatacaccatgagcaaagctcaccctcccacggaatcgagaattatcacggaatcgagaacattcacggaatcgagaagcagacatgtccaaggcgactcggaccgatg

SEQ ID NO: 14401 - DNA, 203 bp, Homo sapiens
  source 1..203: mol_type = other DNA
ggcgcgccagtcctctcttcaaagcgccgggcctacagcgggagcgtgaggaaagccgtgcgttgcgttccaaggcatctgtgagcccgcggagtatacaccatgagcaaagctcaccctcccgagttgaaaaaatttatcgtcaattcctttacattcgtcaattcctttagcagacatgtccaaggcgactcggaccgatg

SEQ ID NO: 14402 - DNA, 203 bp, Homo sapiens
  source 1..203: mol_type = other DNA
ggcgcgccagtcctctcaccatgtcgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattccggcgggttggtggcagccggcgggtaggcgactcggaccgatg

SEQ ID NO: 14403 - DNA, 203 bp, Homo sapiens
  source 1..203: mol_type = other DNA
ggcgcgccagtcctctagagtaaacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattcgtcaattcctttagcagacatgtccaaggcgactcggaccgatg

SEQ ID NO: 14404 - DNA, 203 bp, Homo sapiens
  source 1..203: mol_type = other DNA
ggcgcgccagtcctctgagcctaccgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagaccggccgtaggcgactcggaccgatg

SEQ ID NO: 14405 - DNA, 203 bp, Homo sapiens
  source 1..203: mol_type = other DNA
ggcgcgccagtccttcaaagagatcgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagccggcgggtaggcgactcggaccgatg

SEQ ID NO: 14406 - DNA, 203 bp, Homo sapiens
  source 1..203: mol_type = other DNA
ggcgcgccagtccttgaagacgaccgccgggcctacagcgggagcgtgaggaaagccgtgcgttgcgttccaaggcatctgtgagcccgcggagtatacaccatgagcaaagctcaccctcccgagttgaaaaaatttattactcccaagttatcatttactcccaatggtggcagtactccccaaggcgactcggaccgatg

SEQ ID NO: 14407 - DNA, 203 bp, Homo sapiens
  source 1..203: mol_type = other DNA
ggcgcgccagtcctgatcacaagtcgccgggcctacagcgggagcgtgaggaaagccgtgcgttgcgttccaaggcatctgtgagcccgcggagtatacaccatgagcaaagctcaccctcccgagttgaaaaaatttatttcttggcaaatatcattttcttggcaaagtggcagttcttggcaaagcgactcggaccgatg

SEQ ID NO: 14408 - DNA, 203 bp, Homo sapiens
  source 1..203: mol_type = other DNA
ggcgcgccagtcctacgctagacacgccgggcctacagcgggagcgtgaggaaagccgtgcgttgcgttccaaggcatctgtgagcccgcggagtatacaccattactcccgctcaccctcctactcccaaaaaatttattactcccaagttatcatttactcccaatggtggcagtactccccaaggcgactcggaccgatg

SEQ ID NO: 14409 - DNA, 203 bp, Homo sapiens
  source 1..203: mol_type = other DNA
ggcgcgccagtccttaactagcgtcgccgggcctacagcgggagcgtgaggaaagccgtgcgttgcgttccaaggcatctgtgagcccgcggagtatacaccatttcttggcaaaaccctccttcttggcaaaaatttatttcttggcaaatatcattttcttggcaaagtggcagttcttggcaaagcgactcggaccgatg

SEQ ID NO: 14410 - DNA, 203 bp, Homo sapiens
  source 1..203: mol_type = other DNA
ggcgcgccagtcctagagtcctagcgccgggcctacagcgggagcgtgaggaaagccgtgcgttgcgttccaaggcatctgtgagcccggcgggtatacaccatccggcgggttcaccctccccggcgggtaaaatttatccggcgggtgttatcattccggcgggttggtggcagccggcgggtaggcgactcggaccgatg

SEQ ID NO: 14411 - DNA, 203 bp, Homo sapiens
  source 1..203: mol_type = other DNA
ggcgcgccagtcctcagagtcctacgccgggcctacagcgggagcgtgaggaaagccgtgcgttgcgttccaaggcatctgtgagccgtcaattcctttaccatcgtcaattcctttactcccgtcaattcctttattatcgtcaattcctttacattcgtcaattcctttagcagacatgtccaaggcgactcggaccgatg

SEQ ID NO: 14412 - DNA, 203 bp, Homo sapiens
  source 1..203: mol_type = other DNA
ggcgcgccagtcctaaaccgttcactccggaaaccggccgtagaattcataccggccgtgaatttttaaccggccgtacaaaaagaaccggccgttgccgaaacaccggccgtttagagaataccggccgtaaaagagaaaccggccgtaaggaaaagaccggccgtgaacgtgaaaccggccgtctacgactcggaccgatg

SEQ ID NO: 14413 - DNA, 203 bp, Homo sapiens
  source 1..203: mol_type = other DNA
ggcgcgccagtcctaccgttcatactccggaaagtgataacagaattcataccggccgtgaatttttaaccggccgtacaaaaagaaccggccgttgccgaaacaccggccgtttagagaataccggccgtaaaagagaaaccggccgtaaggaaaagaccggccgtgaacgtgaaaccggccgtctacgactcggaccgatg

SEQ ID NO: 14414 - DNA, 203 bp, Homo sapiens
  source 1..203: mol_type = other DNA
ggcgcgccagtcctatggtcacagctccggaaagtgataacagaattcatcgtcaattcctttatttacgtcaattcctttaaagacgtcaattcctttaaaaccgtcaattcctttagaatcgtcaattcctttaagaacgtcaattcctttaaaagcgtcaattcctttatgaaaaggaagagctacgactcggaccgatg

SEQ ID NO: 14415 - DNA, 203 bp, Homo sapiens
  source 1..203: mol_type = other DNA
ggcgcgccagtcctagctaacgtactccggaaagtgataacagaattcattgaagtggagaatttttaaagaaggtaacaaaaagagaaagaaaatgccgaaaccaggcacaattagagaatgaaaagaagaaaagagaaatagcagaaaaggaaaaggaaagaatagaacgtgaaccggcgggtctacgactcggaccgatg

SEQ ID NO: 14416 - DNA, 203 bp, Homo sapiens
  source 1..203: mol_type = other DNA
ggcgcgccagtcctttgttcagtgctccggaaagtgataacagaattcattgaagtggagaatttttaaagaaggtaacaaaaagagaaagaaaatgccgaaaccaggcacaattagagaatgaaaagaagaaaagagaaatagcagaaaaggaaaaggaaagaatagaacgtgaattcttggcaaaacgactcggaccgatg

SEQ ID NO: 14417 - DNA, 203 bp, Homo sapiens
  source 1..203: mol_type = other DNA
ggcgcgccagtcctctcaactgaactccggaaagtgataacagaattcattgaagtggagaatttttaaagaaggtaacaaaaagagaaagaaaatgccgaaaccaggcacaattagagaatgaaaagaagaaaagagaacgtcaattcctttaaaagcgtcaattcctttatgaaaaggaagagctacgactcggaccgatg

SEQ ID NO: 14418 - DNA, 203 bp, Homo sapiens
  source 1..203: mol_type = other DNA
ggcgcgccagtcctagagactgaactccggaaagtgataacagaattcattgaagtggagaatttttaaagaaggtaacaaaaagagaaagaaaatgccgaaaccaggcacaattagagaatgaaaagaagaaaagagaattcttggcaaaggaaaagttcttggcaaaacgtgaattcttggcaaaacgactcggaccgatg

SEQ ID NO: 14419 - DNA, 203 bp, Homo sapiens
  source 1..203: mol_type = other DNA
ggcgcgccagtcctgagtactgaactccggaaagtgataacagaattcattgaagtggagaatttttaaagaaggtaacaaaaagagaaagaaaatgccgaaaccgtcaattcctttagaatcgtcaattcctttaagaacgtcaattcctttaaaagcgtcaattcctttatgaaaaggaagagctacgactcggaccgatg

SEQ ID NO: 14420 - DNA, 203 bp, Homo sapiens
  source 1..203: mol_type = other DNA
ggcgcgccagtccttcactgaaagctccggaaagtgataacagaattcattgaagtggagaatttttaaagaaggtaacaaaaagagaaagaaaatgccgaaacttcttggcaaaagagaatttcttggcaaaaagagaattcttggcaaaggaaaagttcttggcaaaacgtgaattcttggcaaaacgactcggaccgatg

SEQ ID NO: 14421 - DNA, 203 bp, Homo sapiens
  source 1..203: mol_type = other DNA
ggcgcgccagtcctcccaacggtcctccggaaagtgataacagaattcattgaagtggagaatttttaaagaaggtaacaaaaagatactcccaatgccgaaactactcccaattagagaattactcccagaaaagagaatactcccaaaaggaaaagtactccctagaacgtgaatactcccagctacgactcggaccgatg

SEQ ID NO: 14422 - DNA, 203 bp, Homo sapiens
  source 1..203: mol_type = other DNA
ggcgcgccagtcctgttgggtcagctccggaaagtgataacagaattcattgaagtggagaatttttaccggcgggtacaaaaagaccggcgggttgccgaaacccggcgggtttagagaatccggcgggtaaaagagaaccggcgggtaaggaaaagccggcgggtgaacgtgaaccggcgggtctacgactcggaccgatg

SEQ ID NO: 14423 - DNA, 203 bp, Homo sapiens
  source 1..203: mol_type = other DNA
ggcgcgccagtcctaaagagagacctccggaattcttggcaaaaattcatttcttggcaaaatttttattcttggcaaaaaaaagattcttggcaaaccgaaacttcttggcaaaagagaatttcttggcaaaaagagaattcttggcaaaggaaaagttcttggcaaaacgtgaattcttggcaaaacgactcggaccgatg

SEQ ID NO: 14424 - DNA, 203 bp, Homo sapiens
  source 1..203: mol_type = other DNA
ggcgcgccagtccttccacggtgcctgaagtgacaagccacgctgcttctcacggaatcgagaaccaacacggaatcgagaacccccacggaatcgagaagtcacacggaatcgagaacgttcacggaatcgagaaccaccacggaatcgagaaggatcacggaatcgagaaaacagaaagtaaaaaacgactcggaccgatg

SEQ ID NO: 14425 - DNA, 203 bp, Homo sapiens
  source 1..203: mol_type = other DNA
ggcgcgccagtcctactcaccttactgaagtgacaagccacgctgcttctccggcgggtgctgaccaaccggcgggtatccaccccccggcgggtctcaggtcaccggcgggtgccctcgttccggcgggttatccccacccggcgggtggtgaggatccggcgggtcactcaacaccggcgggtaaacgactcggaccgatg

SEQ ID NO: 14426 - DNA, 203 bp, Homo sapiens
  source 1..203: mol_type = other DNA
ggcgcgccagtcctacccaagcgactgaagtgacaagccacgctgcttctggagccaaagctgaccaacgtcaattcctttacccccgtcaattcctttagtcacgtcaattcctttacgttcgtcaattcctttaccaccgtcaattcctttaggatcgtcaattcctttaaacagaaagtaaaaaacgactcggaccgatg

SEQ ID NO: 14427 - DNA, 203 bp, Homo sapiens
  source 1..203: mol_type = other DNA
ggcgcgccagtcctcccaagcttgctgaagtgacaagccacgctgcttctggagccaaagctgaccaagaagaacaaatccaccccaccggccgtctcaggtcaaccggccgtgccctcgttaccggccgttatccccacaccggccgtggtgaggataccggccgtcactcaacaaccggccgtaaacgactcggaccgatg

SEQ ID NO: 14428 - DNA, 203 bp, Homo sapiens
  source 1..203: mol_type = other DNA
ggcgcgccagtcctgacccaagtcctgaagtgacaagccacgctgcttctggagccaaagctgaccaagaagaacaaatccaccccagatctagactcaggtcaaccggccgtgccctcgttaccggccgttatccccacaccggccgtggtgaggataccggccgtcactcaacaaccggccgtaaacgactcggaccgatg

SEQ ID NO: 14429 - DNA, 203 bp, Homo sapiens
  source 1..203: mol_type = other DNA
ggcgcgccagtcctattcttgggtctgaagtgacaagccacgctgcttctggagccaaagctgaccaagaagaacaaatccaccccagatctagactcaggtcacctcctgaagccctcgttaccggccgttatccccacaccggccgtggtgaggataccggccgtcactcaacaaccggccgtaaacgactcggaccgatg

SEQ ID NO: 14430 - DNA, 203 bp, Homo sapiens
  source 1..203: mol_type = other DNA
ggcgcgccagtcctagactacggtctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacatactcccaaaaacgactcggaccgatg

SEQ ID NO: 14431 - DNA, 203 bp, Homo sapiens
  source 1..203: mol_type = other DNA
ggcgcgccagtcctctaccgtaagctgaagtgacaagccacgctgcttctggagccaaagctgaccaagaagaacaaatccaccccagatctagactcaggtcacctcctgaagccctcgttcagggtcgatatccccactactcccacggtgaggattactcccaccactcaacatactcccaaaaacgactcggaccgatg

SEQ ID NO: 14432 - DNA, 203 bp, Homo sapiens
  source 1..203: mol_type = other DNA
ggcgcgccagtcctctacggttaactgaagtgacaagccacgctgcttctggagccaaagctgaccaagaagaacaaatccaccccagatctagactcaggtcacctcctgaagccctcgttccggcgggttatccccacccggcgggtggtgaggatccggcgggtcactcaacaccggcgggtaaacgactcggaccgatg

SEQ ID NO: 14433 - DNA, 203 bp, Homo sapiens
  source 1..203: mol_type = other DNA
ggcgcgccagtcctaatgcacattctgaagtgacaagccacgctgcttctggagccaaagctgaccaagaagaacaaatccaccccagatctagactcaggtcacgtcaattcctttacgttcgtcaattcctttaccaccgtcaattcctttaggatcgtcaattcctttaaacagaaagtaaaaaacgactcggaccgatg

SEQ ID NO: 14434 - DNA, 203 bp, Homo sapiens
  source 1..203: mol_type = other DNA
ggcgcgccagtcctcagcagcctactgaagtgacaagccacgctgcttctggagccaaagctgaccaagaagaacaaatccacccccacggaatcgagaagtcacacggaatcgagaacgttcacggaatcgagaaccaccacggaatcgagaaggatcacggaatcgagaaaacagaaagtaaaaaacgactcggaccgatg

SEQ ID NO: 14435 - DNA, 203 bp, Homo sapiens
  source 1..203: mol_type = other DNA
ggcgcgccagtcctaactttacttctgaagtgacaagccacgctgcttctggagccaaagctgaccaagaagaacaaatccacccctactcccgactcaggtcatactcccaagccctcgtttactcccgatatccccactactcccacggtgaggattactcccaccactcaacatactcccaaaaacgactcggaccgatg

SEQ ID NO: 14436 - DNA, 203 bp, Homo sapiens
  source 1..203: mol_type = other DNA
ggcgcgccagtcctacttgggtctctgaagtgacaagccacgctgcttcttactcccaagctgaccaatactcccaaatccacccctactcccgactcaggtcatactcccaagccctcgtttactcccgatatccccactactcccacggtgaggattactcccaccactcaacatactcccaaaaacgactcggaccgatg

SEQ ID NO: 14437 - DNA, 203 bp, Homo sapiens
  source 1..203: mol_type = other DNA
ggcgcgccagtcctagcacggtctctgaagtgcacggaatcgagaattctcacggaatcgagaaccaacacggaatcgagaacccccacggaatcgagaagtcacacggaatcgagaacgttcacggaatcgagaaccaccacggaatcgagaaggatcacggaatcgagaaaacagaaagtaaaaaacgactcggaccgatg

SEQ ID NO: 14438 - DNA, 203 bp, Homo sapiens
  source 1..203: mol_type = other DNA
ggcgcgccagtcctacagaccgtactgaagtgttcttggcaaatgcttctttcttggcaaatgaccaattcttggcaaaccaccccttcttggcaaacaggtcattcttggcaaacctcgttttcttggcaaatccccacttcttggcaaatgaggatttcttggcaaactcaacattcttggcaaaacgactcggaccgatg

SEQ ID NO: 14439 - DNA, 203 bp, Homo sapiens
  source 1..203: mol_type = other DNA
ggcgcgccagtcctccaccatgaactgacacaaccggccgtactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14440 - DNA, 203 bp, Homo sapiens
  source 1..203: mol_type = other DNA
ggcgcgccagtcctttttcaaaagctgacacaaccggccgtactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14441 - DNA, 203 bp, Homo sapiens
  source 1..203: mol_type = other DNA
ggcgcgccagtcctagtaactgtactgacacaaccggccgtactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14442 - DNA, 203 bp, Homo sapiens
  source 1..203: mol_type = other DNA
ggcgcgccagtccttctctgtagactgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14443 - DNA, 203 bp, Homo sapiens
  source 1..203: mol_type = other DNA
ggcgcgccagtcctacgatacccactgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14444 - DNA, 203 bp, Homo sapiens
  source 1..203: mol_type = other DNA
ggcgcgccagtcctacgtttcgttctgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14445 - DNA, 203 bp, Homo sapiens
  source 1..203: mol_type = other DNA
ggcgcgccagtcctttagctgcacctgacacaaccgtcaattcctttaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14446 - DNA, 203 bp, Homo sapiens
  source 1..203: mol_type = other DNA
ggcgcgccagtccttgcagctctgctgacacaactaccggccgtagcaacctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14447 - DNA, 203 bp, Homo sapiens
  source 1..203: mol_type = other DNA
ggcgcgccagtcctgtgcagctgcctgacacaactactcccactagcaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14448 - DNA, 203 bp, Homo sapiens
  source 1..203: mol_type = other DNA
ggcgcgccagtccttctacaaggcctgacacaactactcccactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14449 - DNA, 203 bp, Homo sapiens
  source 1..203: mol_type = other DNA
ggcgcgccagtcctccacctgcacctgacacaactccggcgggtagcaacctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14450 - DNA, 203 bp, Homo sapiens
  source 1..203: mol_type = other DNA
ggcgcgccagtcctttcatactaactgacacaactgtgtaccggccgtacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14451 - DNA, 203 bp, Homo sapiens
  source 1..203: mol_type = other DNA
ggcgcgccagtcctaatactagctctgacacaactgtgtaccggccgtacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14452 - DNA, 203 bp, Homo sapiens
  source 1..203: mol_type = other DNA
ggcgcgccagtcctaggtgagtggctgacacaactgtgtaccggccgtacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14453 - DNA, 203 bp, Homo sapiens
  source 1..203: mol_type = other DNA
ggcgcgccagtcctgaaactgcatctgacacaactgtgtcacggaatcgagaaaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14454 - DNA, 203 bp, Homo sapiens
  source 1..203: mol_type = other DNA
ggcgcgccagtcctccaagcctgtctgacacaactgtgtcacggaatcgagaaaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14455 - DNA, 203 bp, Homo sapiens
  source 1..203: mol_type = other DNA
ggcgcgccagtcctcctctctcgtctgacacaactgtgtccggcgggtacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14456 - DNA, 203 bp, Homo sapiens
  source 1..203: mol_type = other DNA
ggcgcgccagtccttaggatcaagctgacacaactgtgtccggcgggtacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14457 - DNA, 203 bp, Homo sapiens
  source 1..203: mol_type = other DNA
ggcgcgccagtcctgacgacacctctgacacaactgtgtccggcgggtacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14458 - DNA, 203 bp, Homo sapiens
  source 1..203: mol_type = other DNA
ggcgcgccagtcctttcaacgaaactgacacaactgtgtcgtcaattcctttaaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14459 - DNA, 203 bp, Homo sapiens
  source 1..203: mol_type = other DNA
ggcgcgccagtcctacaccgaactctgacacaactgtgttactccccaacctcaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14460 - DNA, 203 bp, Homo sapiens
  source 1..203: mol_type = other DNA
ggcgcgccagtcctacgttcggtgctgacacaactgtgttactccccaacctcaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14461 - DNA, 203 bp, Homo sapiens
  source 1..203: mol_type = other DNA
ggcgcgccagtcctaattcggtgtctgacacaactgtgttcaaccggccgttcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14462 - DNA, 203 bp, Homo sapiens
  source 1..203: mol_type = other DNA
ggcgcgccagtccttaaccttggactgacacaactgtgttcaccggcgggttcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14463 - DNA, 203 bp, Homo sapiens
  source 1..203: mol_type = other DNA
ggcgcgccagtccttttgaggcagctgacacaactgtgttcactaaagccgcaggctccactcctggtggtgcccttccgtcaattcctttaagtttcagctttgcaaccatactccccccggaacccaaagactttggtttcccggaagctgcccggcgggtcatgggaataacgccgccgcgaggtcgactcggaccgatg

SEQ ID NO: 14464 - DNA, 203 bp, Homo sapiens
  source 1..203: mol_type = other DNA
ggcgcgccagtcctaactgaggcactgacacaactgtgttcactaccggccgtaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14465 - DNA, 203 bp, Homo sapiens
  source 1..203: mol_type = other DNA
ggcgcgccagtccttttgtgaggcctgacacaactgtgttcactaccggccgtaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14466 - DNA, 203 bp, Homo sapiens
  source 1..203: mol_type = other DNA
ggcgcgccagtcctgcctcatggtctgacacaactgtgttcactacggaactacgacggtatctgatcgtcttcgaacctccgactttcgttcttgattaatgaaaacattcttggcaaatgctttcgctctggtccgtcttgcgccggtccaagaatttcacctctagcggcgcaatacgaagaggtcgactcggaccgatg

SEQ ID NO: 14467 - DNA, 203 bp, Homo sapiens
  source 1..203: mol_type = other DNA
ggcgcgccagtcctacgcctcagtctgacacaactgtgttcactagaccggccgtacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14468 - DNA, 203 bp, Homo sapiens
  source 1..203: mol_type = other DNA
ggcgcgccagtcctgacgaagttcctgacacaactgtgttcactagaccggccgtacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14469 - DNA, 203 bp, Homo sapiens
  source 1..203: mol_type = other DNA
ggcgcgccagtccttgtacgttgtctgacacaactgtgttcactagcaacaccggccgtacaccatggaccggccgtctcctgaggaccggccgtccgttactgaccggccgtgcaaggtgaaccggccgtaagttggtggtgaggccctgggcaggctgctggtggtctacccttggacccagaggtcgactcggaccgatg

SEQ ID NO: 14470 - DNA, 203 bp, Homo sapiens
  source 1..203: mol_type = other DNA
ggcgcgccagtcctaatcacctgtctgacacaactgtgttcactagcaacaccggccgtacaccatggaccggccgtctcctgaggaccggccgtccgttactgaccggccgtgcaaggtgaacgtggatgaagttggtgaccggccgttgggcaggcaccggccgttctacccttaccggccgtggtcgactcggaccgatg

SEQ ID NO: 14471 - DNA, 203 bp, Homo sapiens
  source 1..203: mol_type = other DNA
ggcgcgccagtcctgcttgaggacctgacacaactgtgttcactagcaacaccggccgtacaccatggaccggccgtctcctgaggaccggccgtccgttactgaccggccgtgcaaggtgaacgtggatgaagttggtgaccggccgttgggcaggctgctggtggtctacccttggacccagaggtcgactcggaccgatg

SEQ ID NO: 14472 - DNA, 203 bp, Homo sapiens
  source 1..203: mol_type = other DNA
ggcgcgccagtcctaacgaactctctgacacaactgtgttcactagcaacaccggccgtacaccatggaccggccgtctcctgaggaccggccgtccgttactgccctgtggggcaaggtgaaccggccgtaagttggtgaccggccgttgggcaggcaccggccgttctacccttaccggccgtggtcgactcggaccgatg

SEQ ID NO: 14473 - DNA, 203 bp, Homo sapiens
  source 1..203: mol_type = other DNA
ggcgcgccagtcctgtcatacccactgacacaactgtgttcactagcaacaccggccgtacaccatggaccggccgtctcctgaggaccggccgtccgttactgccctgtggggcaaggtgaaccggccgtaagttggtgaccggccgttgggcaggctgctggtggtctacccttggacccagaggtcgactcggaccgatg

SEQ ID NO: 14474 - DNA, 203 bp, Homo sapiens
  source 1..203: mol_type = other DNA
ggcgcgccagtccttattctttagctgacacaactgtgttcactagcaacaccggccgtacaccatggaccggccgtctcctgaggaccggccgtccgttactgccctgtggggcaaggtgaaccggccgtaagttggtggtgaggccctgggcaggcaccggccgttctacccttggacccagaggtcgactcggaccgatg

SEQ ID NO: 14475 - DNA, 203 bp, Homo sapiens
  source 1..203: mol_type = other DNA
ggcgcgccagtcctcccattcgtactgacacaactgtgttcactagcaacaccggccgtacaccatggaccggccgtctcctgaggaccggccgtccgttactgccctgtggggcaaggtgaacgtggatgaagttggtgaccggccgttgggcaggcaccggccgttctacccttaccggccgtggtcgactcggaccgatg

SEQ ID NO: 14476 - DNA, 203 bp, Homo sapiens
  source 1..203: mol_type = other DNA
ggcgcgccagtcctagtgcaactactgacacaactgtgttcactagcaacaccggccgtacaccatggaccggccgtctcctgaggaccggccgtccgttactgccctgtggggcaaggtgaacgtggatgaagttggtgaccggccgttgggcaggcaccggccgttctacccttggacccagaggtcgactcggaccgatg

SEQ ID NO: 14477 - DNA, 203 bp, Homo sapiens
  source 1..203: mol_type = other DNA
ggcgcgccagtcctctgcaacttactgacacaactgtgttcactagcaacaccggccgtacaccatggaccggccgtctcctgaggaccggccgtccgttactgccctgtggggcaaggtgaacgtggatgaagttggtgaccggccgttgggcaggctgctggtggtctacccttggacccagaggtcgactcggaccgatg

SEQ ID NO: 14478 - DNA, 203 bp, Homo sapiens
  source 1..203: mol_type = other DNA
ggcgcgccagtcctctaacctctcctgacacaactgtgttcactagcaacaccggccgtacaccatggaccggccgtctcctgaggaccggccgtccgttactgccctgtggggcaaggtgaacgtggatgaagttggtggtgaggccctgggcaggctgctggtggtctacccttggacccagaggtcgactcggaccgatg

SEQ ID NO: 14479 - DNA, 203 bp, Homo sapiens
  source 1..203: mol_type = other DNA
ggcgcgccagtccttgtctcagtcctgacacaactgtgttcactagcaacaccggccgtacaccatggaccggccgtctcctgaggagaagtctgccgttactgaccggccgtgcaaggtgaaccggccgtaagttggtgaccggccgttgggcaggcaccggccgttctacccttaccggccgtggtcgactcggaccgatg

SEQ ID NO: 14480 - DNA, 203 bp, Homo sapiens
  source 1..203: mol_type = other DNA
ggcgcgccagtcctacatgagacactgacacaactgtgttcactagcaacaccggccgtacaccatggaccggccgtctcctgaggagaagtctgccgttactgaccggccgtgcaaggtgaaccggccgtaagttggtgaccggccgttgggcaggcaccggccgttctacccttggacccagaggtcgactcggaccgatg

SEQ ID NO: 14481 - DNA, 203 bp, Homo sapiens
  source 1..203: mol_type = other DNA
ggcgcgccagtccttaacggtgtactgacacaactgtgttcactagcaacaccggccgtacaccatggaccggccgtctcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14482 - DNA, 203 bp, Homo sapiens
  source 1..203: mol_type = other DNA
ggcgcgccagtccttcgatcatggctgacacaactgtgttcactagcaacaccggccgtacaccatggaccggccgtctcctgaggagaagtctgccgttactgaccggccgtgcaaggtgaaccggccgtaagttggtgaccggccgttgggcaggctgctggtggtctacccttggacccagaggtcgactcggaccgatg

SEQ ID NO: 14483 - DNA, 203 bp, Homo sapiens
  source 1..203: mol_type = other DNA
ggcgcgccagtcctacaacagtttctgacacaactgtgttcactagcaacaccggccgtacaccatggaccggccgtctcctgaggagaagtctgccgttactgaccggccgtgcaaggtgaaccggccgtaagttggtggtgaggccctgggcaggctgctggtggtctacccttggacccagaggtcgactcggaccgatg

SEQ ID NO: 14484 - DNA, 203 bp, Homo sapiens
  source 1..203: mol_type = other DNA
ggcgcgccagtccttgaatgctctctgacacaactgtgttcactagcaacaccggccgtacaccatggaccggccgtctcctgaggagaagtctgccgttactgaccggccgtgcaaggtgaacgtggatgaagttggtgaccggccgttgggcaggcaccggccgttctacccttggacccagaggtcgactcggaccgatg

SEQ ID NO: 14485 - DNA, 203 bp, Homo sapiens
  source 1..203: mol_type = other DNA
ggcgcgccagtcctctttgaaaacctgacacaactgtgttcactagcaacaccggccgtacaccatggaccggccgtctcctgaggagaagtctgccgttactgaccggccgtgcaaggtgaacgtggatgaagttggtgaccggccgttgggcaggctgctggtggtctacccttggacccagaggtcgactcggaccgatg

SEQ ID NO: 14486 - DNA, 203 bp, Homo sapiens
  source 1..203: mol_type = other DNA
ggcgcgccagtcctagtacttaacctgacacaactgtgttcactagcaacaccggccgtacaccatggaccggccgtctcctgaggagaagtctgccgttactgaccggccgtgcaaggtgaacgtggatgaagttggtggtgaggccctgggcaggctgctggtggtctacccttggacccagaggtcgactcggaccgatg

SEQ ID NO: 14487 - DNA, 203 bp, Homo sapiens
  source 1..203: mol_type = other DNA
ggcgcgccagtcctaacaaagtacctgacacaactgtgttcactagcaacaccggccgtacaccatggaccggccgtctcctgaggagaagtctgccgttactgccctgtggggcaaggtgaaccggccgtaagttggtgaccggccgttgggcaggctgctggtggtctacccttaccggccgtggtcgactcggaccgatg

SEQ ID NO: 14488 - DNA, 203 bp, Homo sapiens
  source 1..203: mol_type = other DNA
ggcgcgccagtcctgaatcttcttctgacacaactgtgttcactagcaacaccggccgtacaccatggaccggccgtctcctgaggagaagtctgccgttactgccctgtggggcaaggtgaacgtggatgaagttggtgaccggccgttgggcaggcaccggccgttctacccttggacccagaggtcgactcggaccgatg

SEQ ID NO: 14489 - DNA, 203 bp, Homo sapiens
  source 1..203: mol_type = other DNA
ggcgcgccagtcctgttgtagtatctgacacaactgtgttcactagcaacaccggccgtacaccatggaccggccgtctcctgaggagaagtctgccgttactgccctgtggggcaaggtgaacgtggatgaagttggtgaccggccgttgggcaggctgctggtggtctacccttggacccagaggtcgactcggaccgatg

SEQ ID NO: 14490 - DNA, 203 bp, Homo sapiens
  source 1..203: mol_type = other DNA
ggcgcgccagtccttattcttagcctgacacaactgtgttcactagcaacaccggccgtacaccatggtgcatctgactcctgaggaccggccgtccgttactgaccggccgtgcaaggtgaaccggccgtaagttggtgaccggccgttgggcaggcaccggccgttctacccttaccggccgtggtcgactcggaccgatg

SEQ ID NO: 14491 - DNA, 203 bp, Homo sapiens
  source 1..203: mol_type = other DNA
ggcgcgccagtcctgtcttttcaactgacacaactgtgttcactagcaacaccggccgtacaccatggtgcatctgactcctgaggaccggccgtccgttactgaccggccgtgcaaggtgaaccggccgtaagttggtgaccggccgttgggcaggctgctggtggtctacccttaccggccgtggtcgactcggaccgatg

SEQ ID NO: 14492 - DNA, 203 bp, Homo sapiens
  source 1..203: mol_type = other DNA
ggcgcgccagtccttaagttactcctgacacaactgtgttcactagcaacaccggccgtacaccatggtgcatctgactcctgaggaccggccgtccgttactgaccggccgtgcaaggtgaaccggccgtaagttggtggtgaggccctgggcaggctgctggtggtctacccttaccggccgtggtcgactcggaccgatg

SEQ ID NO: 14493 - DNA, 203 bp, Homo sapiens
  source 1..203: mol_type = other DNA
ggcgcgccagtccttaactcaaacctgacacaactgtgttcactagcaacaccggccgtacaccatggtgcatctgactcctgaggaccggccgtccgttactgaccggccgtgcaaggtgaaccggccgtaagttggtggtgaggccctgggcaggctgctggtggtctacccttggacccagaggtcgactcggaccgatg

SEQ ID NO: 14494 - DNA, 203 bp, Homo sapiens
  source 1..203: mol_type = other DNA
ggcgcgccagtcctatgtagaaacctgacacaactgtgttcactagcaacaccggccgtacaccatggtgcatctgactcctgaggaccggccgtccgttactgaccggccgtgcaaggtgaacgtggatgaagttggtgaccggccgttgggcaggcaccggccgttctacccttggacccagaggtcgactcggaccgatg

SEQ ID NO: 14495 - DNA, 203 bp, Homo sapiens
  source 1..203: mol_type = other DNA
ggcgcgccagtcctacgaaggatcctgacacaactgtgttcactagcaacaccggccgtacaccatggtgcatctgactcctgaggaccggccgtccgttactgaccggccgtgcaaggtgaacgtggatgaagttggtgaccggccgttgggcaggctgctggtggtctacccttggacccagaggtcgactcggaccgatg

SEQ ID NO: 14496 - DNA, 203 bp, Homo sapiens
  source 1..203: mol_type = other DNA
ggcgcgccagtcctcttcatacagctgacacaactgtgttcactagcaacaccggccgtacaccatggtgcatctgactcctgaggaccggccgtccgttactgccctgtggggcaaggtgaaccggccgtaagttggtggtgaggccctgggcaggcaccggccgttctacccttaccggccgtggtcgactcggaccgatg

SEQ ID NO: 14497 - DNA, 203 bp, Homo sapiens
  source 1..203: mol_type = other DNA
ggcgcgccagtccttcgttgtatgctgacacaactgtgttcactagcaacaccggccgtacaccatggtgcatctgactcctgaggaccggccgtccgttactgccctgtggggcaaggtgaaccggccgtaagttggtggtgaggccctgggcaggcaccggccgttctacccttggacccagaggtcgactcggaccgatg

SEQ ID NO: 14498 - DNA, 203 bp, Homo sapiens
  source 1..203: mol_type = other DNA
ggcgcgccagtcctctctgtatggctgacacaactgtgttcactagcaacaccggccgtacaccatggtgcatctgactcctgaggaccggccgtccgttactgccctgtggggcaaggtgaaccggccgtaagttggtggtgaggccctgggcaggctgctggtggtctacccttaccggccgtggtcgactcggaccgatg

SEQ ID NO: 14499 - DNA, 203 bp, Homo sapiens
  source 1..203: mol_type = other DNA
ggcgcgccagtcctatgtatgtagctgacacaactgtgttcactagcaacaccggccgtacaccatggtgcatctgactcctgaggaccggccgtccgttactgccctgtggggcaaggtgaaccggccgtaagttggtggtgaggccctgggcaggctgctggtggtctacccttggacccagaggtcgactcggaccgatg

SEQ ID NO: 14500 - DNA, 203 bp, Homo sapiens
  source 1..203: mol_type = other DNA
ggcgcgccagtccttgtatgagatctgacacaactgtgttcactagcaacaccggccgtacaccatggtgcatctgactcctgaggaccggccgtccgttactgccctgtggggcaaggtgaacgtggatgaagttggtgaccggccgttgggcaggcaccggccgttctacccttggacccagaggtcgactcggaccgatg

SEQ ID NO: 14501 - DNA, 203 bp, Homo sapiens
  source 1..203: mol_type = other DNA
ggcgcgccagtccttgtatgaagactgacacaactgtgttcactagcaacaccggccgtacaccatggtgcatctgactcctgaggaccggccgtccgttactgccctgtggggcaaggtgaacgtggatgaagttggtgaccggccgttgggcaggctgctggtggtctacccttaccggccgtggtcgactcggaccgatg

SEQ ID NO: 14502 - DNA, 203 bp, Homo sapiens
  source 1..203: mol_type = other DNA
ggcgcgccagtcctatcagacgaactgacacaactgtgttcactagcaacaccggccgtacaccatggtgcatctgactcctgaggaccggccgtccgttactgccctgtggggcaaggtgaacgtggatgaagttggtggtgaggccctgggcaggcaccggccgttctacccttggacccagaggtcgactcggaccgatg

SEQ ID NO: 14503 - DNA, 203 bp, Homo sapiens
  source 1..203: mol_type = other DNA
ggcgcgccagtccttcagaagttactgacacaactgtgttcactagcaacaccggccgtacaccatggtgcatctgactcctgaggaccggccgtccgttactgccctgtggggcaaggtgaacgtggatgaagttggtggtgaggccctgggcaggctgctggtggtctacccttggacccagaggtcgactcggaccgatg

SEQ ID NO: 14504 - DNA, 203 bp, Homo sapiens
  source 1..203: mol_type = other DNA
ggcgcgccagtcctactggtaggactgacacaactgtgttcactagcaacaccggccgtacaccatggtgcatctgactcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14505 - DNA, 203 bp, Homo sapiens
  source 1..203: mol_type = other DNA
ggcgcgccagtcctaggatacctcctgacacaactgtgttcactagcaacaccggccgtacaccatggtgcatctgactcctgaggagaagtctgccgttactgaccggccgtgcaaggtgaaccggccgtaagttggtggtgaggccctgggcaggcaccggccgttctacccttggacccagaggtcgactcggaccgatg

SEQ ID NO: 14506 - DNA, 203 bp, Homo sapiens
  source 1..203: mol_type = other DNA
ggcgcgccagtcctgaggtatgacctgacacaactgtgttcactagcaacaccggccgtacaccatggtgcatctgactcctgaggagaagtctgccgttactgaccggccgtgcaaggtgaaccggccgtaagttggtggtgaggccctgggcaggctgctggtggtctacccttggacccagaggtcgactcggaccgatg

SEQ ID NO: 14507 - DNA, 203 bp, Homo sapiens
  source 1..203: mol_type = other DNA
ggcgcgccagtcctgtgctgaactctgacacaactgtgttcactagcaacaccggccgtacaccatggtgcatctgactcctgaggagaagtctgccgttactgaccggccgtgcaaggtgaacgtggatgaagttggtgaccggccgttgggcaggctgctggtggtctacccttggacccagaggtcgactcggaccgatg

SEQ ID NO: 14508 - DNA, 203 bp, Homo sapiens
  source 1..203: mol_type = other DNA
ggcgcgccagtcctgcagttcacactgacacaactgtgttcactagcaacaccggccgtacaccatggtgcatctgactcctgaggagaagtctgccgttactgaccggccgtgcaaggtgaacgtggatgaagttggtggtgaggccctgggcaggcaccggccgttctacccttggacccagaggtcgactcggaccgatg

SEQ ID NO: 14509 - DNA, 203 bp, Homo sapiens
  source 1..203: mol_type = other DNA
ggcgcgccagtcctcagcagttctctgacacaactgtgttcactagcaacaccggccgtacaccatggtgcatctgactcctgaggagaagtctgccgttactgaccggccgtgcaaggtgaacgtggatgaagttggtggtgaggccctgggcaggctgctggtggtctacccttaccggccgtggtcgactcggaccgatg

SEQ ID NO: 14510 - DNA, 203 bp, Homo sapiens
  source 1..203: mol_type = other DNA
ggcgcgccagtcctctaccagtagctgacacaactgtgttcactagcaacaccggccgtacaccatggtgcatctgactcctgaggagaagtctgccgttactgccctgtggggcaaggtgaaccggccgtaagttggtgaccggccgttgggcaggcaccggccgttctacccttaccggccgtggtcgactcggaccgatg

SEQ ID NO: 14511 - DNA, 203 bp, Homo sapiens
  source 1..203: mol_type = other DNA
ggcgcgccagtcctcctgctgacactgacacaactgtgttcactagcaacaccggccgtacaccatggtgcatctgactcctgaggagaagtctgccgttactgccctgtggggcaaggtgaaccggccgtaagttggtgaccggccgttgggcaggcaccggccgttctacccttggacccagaggtcgactcggaccgatg

SEQ ID NO: 14512 - DNA, 203 bp, Homo sapiens
  source 1..203: mol_type = other DNA
ggcgcgccagtccttgtcagcattctgacacaactgtgttcactagcaacaccggccgtacaccatggtgcatctgactcctgaggagaagtctgccgttactgccctgtggggcaaggtgaaccggccgtaagttggtgaccggccgttgggcaggctgctggtggtctacccttaccggccgtggtcgactcggaccgatg

SEQ ID NO: 14513 - DNA, 203 bp, Homo sapiens
  source 1..203: mol_type = other DNA
ggcgcgccagtcctctaggtgactctgacacaactgtgttcactagcaacaccggccgtacaccatggtgcatctgactcctgaggagaagtctgccgttactgccctgtggggcaaggtgaaccggccgtaagttggtgaccggccgttgggcaggctgctggtggtctacccttggacccagaggtcgactcggaccgatg

SEQ ID NO: 14514 - DNA, 203 bp, Homo sapiens
  source 1..203: mol_type = other DNA
ggcgcgccagtccttagagtgcagctgacacaactgtgttcactagcaacaccggccgtacaccatggtgcatctgactcctgaggagaagtctgccgttactgccctgtggggcaaggtgaaccggccgtaagttggtggtgaggccctgggcaggcaccggccgttctacccttggacccagaggtcgactcggaccgatg

SEQ ID NO: 14515 - DNA, 203 bp, Homo sapiens
  source 1..203: mol_type = other DNA
ggcgcgccagtcctgtggtgattcctgacacaactgtgttcactagcaacaccggccgtacaccatggtgcatctgactcctgaggagaagtctgccgttactgccctgtggggcaaggtgaaccggccgtaagttggtggtgaggccctgggcaggctgctggtggtctacccttggacccagaggtcgactcggaccgatg

SEQ ID NO: 14516 - DNA, 203 bp, Homo sapiens
  source 1..203: mol_type = other DNA
ggcgcgccagtccttctgaagacactgacacaactgtgttcactagcaacaccggccgtacaccatggtgcatctgactcctgaggagaagtctgccgttactgccctgtggggcaaggtgaacgtggatgaagttggtgaccggccgttgggcaggctgctggtggtctacccttaccggccgtggtcgactcggaccgatg

SEQ ID NO: 14517 - DNA, 203 bp, Homo sapiens
  source 1..203: mol_type = other DNA
ggcgcgccagtccttctgaagtacctgacacaactgtgttcactagcaacaccggccgtacaccatggtgcatctgactcctgaggagaagtctgccgttactgccctgtggggcaaggtgaacgtggatgaagttggtggtgaggccctgggcaggcaccggccgttctacccttggacccagaggtcgactcggaccgatg

SEQ ID NO: 14518 - DNA, 203 bp, Homo sapiens
  source 1..203: mol_type = other DNA
ggcgcgccagtccttctgttctggctgacacaactgtgttcactagcaacaccggccgtacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14519 - DNA, 203 bp, Homo sapiens
  source 1..203: mol_type = other DNA
ggcgcgccagtcctcttgttcagactgacacaactgtgttcactagcaaccacggaatcgagaaatggcacggaatcgagaagaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 14520 - DNA, 203 bp, Homo sapiens
  source 1..203: mol_type = other DNA
ggcgcgccagtcctaccactcagactgacacaactgtgttcactagcaaccacggaatcgagaaatggcacggaatcgagaagaggagaagtctgccgttactgcacggaatcgagaagtgaacgtggatgaagttggtggtgaggccctgggcaggccacggaatcgagaaccttggacccagaggtcgactcggaccgatg

SEQ ID NO: 14521 - DNA, 203 bp, Homo sapiens
  source 1..203: mol_type = other DNA
ggcgcgccagtccttacaacctggctgacacaactgtgttcactagcaaccacggaatcgagaaatggcacggaatcgagaagaggagaagtctgccgttactgcacggaatcgagaagtgacacggaatcgagaaggtggtgaggccctgggcaggccacggaatcgagaaccttggacccagaggtcgactcggaccgatg

SEQ ID NO: 14522 - DNA, 203 bp, Homo sapiens
  source 1..203: mol_type = other DNA
ggcgcgccagtccttgtaggctttctgacacaactgtgttcactagcaaccacggaatcgagaaatggcacggaatcgagaagaggagaagtctgccgttactgcacggaatcgagaagtgacacggaatcgagaaggtggtgaggccctgggcaggctgctggtggtctacccttggacccagaggtcgactcggaccgatg

SEQ ID NO: 14523 - DNA, 203 bp, Homo sapiens
  source 1..203: mol_type = other DNA
ggcgcgccagtcctgagcaactggctgacacaactgtgttcactagcaaccacggaatcgagaaatggcacggaatcgagaagaggagaagtctgccgttactgccctgtggggcaaggtgaacgtggatgaagttggtgcacggaatcgagaaaggctgctggtggtctacccttggacccagaggtcgactcggaccgatg

SEQ ID NO: 14524 - DNA, 203 bp, Homo sapiens
  source 1..203: mol_type = other DNA
ggcgcgccagtcctaggtttcaagctgacacaactgtgttcactagcaaccacggaatcgagaaatggcacggaatcgagaagaggagaagtctgccgttactgccctgtggggcaaggtgacacggaatcgagaaggtggtgaggccctgggcaggccacggaatcgagaaccttggacccagaggtcgactcggaccgatg

SEQ ID NO: 14525 - DNA, 203 bp, Homo sapiens
  source 1..203: mol_type = other DNA
ggcgcgccagtcctcttttcagcactgacacaactgtgttcactagcaaccacggaatcgagaaatggcacggaatcgagaagaggcacggaatcgagaaactgcacggaatcgagaagtgacacggaatcgagaaggtgcacggaatcgagaaaggctgctggtggtctacccttggacccagaggtcgactcggaccgatg

SEQ ID NO: 14526 - DNA, 203 bp, Homo sapiens
  source 1..203: mol_type = other DNA
ggcgcgccagtccttaactctcaactgacacaactgtgttcactagcaaccacggaatcgagaaatggcacggaatcgagaagaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 14527 - DNA, 203 bp, Homo sapiens
  source 1..203: mol_type = other DNA
ggcgcgccagtcctggcaacgagcctgacacaactgtgttcactagcaaccacggaatcgagaaatggcacggaatcgagaagaggcacggaatcgagaaactgccctgtggggcaaggtgaacgtggatgaagttggtgcacggaatcgagaaaggctgctggtggtctacccttggacccagaggtcgactcggaccgatg

SEQ ID NO: 14528 - DNA, 203 bp, Homo sapiens
  source 1..203: mol_type = other DNA
ggcgcgccagtcctggcactgtgcctgacacaactgtgttcactagcaaccacggaatcgagaaatggcacggaatcgagaagaggcacggaatcgagaaactgccctgtggggcaaggtgaacgtggatgaagttggtggtgaggccctgggcaggctgctggtggtctacccttggacccagaggtcgactcggaccgatg

SEQ ID NO: 14529 - DNA, 203 bp, Homo sapiens
  source 1..203: mol_type = other DNA
ggcgcgccagtcctggacggtcacctgacacaactgtgttcactagcaaccacggaatcgagaaatggcacggaatcgagaagaggcacggaatcgagaaactgccctgtggggcaaggtgacacggaatcgagaaggtgcacggaatcgagaaaggccacggaatcgagaaccttggacccagaggtcgactcggaccgatg

SEQ ID NO: 14530 - DNA, 203 bp, Homo sapiens
  source 1..203: mol_type = other DNA
ggcgcgccagtcctgtgaccgtccctgacacaactgtgttcactagcaaccacggaatcgagaaatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 14531 - DNA, 203 bp, Homo sapiens
  source 1..203: mol_type = other DNA
ggcgcgccagtcctcaaggctttcctgacacaactgtgttcactagcaaccacggaatcgagaaatggtgcatctgactcctgaggagaagtctgccgttactgcacggaatcgagaagtgacacggaatcgagaaggtgcacggaatcgagaaaggctgctggtggtctacccttggacccagaggtcgactcggaccgatg

SEQ ID NO: 14532 - DNA, 203 bp, Homo sapiens
  source 1..203: mol_type = other DNA
ggcgcgccagtcctacaaagccttctgacacaactgtgttcactagcaaccacggaatcgagaaatggtgcatctgactcctgaggagaagtctgccgttactgcacggaatcgagaagtgacacggaatcgagaaggtggtgaggccctgggcaggccacggaatcgagaaccttggacccagaggtcgactcggaccgatg

SEQ ID NO: 14533 - DNA, 203 bp, Homo sapiens
  source 1..203: mol_type = other DNA
ggcgcgccagtcctacaacggtccctgacacaactgtgttcactagcaaccacggaatcgagaaatggtgcatctgactcctgaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 14534 - DNA, 203 bp, Homo sapiens
  source 1..203: mol_type = other DNA
ggcgcgccagtcctgtagctcaccctgacacaactgtgttcactagcaaccacggaatcgagaaatggtgcatctgactcctgaggagaagtctgccgttactgccctgtggggcaaggtgacacggaatcgagaaggtgcacggaatcgagaaaggctgctggtggtctacccttggacccagaggtcgactcggaccgatg

SEQ ID NO: 14535 - DNA, 203 bp, Homo sapiens
  source 1..203: mol_type = other DNA
ggcgcgccagtcctgtcacctaccctgacacaactgtgttcactagcaaccacggaatcgagaaatggtgcatctgactcctgaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 14536 - DNA, 203 bp, Homo sapiens
  source 1..203: mol_type = other DNA
ggcgcgccagtccttgagcagtccctgacacaactgtgttcactagcaaccacggaatcgagaaatggtgcatctgactcctgaggcacggaatcgagaaactgcacggaatcgagaagtgaacgtggatgaagttggtgcacggaatcgagaaaggctgctggtggtctacccttggacccagaggtcgactcggaccgatg

SEQ ID NO: 14537 - DNA, 203 bp, Homo sapiens
  source 1..203: mol_type = other DNA
ggcgcgccagtcctctgaaaggccctgacacaactgtgttcactagcaaccacggaatcgagaaatggtgcatctgactcctgaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 14538 - DNA, 203 bp, Homo sapiens
  source 1..203: mol_type = other DNA
ggcgcgccagtcctggctctgcaactgacacaactgtgttcactagcaaccacggaatcgagaaatggtgcatctgactcctgaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 14539 - DNA, 203 bp, Homo sapiens
  source 1..203: mol_type = other DNA
ggcgcgccagtcctatccaggaccctgacacaactgtgttcactagcaaccacggaatcgagaaatggtgcatctgactcctgaggcacggaatcgagaaactgccctgtggggcaaggtgacacggaatcgagaaggtggtgaggccctgggcaggccacggaatcgagaaccttggacccagaggtcgactcggaccgatg

SEQ ID NO: 14540 - DNA, 203 bp, Homo sapiens
  source 1..203: mol_type = other DNA
ggcgcgccagtcctactgaaggccctgacacaactgtgttcactagcaaccaggagcgagcgaccaaaggaaccataactgatttaatgagccattcgcagtttcactgtaccggccgtgcgtactcagacatgcatggcttaatctttgagacaagcatatgctactggcaggatcgacccagaggtcgactcggaccgatg

SEQ ID NO: 14541 - DNA, 203 bp, Homo sapiens
  source 1..203: mol_type = other DNA
ggcgcgccagtcctctacagagccctgacacaactgtgttcactagcaaccccggcgggtcaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14542 - DNA, 203 bp, Homo sapiens
  source 1..203: mol_type = other DNA
ggcgcgccagtcctggcactcaacctgacacaactgtgttcactagcaacccggcgggtacaccatggccggcgggtctcctgaggagaagtctgccgttactgccctgtggggcaaggtgaccggcgggtaagttggtgccggcgggttgggcaggctgctggtggtctacccttccggcgggtggtcgactcggaccgatg

SEQ ID NO: 14543 - DNA, 203 bp, Homo sapiens
  source 1..203: mol_type = other DNA
ggcgcgccagtcctggtgtagagcctgacacaactgtgttcactagcaacccggcgggtacaccatggccggcgggtctcctgaggagaagtctgccgttactgccctgtggggcaaggtgaccggcgggtaagttggtggtgaggccctgggcaggctgctggtggtctacccttggacccagaggtcgactcggaccgatg

SEQ ID NO: 14544 - DNA, 203 bp, Homo sapiens
  source 1..203: mol_type = other DNA
ggcgcgccagtcctggtttcggtcctgacacaactgtgttcactagcaacccggcgggtacaccatggccggcgggtctcctgaggagaagtctgccgttactgccggcgggtgcaaggtgaacgtggatgaagttggtgccggcgggttgggcaggcccggcgggttctacccttccggcgggtggtcgactcggaccgatg

SEQ ID NO: 14545 - DNA, 203 bp, Homo sapiens
  source 1..203: mol_type = other DNA
ggcgcgccagtcctggttggactgctgacacaactgtgttcactagcaacccggcgggtacaccatggccggcgggtctcctgaggagaagtctgccgttactgccggcgggtgcaaggtgaacgtggatgaagttggtggtgaggccctgggcaggcccggcgggttctacccttggacccagaggtcgactcggaccgatg

SEQ ID NO: 14546 - DNA, 203 bp, Homo sapiens
  source 1..203: mol_type = other DNA
ggcgcgccagtcctgacatgacgactgacacaactgtgttcactagcaacccggcgggtacaccatggccggcgggtctcctgaggagaagtctgccgttactgccggcgggtgcaaggtgaacgtggatgaagttggtggtgaggccctgggcaggctgctggtggtctacccttccggcgggtggtcgactcggaccgatg

SEQ ID NO: 14547 - DNA, 203 bp, Homo sapiens
  source 1..203: mol_type = other DNA
ggcgcgccagtcctcctctttgtgctgacacaactgtgttcactagcaacccggcgggtacaccatggccggcgggtctcctgaggagaagtctgccgttactgccggcgggtgcaaggtgaacgtggatgaagttggtggtgaggccctgggcaggctgctggtggtctacccttggacccagaggtcgactcggaccgatg

SEQ ID NO: 14548 - DNA, 203 bp, Homo sapiens
  source 1..203: mol_type = other DNA
ggcgcgccagtccttcgtagaggtctgacacaactgtgttcactagcaacccggcgggtacaccatggccggcgggtctcctgaggagaagtctgccgttactgccggcgggtgcaaggtgaccggcgggtaagttggtgccggcgggttgggcaggctgctggtggtctacccttccggcgggtggtcgactcggaccgatg

SEQ ID NO: 14549 - DNA, 203 bp, Homo sapiens
  source 1..203: mol_type = other DNA
ggcgcgccagtcctatcgtagtacctgacacaactgtgttcactagcaacccggcgggtacaccatggccggcgggtctcctgaggagaagtctgccgttactgccggcgggtgcaaggtgaccggcgggtaagttggtgccggcgggttgggcaggctgctggtggtctacccttggacccagaggtcgactcggaccgatg

SEQ ID NO: 14550 - DNA, 203 bp, Homo sapiens
  source 1..203: mol_type = other DNA
ggcgcgccagtcctgctctacgaactgacacaactgtgttcactagcaacccggcgggtacaccatggccggcgggtctcctgaggccggcgggtccgttactgccctgtggggcaaggtgaacgtggatgaagttggtgccggcgggttgggcaggcccggcgggttctacccttggacccagaggtcgactcggaccgatg

SEQ ID NO: 14551 - DNA, 203 bp, Homo sapiens
  source 1..203: mol_type = other DNA
ggcgcgccagtcctccacctgtgtctgacacaactgtgttcactagcaacccggcgggtacaccatggccggcgggtctcctgaggccggcgggtccgttactgccctgtggggcaaggtgaccggcgggtaagttggtgccggcgggttgggcaggcccggcgggttctacccttccggcgggtggtcgactcggaccgatg

SEQ ID NO: 14552 - DNA, 203 bp, Homo sapiens
  source 1..203: mol_type = other DNA
ggcgcgccagtcctcctgtgtttgctgacacaactgtgttcactagcaacccggcgggtacaccatggccggcgggtctcctgaggccggcgggtccgttactgccctgtggggcaaggtgaccggcgggtaagttggtgccggcgggttgggcaggctgctggtggtctacccttccggcgggtggtcgactcggaccgatg

SEQ ID NO: 14553 - DNA, 203 bp, Homo sapiens
  source 1..203: mol_type = other DNA
ggcgcgccagtcctatgtgtccttctgacacaactgtgttcactagcaacccggcgggtacaccatggccggcgggtctcctgaggccggcgggtccgttactgccctgtggggcaaggtgaccggcgggtaagttggtggtgaggccctgggcaggcccggcgggttctacccttggacccagaggtcgactcggaccgatg

SEQ ID NO: 14554 - DNA, 203 bp, Homo sapiens
  source 1..203: mol_type = other DNA
ggcgcgccagtcctaggacacaggctgacacaactgtgttcactagcaacccggcgggtacaccatggccggcgggtctcctgaggccggcgggtccgttactgccctgtggggcaaggtgaccggcgggtaagttggtggtgaggccctgggcaggctgctggtggtctacccttggacccagaggtcgactcggaccgatg

SEQ ID NO: 14555 - DNA, 203 bp, Homo sapiens
  source 1..203: mol_type = other DNA
ggcgcgccagtcctgtcgtcatgtctgacacaactgtgttcactagcaacccggcgggtacaccatggccggcgggtctcctgaggccggcgggtccgttactgccggcgggtgcaaggtgaacgtggatgaagttggtggtgaggccctgggcaggcccggcgggttctacccttggacccagaggtcgactcggaccgatg

SEQ ID NO: 14556 - DNA, 203 bp, Homo sapiens
  source 1..203: mol_type = other DNA
ggcgcgccagtcctacagttgattctgacacaactgtgttcactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14557 - DNA, 203 bp, Homo sapiens
  source 1..203: mol_type = other DNA
ggcgcgccagtccttaggatcgtcctgacacaactgtgttcactagcaacccggcgggtacaccatggccggcgggtctcctgaggccggcgggtccgttactgccggcgggtgcaaggtgaccggcgggtaagttggtggtgaggccctgggcaggcccggcgggttctacccttccggcgggtggtcgactcggaccgatg

SEQ ID NO: 14558 - DNA, 203 bp, Homo sapiens
  source 1..203: mol_type = other DNA
ggcgcgccagtccttgcttgggtcctgacacaactgtgttcactagcaacccggcgggtacaccatggccggcgggtctcctgaggccggcgggtccgttactgccggcgggtgcaaggtgaccggcgggtaagttggtggtgaggccctgggcaggctgctggtggtctacccttccggcgggtggtcgactcggaccgatg

SEQ ID NO: 14559 - DNA, 203 bp, Homo sapiens
  source 1..203: mol_type = other DNA
ggcgcgccagtcctctagacaggactgacacaactgtgttcactagcaacccggcgggtacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14560 - DNA, 203 bp, Homo sapiens
  source 1..203: mol_type = other DNA
ggcgcgccagtcctggtacggtgactgacacaactgtgttcactagcaacccggcgggtacaccatggtgcatctgactcctgaggagaagtctgccgttactgccctgtggggcaaggtgaccggcgggtaagttggtgccggcgggttgggcaggcccggcgggttctacccttggacccagaggtcgactcggaccgatg

SEQ ID NO: 14561 - DNA, 203 bp, Homo sapiens
  source 1..203: mol_type = other DNA
ggcgcgccagtccttacactgcctctgacacaactgtgttcactagcaacccggcgggtacaccatggtgcatctgactcctgaggagaagtctgccgttactgccggcgggtgcaaggtgaacgtggatgaagttggtgccggcgggttgggcaggcccggcgggttctacccttggacccagaggtcgactcggaccgatg

SEQ ID NO: 14562 - DNA, 203 bp, Homo sapiens
  source 1..203: mol_type = other DNA
ggcgcgccagtcctcaggctgttcctgacacaactgtgttcactagcaacccggcgggtacaccatggtgcatctgactcctgaggagaagtctgccgttactgccggcgggtgcaaggtgaacgtggatgaagttggtgccggcgggttgggcaggctgctggtggtctacccttccggcgggtggtcgactcggaccgatg

SEQ ID NO: 14563 - DNA, 203 bp, Homo sapiens
  source 1..203: mol_type = other DNA
ggcgcgccagtcctaggcagtcttctgacacaactgtgttcactagcaacccggcgggtacaccatggtgcatctgactcctgaggagaagtctgccgttactgccggcgggtgcaaggtgaacgtggatgaagttggtgccggcgggttgggcaggctgctggtggtctacccttggacccagaggtcgactcggaccgatg

SEQ ID NO: 14564 - DNA, 203 bp, Homo sapiens
  source 1..203: mol_type = other DNA
ggcgcgccagtccttcatggtggactgacacaactgtgttcactagcaacccggcgggtacaccatggtgcatctgactcctgaggagaagtctgccgttactgccggcgggtgcaaggtgaacgtggatgaagttggtggtgaggccctgggcaggcccggcgggttctacccttggacccagaggtcgactcggaccgatg

SEQ ID NO: 14565 - DNA, 203 bp, Homo sapiens
  source 1..203: mol_type = other DNA
ggcgcgccagtcctagtagagaacctgacacaactgtgttcactagcaacccggcgggtacaccatggtgcatctgactcctgaggagaagtctgccgttactgccggcgggtgcaaggtgaccggcgggtaagttggtgccggcgggttgggcaggcccggcgggttctacccttggacccagaggtcgactcggaccgatg

SEQ ID NO: 14566 - DNA, 203 bp, Homo sapiens
  source 1..203: mol_type = other DNA
ggcgcgccagtccttgagtccactctgacacaactgtgttcactagcaacccggcgggtacaccatggtgcatctgactcctgaggagaagtctgccgttactgccggcgggtgcaaggtgaccggcgggtaagttggtgccggcgggttgggcaggctgctggtggtctacccttccggcgggtggtcgactcggaccgatg

SEQ ID NO: 14567 - DNA, 203 bp, Homo sapiens
  source 1..203: mol_type = other DNA
ggcgcgccagtccttttgtgacctctgacacaactgtgttcactagcaacccggcgggtacaccatggtgcatctgactcctgaggagaagtctgccgttactgccggcgggtgcaaggtgaccggcgggtaagttggtggtgaggccctgggcaggcccggcgggttctacccttccggcgggtggtcgactcggaccgatg

SEQ ID NO: 14568 - DNA, 203 bp, Homo sapiens
  source 1..203: mol_type = other DNA
ggcgcgccagtcctacaggcttacctgacacaactgtgttcactagcaacccggcgggtacaccatggtgcatctgactcctgaggccggcgggtccgttactgccctgtggggcaaggtgaacgtggatgaagttggtgccggcgggttgggcaggctgctggtggtctacccttggacccagaggtcgactcggaccgatg

SEQ ID NO: 14569 - DNA, 203 bp, Homo sapiens
  source 1..203: mol_type = other DNA
ggcgcgccagtccttaagcctgacctgacacaactgtgttcactagcaacccggcgggtacaccatggtgcatctgactcctgaggccggcgggtccgttactgccctgtggggcaaggtgaacgtggatgaagttggtggtgaggccctgggcaggcccggcgggttctacccttccggcgggtggtcgactcggaccgatg

SEQ ID NO: 14570 - DNA, 203 bp, Homo sapiens
  source 1..203: mol_type = other DNA
ggcgcgccagtccttacagacaacctgacacaactgtgttcactagcaacccggcgggtacaccatggtgcatctgactcctgaggccggcgggtccgttactgccggcgggtgcaaggtgaacgtggatgaagttggtgccggcgggttgggcaggctgctggtggtctacccttggacccagaggtcgactcggaccgatg

SEQ ID NO: 14571 - DNA, 203 bp, Homo sapiens
  source 1..203: mol_type = other DNA
ggcgcgccagtcctcttgtctgaactgacacaactgtgttcactagcaacccggcgggtacaccatggtgcatctgactcctgaggccggcgggtccgttactgccggcgggtgcaaggtgaacgtggatgaagttggtggtgaggccctgggcaggcccggcgggttctacccttggacccagaggtcgactcggaccgatg

SEQ ID NO: 14572 - DNA, 203 bp, Homo sapiens
  source 1..203: mol_type = other DNA
ggcgcgccagtcctaacccatgatctgacacaactgtgttcactagcaacccggcgggtacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14573 - DNA, 203 bp, Homo sapiens
  source 1..203: mol_type = other DNA
ggcgcgccagtcctaccgagcctgctgacacaactgtgttcactagcaacccggcgggtacaccatggtgcatctgactcctgaggccggcgggtccgttactgccggcgggtgcaaggtgaccggcgggtaagttggtgccggcgggttgggcaggctgctggtggtctacccttccggcgggtggtcgactcggaccgatg

SEQ ID NO: 14574 - DNA, 203 bp, Homo sapiens
  source 1..203: mol_type = other DNA
ggcgcgccagtcctacctaagcagctgacacaactgtgttcactagcaacccggcgggtacaccatggtgcatctgactcctgaggccggcgggtccgttactgccggcgggtgcaaggtgaccggcgggtaagttggtgccggcgggttgggcaggctgctggtggtctacccttggacccagaggtcgactcggaccgatg

SEQ ID NO: 14575 - DNA, 203 bp, Homo sapiens
  source 1..203: mol_type = other DNA
ggcgcgccagtcctgtgagaagttctgacacaactgtgttcactagcaacccgtcaattcctttatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14576 - DNA, 203 bp, Homo sapiens
  source 1..203: mol_type = other DNA
ggcgcgccagtcctcttagaccacctgacacaactgtgttcactagcaaccgtcaattcctttaatggcgtcaattcctttagaggagaagtctgccgttactgccctgtggggcaaggtgaacgtggatgaagttggtggtgaggccctgggcaggccgtcaattcctttaccttggacccagaggtcgactcggaccgatg

SEQ ID NO: 14577 - DNA, 203 bp, Homo sapiens
  source 1..203: mol_type = other DNA
ggcgcgccagtccttcagcttagactgacacaactgtgttcactagcaaccgtcaattcctttaatggcgtcaattcctttagaggagaagtctgccgttactgccctgtggggcaaggtgacgtcaattcctttaggtggtgaggccctgggcaggctgctggtggtctacccttggacccagaggtcgactcggaccgatg

SEQ ID NO: 14578 - DNA, 203 bp, Homo sapiens
  source 1..203: mol_type = other DNA
ggcgcgccagtcctccacttctagctgacacaactgtgttcactagcaaccgtcaattcctttaatggcgtcaattcctttagaggagaagtctgccgttactgcgtcaattcctttagtgaacgtggatgaagttggtggtgaggccctgggcaggctgctggtggtctacccttggacccagaggtcgactcggaccgatg

SEQ ID NO: 14579 - DNA, 203 bp, Homo sapiens
  source 1..203: mol_type = other DNA
ggcgcgccagtcctagtttgggtactgacacaactgtgttcactagcaaccgtcaattcctttaatggcgtcaattcctttagaggagaagtctgccgttactgcgtcaattcctttagtgacgtcaattcctttaggtggtgaggccctgggcaggctgctggtggtctacccttggacccagaggtcgactcggaccgatg

SEQ ID NO: 14580 - DNA, 203 bp, Homo sapiens
  source 1..203: mol_type = other DNA
ggcgcgccagtcctcaacagtgacctgacacaactgtgttcactagcaaccgtcaattcctttaatggcgtcaattcctttagaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 14581 - DNA, 203 bp, Homo sapiens
  source 1..203: mol_type = other DNA
ggcgcgccagtcctccacttcggtctgacacaactgtgttcactagcaaccgtcaattcctttaatggcgtcaattcctttagaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 14582 - DNA, 203 bp, Homo sapiens
  source 1..203: mol_type = other DNA
ggcgcgccagtcctttgtagcgttctgacacaactgtgttcactagcaaccgtcaattcctttaatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 14583 - DNA, 203 bp, Homo sapiens
  source 1..203: mol_type = other DNA
ggcgcgccagtcctaacgctactcctgacacaactgtgttcactagcaaccgtcaattcctttaatggcgtcaattcctttagaggcgtcaattcctttaactgccctgtggggcaaggtgacgtcaattcctttaggtggtgaggccctgggcaggctgctggtggtctacccttggacccagaggtcgactcggaccgatg

SEQ ID NO: 14584 - DNA, 203 bp, Homo sapiens
  source 1..203: mol_type = other DNA
ggcgcgccagtcctcagatcagtgctgacacaactgtgttcactagcaaccgtcaattcctttaatggcgtcaattcctttagaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 14585 - DNA, 203 bp, Homo sapiens
  source 1..203: mol_type = other DNA
ggcgcgccagtccttcttgacgatctgacacaactgtgttcactagcaaccgtcaattcctttaatggcgtcaattcctttagaggcgtcaattcctttaactgcgtcaattcctttagtgacgtcaattcctttaggtggtgaggccctgggcaggctgctggtggtctacccttggacccagaggtcgactcggaccgatg

SEQ ID NO: 14586 - DNA, 203 bp, Homo sapiens
  source 1..203: mol_type = other DNA
ggcgcgccagtcctctgatcaagactgacacaactgtgttcactagcaaccgtcaattcctttaatggtgcatctgactcctgaggagaagtctgccgttactgccctgtggggcaaggtgaacgtggatgaagttggtgcgtcaattcctttaaggctgctggtggtctacccttggacccagaggtcgactcggaccgatg

SEQ ID NO: 14587 - DNA, 203 bp, Homo sapiens
  source 1..203: mol_type = other DNA
ggcgcgccagtccttgaacaacgactgacacaactgtgttcactagcaaccgtcaattcctttaatggtgcatctgactcctgaggagaagtctgccgttactgccctgtggggcaaggtgacgtcaattcctttaggtgcgtcaattcctttaaggccgtcaattcctttaccttggacccagaggtcgactcggaccgatg

SEQ ID NO: 14588 - DNA, 203 bp, Homo sapiens
  source 1..203: mol_type = other DNA
ggcgcgccagtccttactgggtctctgacacaactgtgttcactagcaaccgtcaattcctttaatggtgcatctgactcctgaggagaagtctgccgttactgccctgtggggcaaggtgacgtcaattcctttaggtgcgtcaattcctttaaggctgctggtggtctacccttggacccagaggtcgactcggaccgatg

SEQ ID NO: 14589 - DNA, 203 bp, Homo sapiens
  source 1..203: mol_type = other DNA
ggcgcgccagtcctggtaactgggctgacacaactgtgttcactagcaaccgtcaattcctttaatggtgcatctgactcctgaggagaagtctgccgttactgccctgtggggcaaggtgacgtcaattcctttaggtggtgaggccctgggcaggccgtcaattcctttaccttggacccagaggtcgactcggaccgatg

SEQ ID NO: 14590 - DNA, 203 bp, Homo sapiens
  source 1..203: mol_type = other DNA
ggcgcgccagtcctcactgggttcctgacacaactgtgttcactagcaaccgtcaattcctttaatggtgcatctgactcctgaggagaagtctgccgttactgccctgtggggcaaggtgacgtcaattcctttaggtggtgaggccctgggcaggctgctggtggtctacccttggacccagaggtcgactcggaccgatg

SEQ ID NO: 14591 - DNA, 203 bp, Homo sapiens
  source 1..203: mol_type = other DNA
ggcgcgccagtcctcccagtttgcctgacacaactgtgttcactagcaaccgtcaattcctttaatggtgcatctgactcctgaggagaagtctgccgttactgcgtcaattcctttagtgacgtcaattcctttaggtgcgtcaattcctttaaggccgtcaattcctttaccttggacccagaggtcgactcggaccgatg

SEQ ID NO: 14592 - DNA, 203 bp, Homo sapiens
  source 1..203: mol_type = other DNA
ggcgcgccagtcctgaccgtttctctgacacaactgtgttcactagcaaccgtcaattcctttaatggtgcatctgactcctgaggcgtcaattcctttaactgccctgtggggcaaggtgaacgtggatgaagttggtgcgtcaattcctttaaggccgtcaattcctttaccttggacccagaggtcgactcggaccgatg

SEQ ID NO: 14593 - DNA, 203 bp, Homo sapiens
  source 1..203: mol_type = other DNA
ggcgcgccagtccttgtgaactagctgacacaactgtgttcactagcaaccgtcaattcctttaatggtgcatctgactcctgaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 14594 - DNA, 203 bp, Homo sapiens
  source 1..203: mol_type = other DNA
ggcgcgccagtcctctgaactaggctgacacaactgtgttcactagcaaccgtcaattcctttaatggtgcatctgactcctgaggcgtcaattcctttaactgccctgtggggcaaggtgacgtcaattcctttaggtgcgtcaattcctttaaggctgctggtggtctacccttggacccagaggtcgactcggaccgatg

SEQ ID NO: 14595 - DNA, 203 bp, Homo sapiens
  source 1..203: mol_type = other DNA
ggcgcgccagtcctacgctcaccactgacacaactgtgttcactagcaaccgtcaattcctttaatggtgcatctgactcctgaggcgtcaattcctttaactgcgtcaattcctttagtgaacgtggatgaagttggtgcgtcaattcctttaaggccgtcaattcctttaccttggacccagaggtcgactcggaccgatg

SEQ ID NO: 14596 - DNA, 203 bp, Homo sapiens
  source 1..203: mol_type = other DNA
ggcgcgccagtcctatgggttaaactgacacaactgtgttcactagcaaccgtcaattcctttaatggtgcatctgactcctgaggcgtcaattcctttaactgcgtcaattcctttagtgaacgtggatgaagttggtgcgtcaattcctttaaggctgctggtggtctacccttggacccagaggtcgactcggaccgatg

SEQ ID NO: 14597 - DNA, 203 bp, Homo sapiens
  source 1..203: mol_type = other DNA
ggcgcgccagtcctagttaaaggactgacacaactgtgttcactagcaaccgtcaattcctttaatggtgcatctgactcctgaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 14598 - DNA, 203 bp, Homo sapiens
  source 1..203: mol_type = other DNA
ggcgcgccagtcctacgtaactcgctgacacaactgtgttcactagcaaccgtcaattcctttaatggtgcatctgactcctgaggcgtcaattcctttaactgcgtcaattcctttagtgacgtcaattcctttaggtggtgaggccctgggcaggctgctggtggtctacccttggacccagaggtcgactcggaccgatg

SEQ ID NO: 14599 - DNA, 203 bp, Homo sapiens
  source 1..203: mol_type = other DNA
ggcgcgccagtcctggtagtctcgctgacacaactgtgttcactagcaacctacgacggtatctgatcgtcttcgaacctccgactttcgttcttgattaatgaaaacattcttggcaaatgctttcgctctggtccgtcttgcgccggtccaagaatttcacctctagcggcgcaagacccagaggtcgactcggaccgatg

SEQ ID NO: 14600 - DNA, 203 bp, Homo sapiens
  source 1..203: mol_type = other DNA
ggcgcgccagtcctttcaagctcgctgacacaactgtgttcactagcaacctacgacggtatctgatcgtcttcgaacctccgactttcgttcttgattaatgaaaacattcttggcaaatgctttcgctctggtccgtcttgcgccggtccaagaatttcacctctagcggcgcaggacccagaggtcgactcggaccgatg

SEQ ID NO: 14601 - DNA, 203 bp, Homo sapiens
  source 1..203: mol_type = other DNA
ggcgcgccagtcctgaacttgtcgctgacacaactgtgttcactagcaacctcaaacaaccggccgtgtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14602 - DNA, 203 bp, Homo sapiens
  source 1..203: mol_type = other DNA
ggcgcgccagtcctttgagtatcgctgacacaactgtgttcactagcaacctcaaacaaccggccgtgtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 14603 - DNA, 203 bp, Homo sapiens
  source 1..203: mol_type = other DNA
ggcgcgccagtcctcgaggttgtcctgacacaactgtgttcactagcaacctcaaacaagcgaccaaaggaaccataactgatttaatgagccattcgcagtttcactgtaccggccgtgcgtactcagacatgcatggcttaatctttgagacaagcatatgctactggacccttggacccagaggtcgactcggaccgatg

SEQ ID NO: 14604 - DNA, 203 bp, Homo sapiens
  source 1..203: mol_type = other DNA
ggcgcgccagtcctcgacgagcctctgacacaactgtgttcactagcaacctcaaacacacggaatcgagaatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14605 - DNA, 203 bp, Homo sapiens
  source 1..203: mol_type = other DNA
ggcgcgccagtcctgtagctgtcgctgacacaactgtgttcactagcaacctcaaacacactcctggtggtgcccttccgtcaattcctttaagtttcagctttgcaaccatactccccccggaacccaaagactttggtttcccggaagctgcccggcgggtcatgggaacccttggacccagaggtcgactcggaccgatg

SEQ ID NO: 14606 - DNA, 203 bp, Homo sapiens
  source 1..203: mol_type = other DNA
ggcgcgccagtcctcgagctctcactgacacaactgtgttcactagcaacctcaaacacgtgttgagtcaaattaagccgcaggctccactcctggtggtgcccttccgtcaattcctttaagtttcagctttgcaaccatactccccccggaacccaaagactttggttacccttggacccagaggtcgactcggaccgatg

SEQ ID NO: 14607 - DNA, 203 bp, Homo sapiens
  source 1..203: mol_type = other DNA
ggcgcgccagtcctcgagttttcgctgacacaactgtgttcactagcaacctcaaacagaaccggccgtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 14608 - DNA, 203 bp, Homo sapiens
  source 1..203: mol_type = other DNA
ggcgcgccagtcctcgactcttacctgacacaactgtgttcactagcaacctcaaacagacaaccaaaggaaccataactgatttaatgagccattcgcagtttcactgtaccggccgtgcgtactcagacatgcatggcttaatctttgagacaagcatatgctagtctacccttggacccagaggtcgactcggaccgatg

SEQ ID NO: 14609 - DNA, 203 bp, Homo sapiens
  source 1..203: mol_type = other DNA
ggcgcgccagtcctcgacaacgttctgacacaactgtgttcactagcaacctcaaacagacacaccatactccccccggaacccaaagactttggtttcccggaagctgcccggcgggtcatgggaataacgccgccgcatcgccggtcggcatcgtttatggtcggtctacccttggacccagaggtcgactcggaccgatg

SEQ ID NO: 14610 - DNA, 203 bp, Homo sapiens
  source 1..203: mol_type = other DNA
ggcgcgccagtcctgagcctctcgctgacacaactgtgttcactagcaacctcaaacagacacacggaatcgagaaactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14611 - DNA, 203 bp, Homo sapiens
  source 1..203: mol_type = other DNA
ggcgcgccagtcctcgaatcctggctgacacaactgtgttcactagcaacctcaaacagacaccaatcgtcttcgaacctccgactttcgttcttgattaatgaaaacattcttggcaaatgctttcgctctggtccgtcttgcgccggtccaagaatttcacgtggtctacccttggacccagaggtcgactcggaccgatg

SEQ ID NO: 14612 - DNA, 203 bp, Homo sapiens
  source 1..203: mol_type = other DNA
ggcgcgccagtccttcgctcgtcgctgacacaactgtgttcactagcaacctcaaacagacaccacacggaatcgagaacctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 14613 - DNA, 203 bp, Homo sapiens
  source 1..203: mol_type = other DNA
ggcgcgccagtcctcgatcggtcactgacacaactgtgttcactagcaacctcaaacagacaccacatactccccccggaacccaaagactttggtttcccggaagctgcccggcgggtcatgggaataacgccgccgcatcgccggtcggcatcgtttatgggtggtctacccttggacccagaggtcgactcggaccgatg

SEQ ID NO: 14614 - DNA, 203 bp, Homo sapiens
  source 1..203: mol_type = other DNA
ggcgcgccagtcctcgaagcttagctgacacaactgtgttcactagcaacctcaaacagacaccaccggcgggttgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14615 - DNA, 203 bp, Homo sapiens
  source 1..203: mol_type = other DNA
ggcgcgccagtcctcgacttgtatctgacacaactgtgttcactagcaacctcaaacagacaccaggtggtgcccttccgtcaattcctttaagtttcagctttgcaaccatactccccccggaacccaaagactttggtttcccggaagctgcccggcgggtgtggtctacccttggacccagaggtcgactcggaccgatg

SEQ ID NO: 14616 - DNA, 203 bp, Homo sapiens
  source 1..203: mol_type = other DNA
ggcgcgccagtcctcgacgaactactgacacaactgtgttcactagcaacctcaaacagacaccatgaccggccgtactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14617 - DNA, 203 bp, Homo sapiens
  source 1..203: mol_type = other DNA
ggcgcgccagtcctggcaacttcgctgacacaactgtgttcactagcaacctcaaacagacaccatgaggaaccataactgatttaatgagccattcgcagtttcactgtaccggccgtgcgtactcagacatgcatggcttaatctttgagacaagcatatggtggtctacccttggacccagaggtcgactcggaccgatg

SEQ ID NO: 14618 - DNA, 203 bp, Homo sapiens
  source 1..203: mol_type = other DNA
ggcgcgccagtcctcgactggacactgacacaactgtgttcactagcaacctcaaacagacaccatgcgtcaattcctttatgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 14619 - DNA, 203 bp, Homo sapiens
  source 1..203: mol_type = other DNA
ggcgcgccagtcctcgacttcattctgacacaactgtgttcactagcaacctcaaacagacaccatggaccggccgtctcctgaggaccggccgtccgttactgaccggccgtgcaaggtgaaccggccgtaagttggtgaccggccgttgggcaggcaccggccgttctacccttggacccagaggtcgactcggaccgatg

SEQ ID NO: 14620 - DNA, 203 bp, Homo sapiens
  source 1..203: mol_type = other DNA
ggcgcgccagtcctccactttcttctgacacaactgtgttcactagcaacctcaaacagacaccatggaccggccgtctcctgaggaccggccgtccgttactgaccggccgtgcaaggtgaaccggccgtaagttggtggtgaggccctgggcaggctgctggtggtctacccttaccggccgtggtcgactcggaccgatg

SEQ ID NO: 14621 - DNA, 203 bp, Homo sapiens
  source 1..203: mol_type = other DNA
ggcgcgccagtcctaaatcacagcctgacacaactgtgttcactagcaacctcaaacagacaccatggaccggccgtctcctgaggaccggccgtccgttactgaccggccgtgcaaggtgaacgtggatgaagttggtgaccggccgttgggcaggcaccggccgttctacccttaccggccgtggtcgactcggaccgatg

SEQ ID NO: 14622 - DNA, 203 bp, Homo sapiens
  source 1..203: mol_type = other DNA
ggcgcgccagtcctcagcaaatgactgacacaactgtgttcactagcaacctcaaacagacaccatggaccggccgtctcctgaggaccggccgtccgttactgaccggccgtgcaaggtgaacgtggatgaagttggtgaccggccgttgggcaggcaccggccgttctacccttggacccagaggtcgactcggaccgatg

SEQ ID NO: 14623 - DNA, 203 bp, Homo sapiens
  source 1..203: mol_type = other DNA
ggcgcgccagtcctagcaaaatgcctgacacaactgtgttcactagcaacctcaaacagacaccatggaccggccgtctcctgaggaccggccgtccgttactgaccggccgtgcaaggtgaacgtggatgaagttggtggtgaggccctgggcaggcaccggccgttctacccttggacccagaggtcgactcggaccgatg

SEQ ID NO: 14624 - DNA, 203 bp, Homo sapiens
  source 1..203: mol_type = other DNA
ggcgcgccagtcctacagaaatcactgacacaactgtgttcactagcaacctcaaacagacaccatggaccggccgtctcctgaggaccggccgtccgttactgccctgtggggcaaggtgaaccggccgtaagttggtgaccggccgttgggcaggcaccggccgttctacccttaccggccgtggtcgactcggaccgatg

SEQ ID NO: 14625 - DNA, 203 bp, Homo sapiens
  source 1..203: mol_type = other DNA
ggcgcgccagtcctatgaaaatcgctgacacaactgtgttcactagcaacctcaaacagacaccatggaccggccgtctcctgaggaccggccgtccgttactgccctgtggggcaaggtgaaccggccgtaagttggtggtgaggccctgggcaggctgctggtggtctacccttggacccagaggtcgactcggaccgatg

SEQ ID NO: 14626 - DNA, 203 bp, Homo sapiens
  source 1..203: mol_type = other DNA
ggcgcgccagtccttctcacaaatctgacacaactgtgttcactagcaacctcaaacagacaccatggaccggccgtctcctgaggaccggccgtccgttactgccctgtggggcaaggtgaacgtggatgaagttggtggtgaggccctgggcaggcaccggccgttctacccttaccggccgtggtcgactcggaccgatg

SEQ ID NO: 14627 - DNA, 203 bp, Homo sapiens
  source 1..203: mol_type = other DNA
ggcgcgccagtcctaaatcgattcctgacacaactgtgttcactagcaacctcaaacagacaccatggaccggccgtctcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14628 - DNA, 203 bp, Homo sapiens
  source 1..203: mol_type = other DNA
ggcgcgccagtcctcaacaaatcgctgacacaactgtgttcactagcaacctcaaacagacaccatggaccggccgtctcctgaggagaagtctgccgttactgaccggccgtgcaaggtgaaccggccgtaagttggtgaccggccgttgggcaggctgctggtggtctacccttggacccagaggtcgactcggaccgatg

SEQ ID NO: 14629 - DNA, 203 bp, Homo sapiens
  source 1..203: mol_type = other DNA
ggcgcgccagtcctctcaaatggtctgacacaactgtgttcactagcaacctcaaacagacaccatggaccggccgtctcctgaggagaagtctgccgttactgaccggccgtgcaaggtgaacgtggatgaagttggtgaccggccgttgggcaggcaccggccgttctacccttaccggccgtggtcgactcggaccgatg

SEQ ID NO: 14630 - DNA, 203 bp, Homo sapiens
  source 1..203: mol_type = other DNA
ggcgcgccagtcctagctcattttctgacacaactgtgttcactagcaacctcaaacagacaccatggaccggccgtctcctgaggagaagtctgccgttactgaccggccgtgcaaggtgaacgtggatgaagttggtgaccggccgttgggcaggctgctggtggtctacccttaccggccgtggtcgactcggaccgatg

SEQ ID NO: 14631 - DNA, 203 bp, Homo sapiens
  source 1..203: mol_type = other DNA
ggcgcgccagtcctcctcagatttctgacacaactgtgttcactagcaacctcaaacagacaccatggaccggccgtctcctgaggagaagtctgccgttactgaccggccgtgcaaggtgaacgtggatgaagttggtggtgaggccctgggcaggcaccggccgttctacccttaccggccgtggtcgactcggaccgatg

SEQ ID NO: 14632 - DNA, 203 bp, Homo sapiens
  source 1..203: mol_type = other DNA
ggcgcgccagtccttacttgatttctgacacaactgtgttcactagcaacctcaaacagacaccatggaccggccgtctcctgaggagaagtctgccgttactgccctgtggggcaaggtgaaccggccgtaagttggtgaccggccgttgggcaggctgctggtggtctacccttggacccagaggtcgactcggaccgatg

SEQ ID NO: 14633 - DNA, 203 bp, Homo sapiens
  source 1..203: mol_type = other DNA
ggcgcgccagtcctaacatttgaactgacacaactgtgttcactagcaacctcaaacagacaccatggaccggccgtctcctgaggagaagtctgccgttactgccctgtggggcaaggtgaaccggccgtaagttggtggtgaggccctgggcaggcaccggccgttctacccttaccggccgtggtcgactcggaccgatg

SEQ ID NO: 14634 - DNA, 203 bp, Homo sapiens
  source 1..203: mol_type = other DNA
ggcgcgccagtcctcatttctttgctgacacaactgtgttcactagcaacctcaaacagacaccatggaccggccgtctcctgaggagaagtctgccgttactgccctgtggggcaaggtgaacgtggatgaagttggtgaccggccgttgggcaggctgctggtggtctacccttggacccagaggtcgactcggaccgatg

SEQ ID NO: 14635 - DNA, 203 bp, Homo sapiens
  source 1..203: mol_type = other DNA
ggcgcgccagtcctgtgatttcacctgacacaactgtgttcactagcaacctcaaacagacaccatggaccggccgtctcctgaggagaagtctgccgttactgccctgtggggcaaggtgaacgtggatgaagttggtggtgaggccctgggcaggcaccggccgttctacccttggacccagaggtcgactcggaccgatg

SEQ ID NO: 14636 - DNA, 203 bp, Homo sapiens
  source 1..203: mol_type = other DNA
ggcgcgccagtcctcatttcacttctgacacaactgtgttcactagcaacctcaaacagacaccatggaccggccgtctcctgaggagaagtctgccgttactgccctgtggggcaaggtgaacgtggatgaagttggtggtgaggccctgggcaggctgctggtggtctacccttaccggccgtggtcgactcggaccgatg

SEQ ID NO: 14637 - DNA, 203 bp, Homo sapiens
  source 1..203: mol_type = other DNA
ggcgcgccagtccttgcaacatttctgacacaactgtgttcactagcaacctcaaacagacaccatggcacggaatcgagaagaggagaagtctgccgttactgcacggaatcgagaagtgaacgtggatgaagttggtgcacggaatcgagaaaggctgctggtggtctacccttggacccagaggtcgactcggaccgatg

SEQ ID NO: 14638 - DNA, 203 bp, Homo sapiens
  source 1..203: mol_type = other DNA
ggcgcgccagtcctagattttcgtctgacacaactgtgttcactagcaacctcaaacagacaccatggcacggaatcgagaagaggagaagtctgccgttactgcacggaatcgagaagtgaacgtggatgaagttggtggtgaggccctgggcaggccacggaatcgagaaccttggacccagaggtcgactcggaccgatg

SEQ ID NO: 14639 - DNA, 203 bp, Homo sapiens
  source 1..203: mol_type = other DNA
ggcgcgccagtcctccaagatttcctgacacaactgtgttcactagcaacctcaaacagacaccatggcacggaatcgagaagaggagaagtctgccgttactgcacggaatcgagaagtgacacggaatcgagaaggtggtgaggccctgggcaggctgctggtggtctacccttggacccagaggtcgactcggaccgatg

SEQ ID NO: 14640 - DNA, 203 bp, Homo sapiens
  source 1..203: mol_type = other DNA
ggcgcgccagtcctcgacctacaactgacacaactgtgttcactagcaacctcaaacagacaccatggcacggaatcgagaagaggagaagtctgccgttactgccctgtggggcaaggtgacacggaatcgagaaggtgcacggaatcgagaaaggctgctggtggtctacccttggacccagaggtcgactcggaccgatg

SEQ ID NO: 14641 - DNA, 203 bp, Homo sapiens
  source 1..203: mol_type = other DNA
ggcgcgccagtcctccaaccagtgctgacacaactgtgttcactagcaacctcaaacagacaccatggcacggaatcgagaagaggagaagtctgccgttactgccctgtggggcaaggtgacacggaatcgagaaggtggtgaggccctgggcaggctgctggtggtctacccttggacccagaggtcgactcggaccgatg

SEQ ID NO: 14642 - DNA, 203 bp, Homo sapiens
  source 1..203: mol_type = other DNA
ggcgcgccagtcctggctacatggctgacacaactgtgttcactagcaacctcaaacagacaccatggcacggaatcgagaagaggcacggaatcgagaaactgcacggaatcgagaagtgacacggaatcgagaaggtgcacggaatcgagaaaggctgctggtggtctacccttggacccagaggtcgactcggaccgatg

SEQ ID NO: 14643 - DNA, 203 bp, Homo sapiens
  source 1..203: mol_type = other DNA
ggcgcgccagtcctactacatgagctgacacaactgtgttcactagcaacctcaaacagacaccatggcacggaatcgagaagaggcacggaatcgagaaactgcacggaatcgagaagtgacacggaatcgagaaggtggtgaggccctgggcaggctgctggtggtctacccttggacccagaggtcgactcggaccgatg

SEQ ID NO: 14644 - DNA, 203 bp, Homo sapiens
  source 1..203: mol_type = other DNA
ggcgcgccagtccttggtatgcgactgacacaactgtgttcactagcaacctcaaacagacaccatggcacggaatcgagaagaggcacggaatcgagaaactgccctgtggggcaaggtgaacgtggatgaagttggtggtgaggccctgggcaggctgctggtggtctacccttggacccagaggtcgactcggaccgatg

SEQ ID NO: 14645 - DNA, 203 bp, Homo sapiens
  source 1..203: mol_type = other DNA
ggcgcgccagtcctacgagcagcactgacacaactgtgttcactagcaacctcaaacagacaccatggccggcgggtctcctgaggagaagtctgccgttactgccctgtggggcaaggtgaacgtggatgaagttggtgccggcgggttgggcaggctgctggtggtctacccttggacccagaggtcgactcggaccgatg

SEQ ID NO: 14646 - DNA, 203 bp, Homo sapiens
  source 1..203: mol_type = other DNA
ggcgcgccagtcctgtgcagcatactgacacaactgtgttcactagcaacctcaaacagacaccatggccggcgggtctcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14647 - DNA, 203 bp, Homo sapiens
  source 1..203: mol_type = other DNA
ggcgcgccagtccttcttcgttggctgacacaactgtgttcactagcaacctcaaacagacaccatggccggcgggtctcctgaggagaagtctgccgttactgccctgtggggcaaggtgaccggcgggtaagttggtggtgaggccctgggcaggcccggcgggttctacccttccggcgggtggtcgactcggaccgatg

SEQ ID NO: 14648 - DNA, 203 bp, Homo sapiens
  source 1..203: mol_type = other DNA
ggcgcgccagtcctatccaacagtctgacacaactgtgttcactagcaacctcaaacagacaccatggccggcgggtctcctgaggagaagtctgccgttactgccctgtggggcaaggtgaccggcgggtaagttggtggtgaggccctgggcaggcccggcgggttctacccttggacccagaggtcgactcggaccgatg

SEQ ID NO: 14649 - DNA, 203 bp, Homo sapiens
  source 1..203: mol_type = other DNA
ggcgcgccagtcctcacacttaacctgacacaactgtgttcactagcaacctcaaacagacaccatggccggcgggtctcctgaggagaagtctgccgttactgccctgtggggcaaggtgaccggcgggtaagttggtggtgaggccctgggcaggctgctggtggtctacccttccggcgggtggtcgactcggaccgatg

SEQ ID NO: 14650 - DNA, 203 bp, Homo sapiens
  source 1..203: mol_type = other DNA
ggcgcgccagtcctttaggcctcgctgacacaactgtgttcactagcaacctcaaacagacaccatggccggcgggtctcctgaggagaagtctgccgttactgccggcgggtgcaaggtgaacgtggatgaagttggtgccggcgggttgggcaggcccggcgggttctacccttccggcgggtggtcgactcggaccgatg

SEQ ID NO: 14651 - DNA, 203 bp, Homo sapiens
  source 1..203: mol_type = other DNA
ggcgcgccagtcctgttaggcctcctgacacaactgtgttcactagcaacctcaaacagacaccatggccggcgggtctcctgaggagaagtctgccgttactgccggcgggtgcaaggtgaacgtggatgaagttggtgccggcgggttgggcaggcccggcgggttctacccttggacccagaggtcgactcggaccgatg

SEQ ID NO: 14652 - DNA, 203 bp, Homo sapiens
  source 1..203: mol_type = other DNA
ggcgcgccagtcctggcctagtggctgacacaactgtgttcactagcaacctcaaacagacaccatggccggcgggtctcctgaggagaagtctgccgttactgccggcgggtgcaaggtgaacgtggatgaagttggtgccggcgggttgggcaggctgctggtggtctacccttggacccagaggtcgactcggaccgatg

SEQ ID NO: 14653 - DNA, 203 bp, Homo sapiens
  source 1..203: mol_type = other DNA
ggcgcgccagtcctttaagcacttctgacacaactgtgttcactagcaacctcaaacagacaccatggccggcgggtctcctgaggagaagtctgccgttactgccggcgggtgcaaggtgaacgtggatgaagttggtggtgaggccctgggcaggctgctggtggtctacccttccggcgggtggtcgactcggaccgatg

SEQ ID NO: 14654 - DNA, 203 bp, Homo sapiens
  source 1..203: mol_type = other DNA
ggcgcgccagtccttgtgcttgtactgacacaactgtgttcactagcaacctcaaacagacaccatggccggcgggtctcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 14655 - DNA, 203 bp, Homo sapiens
  source 1..203: mol_type = other DNA
ggcgcgccagtcctatgtgcttacctgacacaactgtgttcactagcaacctcaaacagacaccatggccggcgggtctcctgaggagaagtctgccgttactgccggcgggtgcaaggtgaccggcgggtaagttggtgccggcgggttgggcaggctgctggtggtctacccttggacccagaggtcgactcggaccgatg

SEQ ID NO: 14656 - DNA, 203 bp, Homo sapiens
  source 1..203: mol_type = other DNA
ggcgcgccagtcctgtgcttgtaactgacacaactgtgttcactagcaacctcaaacagacaccatggccggcgggtctcctgaggagaagtctgccgttactgccggcgggtgcaaggtgaccggcgggtaagttggtggtgaggccctgggcaggcccggcgggttctacccttccggcgggtggtcgactcggaccgatg

SEQ ID NO: 14657 - DNA, 203 bp, Homo sapiens
  source 1..203: mol_type = other DNA
ggcgcgccagtcctagtgcttttcctgacacaactgtgttcactagcaacctcaaacagacaccatggccggcgggtctcctgaggccggcgggtccgttactgccctgtggggcaaggtgaacgtggatgaagttggtgccggcgggttgggcaggcccggcgggttctacccttccggcgggtggtcgactcggaccgatg

SEQ ID NO: 14658 - DNA, 203 bp, Homo sapiens
  source 1..203: mol_type = other DNA
ggcgcgccagtcctgtaagcaccactgacacaactgtgttcactagcaacctcaaacagacaccatggccggcgggtctcctgaggccggcgggtccgttactgccctgtggggcaaggtgaacgtggatgaagttggtgccggcgggttgggcaggcccggcgggttctacccttggacccagaggtcgactcggaccgatg

SEQ ID NO: 14659 - DNA, 203 bp, Homo sapiens
  source 1..203: mol_type = other DNA
ggcgcgccagtccttaggttagttctgacacaactgtgttcactagcaacctcaaacagacaccatggccggcgggtctcctgaggccggcgggtccgttactgccctgtggggcaaggtgaccggcgggtaagttggtgccggcgggttgggcaggctgctggtggtctacccttccggcgggtggtcgactcggaccgatg

SEQ ID NO: 14660 - DNA, 203 bp, Homo sapiens
  source 1..203: mol_type = other DNA
ggcgcgccagtcctatactgaggactgacacaactgtgttcactagcaacctcaaacagacaccatggccggcgggtctcctgaggccggcgggtccgttactgccctgtggggcaaggtgaccggcgggtaagttggtgccggcgggttgggcaggctgctggtggtctacccttggacccagaggtcgactcggaccgatg

SEQ ID NO: 14661 - DNA, 203 bp, Homo sapiens
  source 1..203: mol_type = other DNA
ggcgcgccagtcctaatcacttagctgacacaactgtgttcactagcaacctcaaacagacaccatggccggcgggtctcctgaggccggcgggtccgttactgccggcgggtgcaaggtgaacgtggatgaagttggtgccggcgggttgggcaggcccggcgggttctacccttggacccagaggtcgactcggaccgatg

SEQ ID NO: 14662 - DNA, 203 bp, Homo sapiens
  source 1..203: mol_type = other DNA
ggcgcgccagtcctcacgcctagcctgacacaactgtgttcactagcaacctcaaacagacaccatggccggcgggtctcctgaggccggcgggtccgttactgccggcgggtgcaaggtgaacgtggatgaagttggtggtgaggccctgggcaggctgctggtggtctacccttccggcgggtggtcgactcggaccgatg

SEQ ID NO: 14663 - DNA, 203 bp, Homo sapiens
  source 1..203: mol_type = other DNA
ggcgcgccagtccttactgagcgactgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14664 - DNA, 203 bp, Homo sapiens
  source 1..203: mol_type = other DNA
ggcgcgccagtcctgatcaaccgtctgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14665 - DNA, 203 bp, Homo sapiens
  source 1..203: mol_type = other DNA
ggcgcgccagtccttctgcaacacctgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14666 - DNA, 203 bp, Homo sapiens
  source 1..203: mol_type = other DNA
ggcgcgccagtcctcctgtaaaccctgacacaactgtgttcactagcaacctcaaacagacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 14667 - DNA, 203 bp, Homo sapiens
  source 1..203: mol_type = other DNA
ggcgcgccagtcctcaagtgaaccctgacacaactgtgttcactagcaacctcaaacagacaccatggccggcgggtctcctgaggccggcgggtccgttactgccggcgggtgcaaggtgaccggcgggtaagttggtggtgaggccctgggcaggcccggcgggttctacccttccggcgggtggtcgactcggaccgatg

SEQ ID NO: 14668 - DNA, 203 bp, Homo sapiens
  source 1..203: mol_type = other DNA
ggcgcgccagtcctggctaaccttctgacacaactgtgttcactagcaacctcaaacagacaccatggcgtcaattcctttagaggagaagtctgccgttactgccctgtggggcaaggtgaacgtggatgaagttggtgcgtcaattcctttaaggctgctggtggtctacccttggacccagaggtcgactcggaccgatg

SEQ ID NO: 14669 - DNA, 203 bp, Homo sapiens
  source 1..203: mol_type = other DNA
ggcgcgccagtcctaagagtgtccctgacacaactgtgttcactagcaacctcaaacagacaccatggcgtcaattcctttagaggagaagtctgccgttactgcgtcaattcctttagtgaacgtggatgaagttggtgcgtcaattcctttaaggctgctggtggtctacccttggacccagaggtcgactcggaccgatg

SEQ ID NO: 14670 - DNA, 203 bp, Homo sapiens
  source 1..203: mol_type = other DNA
ggcgcgccagtccttgaggtaaccctgacacaactgtgttcactagcaacctcaaacagacaccatggcgtcaattcctttagaggagaagtctgccgttactgcgtcaattcctttagtgacgtcaattcctttaggtgcgtcaattcctttaaggctgctggtggtctacccttggacccagaggtcgactcggaccgatg

SEQ ID NO: 14671 - DNA, 203 bp, Homo sapiens
  source 1..203: mol_type = other DNA
ggcgcgccagtcctggcaacagatctgacacaactgtgttcactagcaacctcaaacagacaccatggcgtcaattcctttagaggagaagtctgccgttactgcgtcaattcctttagtgacgtcaattcctttaggtggtgaggccctgggcaggctgctggtggtctacccttggacccagaggtcgactcggaccgatg

SEQ ID NO: 14672 - DNA, 203 bp, Homo sapiens
  source 1..203: mol_type = other DNA
ggcgcgccagtcctggtcaaagctctgacacaactgtgttcactagcaacctcaaacagacaccatggcgtcaattcctttagaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 14673 - DNA, 203 bp, Homo sapiens
  source 1..203: mol_type = other DNA
ggcgcgccagtcctggttcttgacctgacacaactgtgttcactagcaacctcaaacagacaccatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 14674 - DNA, 203 bp, Homo sapiens
  source 1..203: mol_type = other DNA
ggcgcgccagtcctggtttgcagtctgacacaactgtgttcactagcaacctcaaacagacaccatggcgtcaattcctttagaggcgtcaattcctttaactgcgtcaattcctttagtgacgtcaattcctttaggtgcgtcaattcctttaaggccgtcaattcctttaccttggacccagaggtcgactcggaccgatg

SEQ ID NO: 14675 - DNA, 203 bp, Homo sapiens
  source 1..203: mol_type = other DNA
ggcgcgccagtcctggttaaccagctgacacaactgtgttcactagcaacctcaaacagacaccatggggaaccataactgatttaatgagccattcgcagtttcactgtaccggccgtgcgtactcagacatgcatggcttaatctttgagacaagcatctggtggtctacccttggacccagaggtcgactcggaccgatg

SEQ ID NO: 14676 - DNA, 203 bp, Homo sapiens
  source 1..203: mol_type = other DNA
ggcgcgccagtcctggctaaaggtctgacacaactgtgttcactagcaacctcaaacagacaccatggggtgcccttccgtcaattcctttaagtttcagctttgcaaccatactccccccggaacccaaagactttggtttcccggaagctgcccggcgctggtggtctacccttggacccagaggtcgactcggaccgatg

SEQ ID NO: 14677 - DNA, 203 bp, Homo sapiens
  source 1..203: mol_type = other DNA
ggcgcgccagtcctggtttctgagctgacacaactgtgttcactagcaacctcaaacagacaccatggtaaattaagccgcaggctccactcctggtggtgcccttccgtcaattcctttaagtttcagctttgcaaccatactccccccggaacccaagctggtggtctacccttggacccagaggtcgactcggaccgatg

SEQ ID NO: 14678 - DNA, 203 bp, Homo sapiens
  source 1..203: mol_type = other DNA
ggcgcgccagtcctggacaaactgctgacacaactgtgttcactagcaacctcaaacagacaccatggtactcccgactcctgaggagaagtctgccgttactgccctgtggggcaaggtgaacgtggatgaagttggtggtgaggccctgggcaggctactcccggtctaccctttactcccgaggtcgactcggaccgatg

SEQ ID NO: 14679 - DNA, 203 bp, Homo sapiens
  source 1..203: mol_type = other DNA
ggcgcgccagtcctggactgtcttctgacacaactgtgttcactagcaacctcaaacagacaccatggtactcccgactcctgaggagaagtctgccgttactgccctgtggggcaaggtgaacgtggatgaagttggtgtactccccctgggcaggctactcccggtctacccttggacccagaggtcgactcggaccgatg

SEQ ID NO: 14680 - DNA, 203 bp, Homo sapiens
  source 1..203: mol_type = other DNA
ggcgcgccagtcctagtcgataccctgacacaactgtgttcactagcaacctcaaacagacaccatggtactcccgactcctgaggagaagtctgccgttactgccctgtggggcaaggtgatactccctgaagttggtggtgaggccctgggcaggctgctggtggtctaccctttactcccgaggtcgactcggaccgatg

SEQ ID NO: 14681 - DNA, 203 bp, Homo sapiens
  source 1..203: mol_type = other DNA
ggcgcgccagtcctgtagtcgatactgacacaactgtgttcactagcaacctcaaacagacaccatggtactcccgactcctgaggagaagtctgccgttactgccctgtggggcaaggtgatactccctgaagttggtgtactccccctgggcaggctgctggtggtctacccttggacccagaggtcgactcggaccgatg

SEQ ID NO: 14682 - DNA, 203 bp, Homo sapiens
  source 1..203: mol_type = other DNA
ggcgcgccagtccttcgactgtcactgacacaactgtgttcactagcaacctcaaacagacaccatggtactcccgactcctgaggagaagtctgccgttactgtactcccgggcaaggtgaacgtggatgaagttggtggtgaggccctgggcaggctactcccggtctacccttggacccagaggtcgactcggaccgatg

SEQ ID NO: 14683 - DNA, 203 bp, Homo sapiens
  source 1..203: mol_type = other DNA
ggcgcgccagtcctagcgttttgcctgacacaactgtgttcactagcaacctcaaacagacaccatggtactcccgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 14684 - DNA, 203 bp, Homo sapiens
  source 1..203: mol_type = other DNA
ggcgcgccagtcctaacagcgtttctgacacaactgtgttcactagcaacctcaaacagacaccatggtactcccgactcctgaggagaagtctgccgttactgtactcccgggcaaggtgaacgtggatgaagttggtgtactccccctgggcaggctgctggtggtctaccctttactcccgaggtcgactcggaccgatg

SEQ ID NO: 14685 - DNA, 203 bp, Homo sapiens
  source 1..203: mol_type = other DNA
ggcgcgccagtcctaaacgctcgtctgacacaactgtgttcactagcaacctcaaacagacaccatggtactcccgactcctgaggagaagtctgccgttactgtactcccgggcaaggtgatactccctgaagttggtggtgaggccctgggcaggctgctggtggtctaccctttactcccgaggtcgactcggaccgatg

SEQ ID NO: 14686 - DNA, 203 bp, Homo sapiens
  source 1..203: mol_type = other DNA
ggcgcgccagtcctgtgggtctacctgacacaactgtgttcactagcaacctcaaacagacaccatggtactcccgactcctgaggagaagtctgccgttactgtactcccgggcaaggtgatactccctgaagttggtgtactccccctgggcaggctactcccggtctacccttggacccagaggtcgactcggaccgatg

SEQ ID NO: 14687 - DNA, 203 bp, Homo sapiens
  source 1..203: mol_type = other DNA
ggcgcgccagtcctggttgcaccactgacacaactgtgttcactagcaacctcaaacagacaccatggtactcccgactcctgaggtactccctgccgttactgccctgtggggcaaggtgaacgtggatgaagttggtggtgaggccctgggcaggctactcccggtctaccctttactcccgaggtcgactcggaccgatg

SEQ ID NO: 14688 - DNA, 203 bp, Homo sapiens
  source 1..203: mol_type = other DNA
ggcgcgccagtcctgaggtacacactgacacaactgtgttcactagcaacctcaaacagacaccatggtactcccgactcctgaggtactccctgccgttactgccctgtggggcaaggtgaacgtggatgaagttggtgtactccccctgggcaggctgctggtggtctacccttggacccagaggtcgactcggaccgatg

SEQ ID NO: 14689 - DNA, 203 bp, Homo sapiens
  source 1..203: mol_type = other DNA
ggcgcgccagtcctgctcaaaattctgacacaactgtgttcactagcaacctcaaacagacaccatggtactcccgactcctgaggtactccctgccgttactgccctgtggggcaaggtgatactccctgaagttggtggtgaggccctgggcaggctactcccggtctaccctttactcccgaggtcgactcggaccgatg

SEQ ID NO: 14690 - DNA, 203 bp, Homo sapiens
  source 1..203: mol_type = other DNA
ggcgcgccagtcctccaccaaattctgacacaactgtgttcactagcaacctcaaacagacaccatggtactcccgactcctgaggtactccctgccgttactgccctgtggggcaaggtgatactccctgaagttggtggtgaggccctgggcaggctgctggtggtctaccctttactcccgaggtcgactcggaccgatg

SEQ ID NO: 14691 - DNA, 203 bp, Homo sapiens
  source 1..203: mol_type = other DNA
ggcgcgccagtccttgtagaaattctgacacaactgtgttcactagcaacctcaaacagacaccatggtactcccgactcctgaggtactccctgccgttactgccctgtggggcaaggtgatactccctgaagttggtgtactccccctgggcaggctactcccggtctaccctttactcccgaggtcgactcggaccgatg

SEQ ID NO: 14692 - DNA, 203 bp, Homo sapiens
  source 1..203: mol_type = other DNA
ggcgcgccagtccttagaacttgcctgacacaactgtgttcactagcaacctcaaacagacaccatggtactcccgactcctgaggtactccctgccgttactgtactcccgggcaaggtgatactccctgaagttggtgtactccccctgggcaggctgctggtggtctaccctttactcccgaggtcgactcggaccgatg

SEQ ID NO: 14693 - DNA, 203 bp, Homo sapiens
  source 1..203: mol_type = other DNA
ggcgcgccagtcctctagaacttcctgacacaactgtgttcactagcaacctcaaacagacaccatggtatcgctccaccaactaagaacggccatgcaccaccacccacggaatcgagaaagagctatcaatctgtcaatcctgtccgtgtccgggccgctggtggtctacccttggacccagaggtcgactcggaccgatg

SEQ ID NO: 14694 - DNA, 203 bp, Homo sapiens
  source 1..203: mol_type = other DNA
ggcgcgccagtcctaatctgacgtctgacacaactgtgttcactagcaacctcaaacagacaccatggtcacggaatcgagaaaggagaagtctgccgttactgccctgtggggcaaggtgaacgtggatgaagttggtggtgaggccctgggcaggctgctggtggtctacccttggacctactccccgactcggaccgatg

SEQ ID NO: 14695 - DNA, 203 bp, Homo sapiens
  source 1..203: mol_type = other DNA
ggcgcgccagtccttgctcggtgactgacacaactgtgttcactagcaacctcaaacagacaccatggtcgtcaattcctttaaggagaagtctgccgttactgccctgtggggcaaggtgaacgtggatgaagttggtggtgaggccctgggcaggctgctggtggtctacccttggacccagaggtcgactcggaccgatg

SEQ ID NO: 14696 - DNA, 203 bp, Homo sapiens
  source 1..203: mol_type = other DNA
ggcgcgccagtcctgacaacattcctgacacaactgtgttcactagcaacctcaaacagacaccatggtgcacacggaatcgagaaagaagtctgccgttactgccctgtggggcaaggtgaacgtggatgaagttggtggtgaggccctgggcaggctgctggtggtctacccttgttcttggcaaacgactcggaccgatg

SEQ ID NO: 14697 - DNA, 203 bp, Homo sapiens
  source 1..203: mol_type = other DNA
ggcgcgccagtcctgtgtaccatgctgacacaactgtgttcactagcaacctcaaacagacaccatggtgcacgtcaattcctttaagaagtctgccgttactgccctgtggggcaaggtgaacgtggatgaagttggtggtgaggccctgggcaggctgctggtggtctacccttgttcttggcaaacgactcggaccgatg

SEQ ID NO: 14698 - DNA, 203 bp, Homo sapiens
  source 1..203: mol_type = other DNA
ggcgcgccagtcctgcacgatcgtctgacacaactgtgttcactagcaacctcaaacagacaccatggtgcatcaccggccgtaggagaagtctgccgttactgccctgtggggcaaggtgaacgtggatgaagttggtggtgaggccctgggcaggctgctggtggtctacccttggacccagaggtcgactcggaccgatg

SEQ ID NO: 14699 - DNA, 203 bp, Homo sapiens
  source 1..203: mol_type = other DNA
ggcgcgccagtcctatcacgatacctgacacaactgtgttcactagcaacctcaaacagacaccatggtgcatcaccggccgtaggagaagtctgccgttactgccctgtggggcaaggtgaacgtggatgaagttggtggtgaggccctgggcaggctgctggtggtctacccttggacctactccccgactcggaccgatg

SEQ ID NO: 14700 - DNA, 203 bp, Homo sapiens
  source 1..203: mol_type = other DNA
ggcgcgccagtcctgacgtcactactgacacaactgtgttcactagcaacctcaaacagacaccatggtgcatcataactgatttaatgagccattcgcagtttcactgtaccggccgtgcgtactcagacatgcatggcttaatctttgagacaggctgctggtggtctacccttggacccagaggtcgactcggaccgatg

SEQ ID NO: 14701 - DNA, 203 bp, Homo sapiens
  source 1..203: mol_type = other DNA
ggcgcgccagtcctactctcgtgtctgacacaactgtgttcactagcaacctcaaacagacaccatggtgcatcccggcgggtaggagaagtctgccgttactgccctgtggggcaaggtgaacgtggatgaagttggtggtgaggccctgggcaggctgctggtggtctaccccacggaatcgagaacgactcggaccgatg

SEQ ID NO: 14702 - DNA, 203 bp, Homo sapiens
  source 1..203: mol_type = other DNA
ggcgcgccagtcctcaactcgtgactgacacaactgtgttcactagcaacctcaaacagacaccatggtgcatcccggcgggtaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14703 - DNA, 203 bp, Homo sapiens
  source 1..203: mol_type = other DNA
ggcgcgccagtccttgagctcgtgctgacacaactgtgttcactagcaacctcaaacagacaccatggtgcatccgtcaattcctttaaagtctgccgttactgccctgtggggcaaggtgaacgtggatgaagttggtggtgaggccctgggcaggctgctggtggtctacccttggaaccggccgtcgactcggaccgatg

SEQ ID NO: 14704 - DNA, 203 bp, Homo sapiens
  source 1..203: mol_type = other DNA
ggcgcgccagtcctcacgagctagctgacacaactgtgttcactagcaacctcaaacagacaccatggtgcatccgtcaattcctttaaagtctgccgttactgccctgtggggcaaggtgaacgtggatgaagttggtggtgaggccctgggcaggctgctggtggtctacccttggaccggcgggtcgactcggaccgatg

SEQ ID NO: 14705 - DNA, 203 bp, Homo sapiens
  source 1..203: mol_type = other DNA
ggcgcgccagtccttaagcacgagctgacacaactgtgttcactagcaacctcaaacagacaccatggtgcatccttccgtcaattcctttaagtttcagctttgcaaccatactccccccggaacccaaagactttggtttcccggaagctgcaggctgctggtggtctacccttggacccagaggtcgactcggaccgatg

SEQ ID NO: 14706 - DNA, 203 bp, Homo sapiens
  source 1..203: mol_type = other DNA
ggcgcgccagtcctcacgagtttcctgacacaactgtgttcactagcaacctcaaacagacaccatggtgcatccttccgtcaattcctttaagtttcagctttgcaaccatactccccccggaacccaaagactttggtttcccggaagctgccggctgctggtggtctacccttggacccagaggtcgactcggaccgatg

SEQ ID NO: 14707 - DNA, 203 bp, Homo sapiens
  source 1..203: mol_type = other DNA
ggcgcgccagtccttcacgagtatctgacacaactgtgttcactagcaacctcaaacagacaccatggtgcatctaacctccgactttcgttcttgattaatgaaaacattcttggcaaatgctttcgctctggtccgtcttgcgccggtccacaggctgctggtggtctacccttggacccagaggtcgactcggaccgatg

SEQ ID NO: 14708 - DNA, 203 bp, Homo sapiens
  source 1..203: mol_type = other DNA
ggcgcgccagtccttctgttgagcctgacacaactgtgttcactagcaacctcaaacagacaccatggtgcatctagccgcaggctccactcctggtggtgcccttccgtcaattcctttaagtttcagctttgcaaccatactccccccggacaggctgctggtggtctacccttggacccagaggtcgactcggaccgatg

SEQ ID NO: 14709 - DNA, 203 bp, Homo sapiens
  source 1..203: mol_type = other DNA
ggcgcgccagtccttatgcacggtctgacacaactgtgttcactagcaacctcaaacagacaccatggtgcatctccaccaactaagaacggccatgcaccaccacccacggaatcgagaaagagctatcaatctgtcaatcctgtccgtgtccgggctgctggtggtctacccttggacccagaggtcgactcggaccgatg

SEQ ID NO: 14710 - DNA, 203 bp, Homo sapiens
  source 1..203: mol_type = other DNA
ggcgcgccagtcctaaggctcggtctgacacaactgtgttcactagcaacctcaaacagacaccatggtgcatctgacccaactaagaacggccatgcaccaccacccacggaatcgagaaagagctatcaatctgtcaatcctgtccgtgggcaggctgctggtggtctacccttggacccagaggtcgactcggaccgatg

SEQ ID NO: 14711 - DNA, 203 bp, Homo sapiens
  source 1..203: mol_type = other DNA
ggcgcgccagtcctacggtctaaactgacacaactgtgttcactagcaacctcaaacagacaccatggtgcatctgaccggcgggtagaagtctgccgttactgccctgtggggcaaggtgaacgtggatgaagttggtggtgaggccctgggcaggctgctggtggtctacccttgttcttggcaaacgactcggaccgatg

SEQ ID NO: 14712 - DNA, 203 bp, Homo sapiens
  source 1..203: mol_type = other DNA
ggcgcgccagtcctctttagagtactgacacaactgtgttcactagcaacctcaaacagacaccatggtgcatctgacctccgactttcgttcttgattaatgaaaacattcttggcaaatgctttcgctctggtccgtcttgcgccggtcggcaggctgctggtggtctacccttggacccagaggtcgactcggaccgatg

SEQ ID NO: 14713 - DNA, 203 bp, Homo sapiens
  source 1..203: mol_type = other DNA
ggcgcgccagtcctagtctaaaggctgacacaactgtgttcactagcaacctcaaacagacaccatggtgcatctgacctgatttaatgagccattcgcagtttcactgtaccggccgtgcgtactcagacatgcatggcttaatctttggggcaggctgctggtggtctacccttggacccagaggtcgactcggaccgatg

SEQ ID NO: 14714 - DNA, 203 bp, Homo sapiens
  source 1..203: mol_type = other DNA
ggcgcgccagtcctataccatgttctgacacaactgtgttcactagcaacctcaaacagacaccatggtgcatctgactaacccaaagactttggtttcccggaagctgcccggcgggtcatgggaataacgccgccgcatcgccggtctgggcaggctgctggtggtctacccttggacccagaggtcgactcggaccgatg

SEQ ID NO: 14715 - DNA, 203 bp, Homo sapiens
  source 1..203: mol_type = other DNA
ggcgcgccagtccttccagaaacgctgacacaactgtgttcactagcaacctcaaacagacaccatggtgcatctgactaccggccgtaagtctgccgttactgccctgtggggcaaggtgaacgtggatgaagttggtggtgaggccctgggcaggctgctggtggtctacccttggaaccggccgtcgactcggaccgatg

SEQ ID NO: 14716 - DNA, 203 bp, Homo sapiens
  source 1..203: mol_type = other DNA
ggcgcgccagtcctccagtgcacgctgacacaactgtgttcactagcaacctcaaacagacaccatggtgcatctgactccaccggccgtgtctgccgttactgccctgtggggcaaggtgaacgtggatgaagttggtggtgaggccctgggcaggctgctggtggtctaccccgtcaattcctttacgactcggaccgatg

SEQ ID NO: 14717 - DNA, 203 bp, Homo sapiens
  source 1..203: mol_type = other DNA
ggcgcgccagtcctctcagagacgctgacacaactgtgttcactagcaacctcaaacagacaccatggtgcatctgactccaccggccgtgtctgccgttactgccctgtggggcaaggtgaacgtggatgaagttggtggtgaggccctgggcaggctgctggtggtctacccttggacctactccccgactcggaccgatg

SEQ ID NO: 14718 - DNA, 203 bp, Homo sapiens
  source 1..203: mol_type = other DNA
ggcgcgccagtcctcgttagtttactgacacaactgtgttcactagcaacctcaaacagacaccatggtgcatctgactccatttaatgagccattcgcagtttcactgtaccggccgtgcgtactcagacatgcatggcttaatctcctgggcaggctgctggtggtctacccttggacccagaggtcgactcggaccgatg

SEQ ID NO: 14719 - DNA, 203 bp, Homo sapiens
  source 1..203: mol_type = other DNA
ggcgcgccagtcctcgtcgtctacctgacacaactgtgttcactagcaacctcaaacagacaccatggtgcatctgactcccacggaatcgagaaccgttactgccctgtggggcaaggtgaacgtggatgaagttggtggtgaggccctgggcaggctgctggtggtctacccttggaaccggccgtcgactcggaccgatg

SEQ ID NO: 14720 - DNA, 203 bp, Homo sapiens
  source 1..203: mol_type = other DNA
ggcgcgccagtcctcgacaagacgctgacacaactgtgttcactagcaacctcaaacagacaccatggtgcatctgactcccacggaatcgagaaccgttactgccctgtggggcaaggtgaacgtggatgaagttggtggtgaggccctgggcaggctgctggtggtctacccttggaccggcgggtcgactcggaccgatg

SEQ ID NO: 14721 - DNA, 203 bp, Homo sapiens
  source 1..203: mol_type = other DNA
ggcgcgccagtcctacgcctgacgctgacacaactgtgttcactagcaacctcaaacagacaccatggtgcatctgactcccccaaagactttggtttcccggaagctgcccggcgggtcatgggaataacgccgccgcatcgccggcctgggcaggctgctggtggtctacccttggacccagaggtcgactcggaccgatg

SEQ ID NO: 14722 - DNA, 203 bp, Homo sapiens
  source 1..203: mol_type = other DNA
ggcgcgccagtcctaatcttaacgctgacacaactgtgttcactagcaacctcaaacagacaccatggtgcatctgactcccgactttcgttcttgattaatgaaaacattcttggcaaatgctttcgctctggtccgtcttgcgcccctgggcaggctgctggtggtctacccttggacccagaggtcgactcggaccgatg

SEQ ID NO: 14723 - DNA, 203 bp, Homo sapiens
  source 1..203: mol_type = other DNA
ggcgcgccagtcctgagctttacgctgacacaactgtgttcactagcaacctcaaacagacaccatggtgcatctgactcctactcccaagtctgccgttactgccctgtggggcaaggtgaacgtggatgaagttggtggtgaggccctgggcaggctgctggtggtctacccttggaccggcgggtcgactcggaccgatg

SEQ ID NO: 14724 - DNA, 203 bp, Homo sapiens
  source 1..203: mol_type = other DNA
ggcgcgccagtcctcgtgctcacgctgacacaactgtgttcactagcaacctcaaacagacaccatggtgcatctgactcctgaccggcgggttgccgttactgccctgtggggcaaggtgaacgtggatgaagttggtggtgaggccctgggcaggctgctggtggtctacccttgttcttggcaaacgactcggaccgatg

SEQ ID NO: 14725 - DNA, 203 bp, Homo sapiens
  source 1..203: mol_type = other DNA
ggcgcgccagtcctcgtcagcacgctgacacaactgtgttcactagcaacctcaaacagacaccatggtgcatctgactcctgactccactcctggtggtgcccttccgtcaattcctttaagtttcagctttgcaaccatactggccctgggcaggctgctggtggtctacccttggacccagaggtcgactcggaccgatg

SEQ ID NO: 14726 - DNA, 203 bp, Homo sapiens
  source 1..203: mol_type = other DNA
ggcgcgccagtcctgaatcagacgctgacacaactgtgttcactagcaacctcaaacagacaccatggtgcatctgactcctgagaatgagccattcgcagtttcactgtaccggccgtgcgtactcagacatgcatggcttaaggccctgggcaggctgctggtggtctacccttggacccagaggtcgactcggaccgatg

SEQ ID NO: 14727 - DNA, 203 bp, Homo sapiens
  source 1..203: mol_type = other DNA
ggcgcgccagtcctcactctaacgctgacacaactgtgttcactagcaacctcaaacagacaccatggtgcatctgactcctgagagaacggccatgcaccaccacccacggaatcgagaaagagctatcaatctgtcaatccaggccctgggcaggctgctggtggtctacccttggacccagaggtcgactcggaccgatg

SEQ ID NO: 14728 - DNA, 203 bp, Homo sapiens
  source 1..203: mol_type = other DNA
ggcgcgccagtcctcgtacacattctgacacaactgtgttcactagcaacctcaaacagacaccatggtgcatctgactcctgaggaaacggccatgcaccaccacccacggaatcgagaaagagctatcaatctgtcaattgaggccctgggcaggctgctggtggtctacccttggacccagaggtcgactcggaccgatg

SEQ ID NO: 14729 - DNA, 203 bp, Homo sapiens
  source 1..203: mol_type = other DNA
ggcgcgccagtcctgttgtgaacgctgacacaactgtgttcactagcaacctcaaacagacaccatggtgcatctgactcctgaggaacggaatcgagaaactgaacggaatcgagaagtgaaacggaatcgagaaggtgaacggaatcgagaaaggcaacggaatcgagaaccttggacccagaggtcgactcggaccgatg

SEQ ID NO: 14730 - DNA, 203 bp, Homo sapiens
  source 1..203: mol_type = other DNA
ggcgcgccagtcctcgtcttctggctgacacaactgtgttcactagcaacctcaaacagacaccatggtgcatctgactcctgaggaactccctgccgttactgaactcccgggcaaggtgaaactccctgaagttggtgaactccccctgggcaggcaactcccggtctacccttggacccagaggtcgactcggaccgatg

SEQ ID NO: 14731 - DNA, 203 bp, Homo sapiens
  source 1..203: mol_type = other DNA
ggcgcgccagtcctcgtcaccttcctgacacaactgtgttcactagcaacctcaaacagacaccatggtgcatctgactcctgaggaccgagcgtccgttactgaccgagcgtgcaaggtgaaccgagcgtaagttggtgaccgagcgttgggcaggcaccgagcgttctacccttggacccagaggtcgactcggaccgatg

SEQ ID NO: 14732 - DNA, 203 bp, Homo sapiens
  source 1..203: mol_type = other DNA
ggcgcgccagtcctggttagtacgctgacacaactgtgttcactagcaacctcaaacagacaccatggtgcatctgactcctgaggaccgatcgtccgttactgaccgatcgtgcaaggtgaaccgatcgtaagttggtgaccgatcgttgggcaggcaccgatcgttctacccttggacccagaggtcgactcggaccgatg

SEQ ID NO: 14733 - DNA, 203 bp, Homo sapiens
  source 1..203: mol_type = other DNA
ggcgcgccagtcctcgttaactcgctgacacaactgtgttcactagcaacctcaaacagacaccatggtgcatctgactcctgaggaccgcacgtccgttactgaccgcacgtgcaaggtgaaccgcacgtaagttggtgaccgcacgttgggcaggcaccgcacgttctacccttggacccagaggtcgactcggaccgatg

SEQ ID NO: 14734 - DNA, 203 bp, Homo sapiens
  source 1..203: mol_type = other DNA
ggcgcgccagtccttacccaaacgctgacacaactgtgttcactagcaacctcaaacagacaccatggtgcatctgactcctgaggaccgcccgtccgttactgaccgcccgtgcaaggtgaaccgcccgtaagttggtgaccgcccgttgggcaggcaccgcccgttctacccttggacccagaggtcgactcggaccgatg

SEQ ID NO: 14735 - DNA, 203 bp, Homo sapiens
  source 1..203: mol_type = other DNA
ggcgcgccagtcctcgtttgaacactgacacaactgtgttcactagcaacctcaaacagacaccatggtgcatctgactcctgaggaccgctcgtccgttactgaccgctcgtgcaaggtgaaccgctcgtaagttggtgaccgctcgttgggcaggcaccgctcgttctacccttggacccagaggtcgactcggaccgatg

SEQ ID NO: 14736 - DNA, 203 bp, Homo sapiens
  source 1..203: mol_type = other DNA
ggcgcgccagtcctcgtagtcgagctgacacaactgtgttcactagcaacctcaaacagacaccatggtgcatctgactcctgaggaccggacgtccgttactgaccggacgtgcaaggtgaaccggacgtaagttggtgaccggacgttgggcaggcaccggacgttctacccttggacccagaggtcgactcggaccgatg

SEQ ID NO: 14737 - DNA, 203 bp, Homo sapiens
  source 1..203: mol_type = other DNA
ggcgcgccagtccttggtagaaccctgacacaactgtgttcactagcaacctcaaacagacaccatggtgcatctgactcctgaggaccggccaaccgttactgaccggccaagcaaggtgaaccggccaaaagttggtgaccggccaatgggcaggcaccggccaatctacccttggacccagaggtcgactcggaccgatg

SEQ ID NO: 14738 - DNA, 203 bp, Homo sapiens
  source 1..203: mol_type = other DNA
ggcgcgccagtcctgaatacagcgctgacacaactgtgttcactagcaacctcaaacagacaccatggtgcatctgactcctgaggaccggccacccgttactgaccggccacgcaaggtgaaccggccacaagttggtgaccggccactgggcaggcaccggccactctacccttggacccagaggtcgactcggaccgatg

SEQ ID NO: 14739 - DNA, 203 bp, Homo sapiens
  source 1..203: mol_type = other DNA
ggcgcgccagtccttcttacagcgctgacacaactgtgttcactagcaacctcaaacagacaccatggtgcatctgactcctgaggaccggccagccgttactgaccggccaggcaaggtgaaccggccagaagttggtgaccggccagtgggcaggcaccggccagtctacccttggacccagaggtcgactcggaccgatg

SEQ ID NO: 14740 - DNA, 203 bp, Homo sapiens
  source 1..203: mol_type = other DNA
ggcgcgccagtcctgcaccaagcgctgacacaactgtgttcactagcaacctcaaacagacaccatggtgcatctgactcctgaggaccggccatccgttactgaccggccatgcaaggtgaaccggccataagttggtgaccggccattgggcaggcaccggccattctacccttggacccagaggtcgactcggaccgatg

SEQ ID NO: 14741 - DNA, 203 bp, Homo sapiens
  source 1..203: mol_type = other DNA
ggcgcgccagtccttgggtctgcgctgacacaactgtgttcactagcaacctcaaacagacaccatggtgcatctgactcctgaggaccggccccccgttactgaccggccccgcaaggtgaaccggccccaagttggtgaccggcccctgggcaggcaccggcccctctacccttggacccagaggtcgactcggaccgatg

SEQ ID NO: 14742 - DNA, 203 bp, Homo sapiens
  source 1..203: mol_type = other DNA
ggcgcgccagtcctcctacaagcgctgacacaactgtgttcactagcaacctcaaacagacaccatggtgcatctgactcctgaggaccggccctccgttactgaccggccctgcaaggtgaaccggccctaagttggtgaccggcccttgggcaggcaccggcccttctacccttggacccagaggtcgactcggaccgatg

SEQ ID NO: 14743 - DNA, 203 bp, Homo sapiens
  source 1..203: mol_type = other DNA
ggcgcgccagtcctctgtgaggcgctgacacaactgtgttcactagcaacctcaaacagacaccatggtgcatctgactcctgaggaccggccggccgttactgaccggccgggcaaggtgaaccggccggaagttggtgaccggccggtgggcaggcaccggccggtctacccttggacccagaggtcgactcggaccgatg

SEQ ID NO: 14744 - DNA, 203 bp, Homo sapiens
  source 1..203: mol_type = other DNA
ggcgcgccagtcctacggtaagcgctgacacaactgtgttcactagcaacctcaaacagacaccatggtgcatctgactcctgaggaccggccgtccgttactgaccggccgtgcaaggtgaaccggccgtaagttggtgaccggccgttgggcaggcaccggccgttctacccttaccggccgtggtcgactcggaccgatg

SEQ ID NO: 14745 - DNA, 203 bp, Homo sapiens
  source 1..203: mol_type = other DNA
ggcgcgccagtccttaaactagcgctgacacaactgtgttcactagcaacctcaaacagacaccatggtgcatctgactcctgaggaccggccgtccgttactgaccggccgtgcaaggtgaaccggccgtaagttggtggtgaggccctgggcaggcaccggccgttctacccttggacccagaggtcgactcggaccgatg

SEQ ID NO: 14746 - DNA, 203 bp, Homo sapiens
  source 1..203: mol_type = other DNA
ggcgcgccagtcctactttaggcgctgacacaactgtgttcactagcaacctcaaacagacaccatggtgcatctgactcctgaggaccggccgtccgttactgaccggccgtgcaaggtgaacgtggatgaagttggtgaccggccgttgggcaggcaccggccgttctacccttaccggccgtggtcgactcggaccgatg

SEQ ID NO: 14747 - DNA, 203 bp, Homo sapiens
  source 1..203: mol_type = other DNA
ggcgcgccagtcctcaacgttgcgctgacacaactgtgttcactagcaacctcaaacagacaccatggtgcatctgactcctgaggaccggccgtccgttactgaccggccgtgcaaggtgaacgtggatgaagttggtggtgaggccctgggcaggcaccggccgttctacccttaccggccgtggtcgactcggaccgatg

SEQ ID NO: 14748 - DNA, 203 bp, Homo sapiens
  source 1..203: mol_type = other DNA
ggcgcgccagtcctgtatgctgcgctgacacaactgtgttcactagcaacctcaaacagacaccatggtgcatctgactcctgaggaccggccgtccgttactgaccggccgtgcaaggtgaacgtggatgaagttggtggtgaggccctgggcaggctgctggtggtctacccttggacccagaggtcgactcggaccgatg

SEQ ID NO: 14749 - DNA, 203 bp, Homo sapiens
  source 1..203: mol_type = other DNA
ggcgcgccagtcctgcttgaagcgctgacacaactgtgttcactagcaacctcaaacagacaccatggtgcatctgactcctgaggaccggccgtccgttactgccctgtggggcaaggtgaaccggccgtaagttggtgaccggccgttgggcaggcaccggccgttctacccttaccggccgtggtcgactcggaccgatg

SEQ ID NO: 14750 - DNA, 203 bp, Homo sapiens
  source 1..203: mol_type = other DNA
ggcgcgccagtccttggtctagcgctgacacaactgtgttcactagcaacctcaaacagacaccatggtgcatctgactcctgaggaccggccgtccgttactgccctgtggggcaaggtgaaccggccgtaagttggtgaccggccgttgggcaggcaccggccgttctacccttggacccagaggtcgactcggaccgatg

SEQ ID NO: 14751 - DNA, 203 bp, Homo sapiens
  source 1..203: mol_type = other DNA
ggcgcgccagtcctcgcattcaggctgacacaactgtgttcactagcaacctcaaacagacaccatggtgcatctgactcctgaggaccggccgtccgttactgccctgtggggcaaggtgaaccggccgtaagttggtgaccggccgttgggcaggctgctggtggtctacccttaccggccgtggtcgactcggaccgatg

SEQ ID NO: 14752 - DNA, 203 bp, Homo sapiens
  source 1..203: mol_type = other DNA
ggcgcgccagtcctcgctaggatcctgacacaactgtgttcactagcaacctcaaacagacaccatggtgcatctgactcctgaggaccggccgtccgttactgccctgtggggcaaggtgaacgtggatgaagttggtgaccggccgttgggcaggcaccggccgttctacccttggacccagaggtcgactcggaccgatg

SEQ ID NO: 14753 - DNA, 203 bp, Homo sapiens
  source 1..203: mol_type = other DNA
ggcgcgccagtcctcgctgagtatctgacacaactgtgttcactagcaacctcaaacagacaccatggtgcatctgactcctgaggaccggccgtccgttactgccctgtggggcaaggtgaacgtggatgaagttggtgaccggccgttgggcaggctgctggtggtctacccttggacccagaggtcgactcggaccgatg

SEQ ID NO: 14754 - DNA, 203 bp, Homo sapiens
  source 1..203: mol_type = other DNA
ggcgcgccagtcctcgcaaagtaactgacacaactgtgttcactagcaacctcaaacagacaccatggtgcatctgactcctgaggaccggccgtccgttactgccctgtggggcaaggtgaacgtggatgaagttggtggtgaggccctgggcaggcaccggccgttctacccttaccggccgtggtcgactcggaccgatg

SEQ ID NO: 14755 - DNA, 203 bp, Homo sapiens
  source 1..203: mol_type = other DNA
ggcgcgccagtcctcgcaaagcctctgacacaactgtgttcactagcaacctcaaacagacaccatggtgcatctgactcctgaggaccggccgtccgttactgccctgtggggcaaggtgaacgtggatgaagttggtggtgaggccctgggcaggctgctggtggtctacccttggaccggcgggtcgactcggaccgatg

SEQ ID NO: 14756 - DNA, 203 bp, Homo sapiens
  source 1..203: mol_type = other DNA
ggcgcgccagtcctcgcttcatttctgacacaactgtgttcactagcaacctcaaacagacaccatggtgcatctgactcctgaggaccggcctcccgttactgaccggcctcgcaaggtgaaccggcctcaagttggtgaccggcctctgggcaggcaccggcctctctacccttggacccagaggtcgactcggaccgatg

SEQ ID NO: 14757 - DNA, 203 bp, Homo sapiens
  source 1..203: mol_type = other DNA
ggcgcgccagtcctcgctacacagctgacacaactgtgttcactagcaacctcaaacagacaccatggtgcatctgactcctgaggaccggcctgccgttactgaccggcctggcaaggtgaaccggcctgaagttggtgaccggcctgtgggcaggcaccggcctgtctacccttggacccagaggtcgactcggaccgatg

SEQ ID NO: 14758 - DNA, 203 bp, Homo sapiens
  source 1..203: mol_type = other DNA
ggcgcgccagtcctcgctgaaaggctgacacaactgtgttcactagcaacctcaaacagacaccatggtgcatctgactcctgaggaccggcgatccgttactgaccggcgatgcaaggtgaaccggcgataagttggtgaccggcgattgggcaggcaccggcgattctacccttggacccagaggtcgactcggaccgatg

SEQ ID NO: 14759 - DNA, 203 bp, Homo sapiens
  source 1..203: mol_type = other DNA
ggcgcgccagtcctcgcctagtccctgacacaactgtgttcactagcaacctcaaacagacaccatggtgcatctgactcctgaggaccggcgctccgttactgaccggcgctgcaaggtgaaccggcgctaagttggtgaccggcgcttgggcaggcaccggcgcttctacccttggacccagaggtcgactcggaccgatg

SEQ ID NO: 14760 - DNA, 203 bp, Homo sapiens
  source 1..203: mol_type = other DNA
ggcgcgccagtcctcgcagtaagtctgacacaactgtgttcactagcaacctcaaacagacaccatggtgcatctgactcctgaggaccggctatccgttactgaccggctatgcaaggtgaaccggctataagttggtgaccggctattgggcaggcaccggctattctacccttggacccagaggtcgactcggaccgatg

SEQ ID NO: 14761 - DNA, 203 bp, Homo sapiens
  source 1..203: mol_type = other DNA
ggcgcgccagtcctcgctttgagtctgacacaactgtgttcactagcaacctcaaacagacaccatggtgcatctgactcctgaggaccggctctccgttactgaccggctctgcaaggtgaaccggctctaagttggtgaccggctcttgggcaggcaccggctcttctacccttggacccagaggtcgactcggaccgatg

SEQ ID NO: 14762 - DNA, 203 bp, Homo sapiens
  source 1..203: mol_type = other DNA
ggcgcgccagtcctcgcactgaatctgacacaactgtgttcactagcaacctcaaacagacaccatggtgcatctgactcctgaggaccggctgtccgttactgaccggctgtgcaaggtgaaccggctgtaagttggtgaccggctgttgggcaggcaccggctgttctacccttggacccagaggtcgactcggaccgatg

SEQ ID NO: 14763 - DNA, 203 bp, Homo sapiens
  source 1..203: mol_type = other DNA
ggcgcgccagtcctcgctgacaaactgacacaactgtgttcactagcaacctcaaacagacaccatggtgcatctgactcctgaggaccggctttccgttactgaccggctttgcaaggtgaaccggctttaagttggtgaccggcttttgggcaggcaccggcttttctacccttggacccagaggtcgactcggaccgatg

SEQ ID NO: 14764 - DNA, 203 bp, Homo sapiens
  source 1..203: mol_type = other DNA
ggcgcgccagtcctcgctaccgttctgacacaactgtgttcactagcaacctcaaacagacaccatggtgcatctgactcctgaggaccgtccgtccgttactgaccgtccgtgcaaggtgaaccgtccgtaagttggtgaccgtccgttgggcaggcaccgtccgttctacccttggacccagaggtcgactcggaccgatg

SEQ ID NO: 14765 - DNA, 203 bp, Homo sapiens
  source 1..203: mol_type = other DNA
ggcgcgccagtcctgttagttcaactgacacaactgtgttcactagcaacctcaaacagacaccatggtgcatctgactcctgaggaccgttcgtccgttactgaccgttcgtgcaaggtgaaccgttcgtaagttggtgaccgttcgttgggcaggcaccgttcgttctacccttggacccagaggtcgactcggaccgatg

SEQ ID NO: 14766 - DNA, 203 bp, Homo sapiens
  source 1..203: mol_type = other DNA
ggcgcgccagtccttaacgaggcactgacacaactgtgttcactagcaacctcaaacagacaccatggtgcatctgactcctgaggacctccctgccgttactgacctcccgggcaaggtgaacctccctgaagttggtgacctccccctgggcaggcacctcccggtctacccttggacccagaggtcgactcggaccgatg

SEQ ID NO: 14767 - DNA, 203 bp, Homo sapiens
  source 1..203: mol_type = other DNA
ggcgcgccagtcctagcttcgttactgacacaactgtgttcactagcaacctcaaacagacaccatggtgcatctgactcctgaggaccttggcaaagttactgaccttggcaaaaaggtgaaccttggcaaagttggtgaccttggcaaaggcaggcaccttggcaaatacccttggacccagaggtcgactcggaccgatg

SEQ ID NO: 14768 - DNA, 203 bp, Homo sapiens
  source 1..203: mol_type = other DNA
ggcgcgccagtccttcgttagttcctgacacaactgtgttcactagcaacctcaaacagacaccatggtgcatctgactcctgaggacggcgggtccgttactgacggcgggtgcaaggtgaacggcgggtaagttggtgacggcgggttgggcaggcacggcgggttctacccttggacccagaggtcgactcggaccgatg

SEQ ID NO: 14769 - DNA, 203 bp, Homo sapiens
  source 1..203: mol_type = other DNA
ggcgcgccagtcctgtttaacgatctgacacaactgtgttcactagcaacctcaaacagacaccatggtgcatctgactcctgaggacgggccgtccgttactgacgggccgtgcaaggtgaacgggccgtaagttggtgacgggccgttgggcaggcacgggccgttctacccttggacccagaggtcgactcggaccgatg

SEQ ID NO: 14770 - DNA, 203 bp, Homo sapiens
  source 1..203: mol_type = other DNA
ggcgcgccagtcctcttctcgttactgacacaactgtgttcactagcaacctcaaacagacaccatggtgcatctgactcctgaggactagccgtccgttactgactagccgtgcaaggtgaactagccgtaagttggtgactagccgttgggcaggcactagccgttctacccttggacccagaggtcgactcggaccgatg

SEQ ID NO: 14771 - DNA, 203 bp, Homo sapiens
  source 1..203: mol_type = other DNA
ggcgcgccagtcctgttcgttacgctgacacaactgtgttcactagcaacctcaaacagacaccatggtgcatctgactcctgaggactcgccgtccgttactgactcgccgtgcaaggtgaactcgccgtaagttggtgactcgccgttgggcaggcactcgccgttctacccttggacccagaggtcgactcggaccgatg

SEQ ID NO: 14772 - DNA, 203 bp, Homo sapiens
  source 1..203: mol_type = other DNA
ggcgcgccagtccttaacgagtggctgacacaactgtgttcactagcaacctcaaacagacaccatggtgcatctgactcctgaggactttaagtttcagctttgcaaccatactccccccggaacccaaagactttggtttgaggccctgggcaggctgctggtggtctacccttggacccagaggtcgactcggaccgatg

SEQ ID NO: 14773 - DNA, 203 bp, Homo sapiens
  source 1..203: mol_type = other DNA
ggcgcgccagtcctaaatgcagaactgacacaactgtgttcactagcaacctcaaacagacaccatggtgcatctgactcctgaggagaacgtcaattcctttaccctgtggggcaaggtgaacgtggatgaagttggtggtgaggccctgggcaggctgctggtggtctaccccacggaatcgagaacgactcggaccgatg

SEQ ID NO: 14774 - DNA, 203 bp, Homo sapiens
  source 1..203: mol_type = other DNA
ggcgcgccagtcctaatgcgtttgctgacacaactgtgttcactagcaacctcaaacagacaccatggtgcatctgactcctgaggagaacgtcaattcctttaccctgtggggcaaggtgaacgtggatgaagttggtggtgaggccctgggcaggctgctggtggtctaccccgtcaattcctttacgactcggaccgatg

SEQ ID NO: 14775 - DNA, 203 bp, Homo sapiens
  source 1..203: mol_type = other DNA
ggcgcgccagtcctcgacctagtcctgacacaactgtgttcactagcaacctcaaacagacaccatggtgcatctgactcctgaggagaagaccggccgtactgccctgtggggcaaggtgaacgtggatgaagttggtggtgaggccctgggcaggctgctggtggtctacccttgttcttggcaaacgactcggaccgatg

SEQ ID NO: 14776 - DNA, 203 bp, Homo sapiens
  source 1..203: mol_type = other DNA
ggcgcgccagtcctagacctagcactgacacaactgtgttcactagcaacctcaaacagacaccatggtgcatctgactcctgaggagaagccattcgcagtttcactgtaccggccgtgcgtactcagacatgcatggggtgaggccctgggcaggctgctggtggtctacccttggacccagaggtcgactcggaccgatg

SEQ ID NO: 14777 - DNA, 203 bp, Homo sapiens
  source 1..203: mol_type = other DNA
ggcgcgccagtccttgattttcagctgacacaactgtgttcactagcaacctcaaacagacaccatggtgcatctgactcctgaggagaagcctggtggtgcccttccgtcaattcctttaagtttcagctttgcaagtggtgaggccctgggcaggctgctggtggtctacccttggacccagaggtcgactcggaccgatg

SEQ ID NO: 14778 - DNA, 203 bp, Homo sapiens
  source 1..203: mol_type = other DNA
ggcgcgccagtccttatgattttcctgacacaactgtgttcactagcaacctcaaacagacaccatggtgcatctgactcctgaggagaaggccatgcaccaccacccacggaatcgagaaagagctatcaatctgtctggtgaggccctgggcaggctgctggtggtctacccttggacccagaggtcgactcggaccgatg

SEQ ID NO: 14779 - DNA, 203 bp, Homo sapiens
  source 1..203: mol_type = other DNA
ggcgcgccagtcctcacgttaacactgacacaactgtgttcactagcaacctcaaacagacaccatggtgcatctgactcctgaggagaaggccatgcaccaccacccacggaatcgagaaagagctatcaatctgtgtggtgaggccctgggcaggctgctggtggtctacccttggacccagaggtcgactcggaccgatg

SEQ ID NO: 14780 - DNA, 203 bp, Homo sapiens
  source 1..203: mol_type = other DNA
ggcgcgccagtcctcacgtttgccctgacacaactgtgttcactagcaacctcaaacagacaccatggtgcatctgactcctgaggagaagtcaccggccgttgccctgtggggcaaggtgaacgtggatgaagttggtggtgaggccctgggcaggctgctggtggtctacccttggaaccggccgtcgactcggaccgatg

SEQ ID NO: 14781 - DNA, 203 bp, Homo sapiens
  source 1..203: mol_type = other DNA
ggcgcgccagtcctacaaatgccactgacacaactgtgttcactagcaacctcaaacagacaccatggtgcatctgactcctgaggagaagtcattcgcagtttcactgtaccggccgtgcgtactcagacatgcaggtggtgaggccctgggcaggctgctggtggtctacccttggacccagaggtcgactcggaccgatg

SEQ ID NO: 14782 - DNA, 203 bp, Homo sapiens
  source 1..203: mol_type = other DNA
ggcgcgccagtcctaacatgcaagctgacacaactgtgttcactagcaacctcaaacagacaccatggtgcatctgactcctgaggagaagtccacggaatcgagaatgtggggcaaggtgaacgtggatgaagttggtggtgaggccctgggcaggctgctggtggtctacccttgttcttggcaaacgactcggaccgatg

SEQ ID NO: 14783 - DNA, 203 bp, Homo sapiens
  source 1..203: mol_type = other DNA
ggcgcgccagtcctcgacatgcagctgacacaactgtgttcactagcaacctcaaacagacaccatggtgcatctgactcctgaggagaagtccatgcaccaccacccacggaatcgagaaagagctatcaatctgggtggtgaggccctgggcaggctgctggtggtctacccttggacccagaggtcgactcggaccgatg

SEQ ID NO: 14784 - DNA, 203 bp, Homo sapiens
  source 1..203: mol_type = other DNA
ggcgcgccagtcctaacaccacgtctgacacaactgtgttcactagcaacctcaaacagacaccatggtgcatctgactcctgaggagaagtccgtcaattcctttatgtggggcaaggtgaacgtggatgaagttggtggtgaggccctgggcaggctgctggtggtctacccttgttcttggcaaacgactcggaccgatg

SEQ ID NO: 14785 - DNA, 203 bp, Homo sapiens
  source 1..203: mol_type = other DNA
ggcgcgccagtcctttgcacgttcctgacacaactgtgttcactagcaacctcaaacagacaccatggtgcatctgactcctgaggagaagtctactcccactgccctgtggggcaaggtgaacgtggatgaagttggtggtgaggccctgggcaggctgctggtggtctacccttgttcttggcaaacgactcggaccgatg

SEQ ID NO: 14786 - DNA, 203 bp, Homo sapiens
  source 1..203: mol_type = other DNA
ggcgcgccagtcctaacgtgcattctgacacaactgtgttcactagcaacctcaaacagacaccatggtgcatctgactcctgaggagaagtctgaccggccgtccctgtggggcaaggtgaacgtggatgaagttggtggtgaggccctgggcaggctgctggtggtctaccccacggaatcgagaacgactcggaccgatg

SEQ ID NO: 14787 - DNA, 203 bp, Homo sapiens
  source 1..203: mol_type = other DNA
ggcgcgccagtccttgtctaacgcctgacacaactgtgttcactagcaacctcaaacagacaccatggtgcatctgactcctgaggagaagtctgcattaatgaaaacattcttggcaaatgctttcgctctagttggtggtgaggccctgggcaggctgctggtggtctacccttggacccagaggtcgactcggaccgatg

SEQ ID NO: 14788 - DNA, 203 bp, Homo sapiens
  source 1..203: mol_type = other DNA
ggcgcgccagtcctacggttaaacctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctaccccacggaatcgagaacgactcggaccgatg

SEQ ID NO: 14789 - DNA, 203 bp, Homo sapiens
  source 1..203: mol_type = other DNA
ggcgcgccagtcctcaggctttagctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctaccccgtcaattcctttacgactcggaccgatg

SEQ ID NO: 14790 - DNA, 203 bp, Homo sapiens
  source 1..203: mol_type = other DNA
ggcgcgccagtcctacgtaaagccctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctacccttggacccagaggtcgactcggaccgatg

SEQ ID NO: 14791 - DNA, 203 bp, Homo sapiens
  source 1..203: mol_type = other DNA
ggcgcgccagtcctaacgcagctgctgacacaactgtgttcactagcaacctcaaacagacaccatggtgcatctgactcctgaggagaagtctgcccgtcaattcctttagggcaaggtgaacgtggatgaagttggtggtgaggccctgggcaggctgctggtggtctacccttggacctactccccgactcggaccgatg

SEQ ID NO: 14792 - DNA, 203 bp, Homo sapiens
  source 1..203: mol_type = other DNA
ggcgcgccagtcctcgtcctgcgtctgacacaactgtgttcactagcaacctcaaacagacaccatggtgcatctgactcctgaggagaagtctgccgaccaccacccacggaatcgagaaagagctatcgaagttggtggtgaggccctgggcaggctgctggtggtctacccttggacccagaggtcgactcggaccgatg

SEQ ID NO: 14793 - DNA, 203 bp, Homo sapiens
  source 1..203: mol_type = other DNA
ggcgcgccagtccttgacatactcctgacacaactgtgttcactagcaacctcaaacagacaccatggtgcatctgactcctgaggagaagtctgccgagctttgcaaccatactccccccggaacccaagaagttggtggtgaggccctgggcaggctgctggtggtctacccttggacccagaggtcgactcggaccgatg

SEQ ID NO: 14794 - DNA, 203 bp, Homo sapiens
  source 1..203: mol_type = other DNA
ggcgcgccagtccttagaggctagctgacacaactgtgttcactagcaacctcaaacagacaccatggtgcatctgactcctgaggagaagtctgccgcccggaagctgcccggcgggtcatgggaataagaagttggtggtgaggccctgggcaggctgctggtggtctacccttggacccagaggtcgactcggaccgatg

SEQ ID NO: 14795 - DNA, 203 bp, Homo sapiens
  source 1..203: mol_type = other DNA
ggcgcgccagtcctgaccagtacactgacacaactgtgttcactagcaacctcaaacagacaccatggtgcatctgactcctgaggagaagtctgccgccggcgggttgtggggcaaggtgaacgtggatgaagttggtggtgaggccctgggcaggctgctggtggtctacccttgttcttggcaaacgactcggaccgatg

SEQ ID NO: 14796 - DNA, 203 bp, Homo sapiens
  source 1..203: mol_type = other DNA
ggcgcgccagtcctattttgcagcctgacacaactgtgttcactagcaacctcaaacagacaccatggtgcatctgactcctgaggagaagtctgccggtgcccttccgtcaattcctttaagtttcagctaagttggtggtgaggccctgggcaggctgctggtggtctacccttggacccagaggtcgactcggaccgatg

SEQ ID NO: 14797 - DNA, 203 bp, Homo sapiens
  source 1..203: mol_type = other DNA
ggcgcgccagtcctttaagcgtatctgacacaactgtgttcactagcaacctcaaacagacaccatggtgcatctgactcctgaggagaagtctgccgtagtttcactgtaccggccgtgcgtactcagtgaagttggtggtgaggccctgggcaggctgctggtggtctacccttggacccagaggtcgactcggaccgatg

SEQ ID NO: 14798 - DNA, 203 bp, Homo sapiens
  source 1..203: mol_type = other DNA
ggcgcgccagtcctgcctgtgacactgacacaactgtgttcactagcaacctcaaacagacaccatggtgcatctgactcctgaggagaagtctgccgttacaccggccgtgggcaaggtgaacgtggatgaagttggtggtgaggccctgggcaggctgctggtggtctacccttggacctactccccgactcggaccgatg

SEQ ID NO: 14799 - DNA, 203 bp, Homo sapiens
  source 1..203: mol_type = other DNA
ggcgcgccagtcctaatgtcacatctgacacaactgtgttcactagcaacctcaaacagacaccatggtgcatctgactcctgaggagaagtctgccgttacccggcgggtgggcaaggtgaacgtggatgaagttggtggtgaggccctgggcaggctgctggtggtctaccccacggaatcgagaacgactcggaccgatg

SEQ ID NO: 14800 - DNA, 203 bp, Homo sapiens
  source 1..203: mol_type = other DNA
ggcgcgccagtcctcacacaggtcctgacacaactgtgttcactagcaacctcaaacagacaccatggtgcatctgactcctgaggagaagtctgccgttacccggcgggtgggcaaggtgaacgtggatgaagttggtggtgaggccctgggcaggctgctggtggtctacccttggacctactccccgactcggaccgatg

SEQ ID NO: 14801 - DNA, 203 bp, Homo sapiens
  source 1..203: mol_type = other DNA
ggcgcgccagtcctccacacagctctgacacaactgtgttcactagcaacctcaaacagacaccatggtgcatctgactcctgaggagaagtctgccgttacccttccgtcaattcctttaagtttcgatgaagttggtggtgaggccctgggcaggctgctggtggtctacccttggacccagaggtcgactcggaccgatg

SEQ ID NO: 14802 - DNA, 203 bp, Homo sapiens
  source 1..203: mol_type = other DNA
ggcgcgccagtcctaccttgtgtgctgacacaactgtgttcactagcaacctcaaacagacaccatggtgcatctgactcctgaggagaagtctgccgttaccggccgttggggcaaggtgaacgtggatgaagttggtggtgaggccctgggcaggctgctggtggtctacccttggaaccggccgtcgactcggaccgatg

SEQ ID NO: 14803 - DNA, 203 bp, Homo sapiens
  source 1..203: mol_type = other DNA
ggcgcgccagtcctactgtgtgacctgacacaactgtgttcactagcaacctcaaacagacaccatggtgcatctgactcctgaggagaagtctgccgttaccgtcaattcctttaaggtgaacgtggatgaagttggtggtgaggccctgggcaggctgctggtggtctacccttggaaccggccgtcgactcggaccgatg

SEQ ID NO: 14804 - DNA, 203 bp, Homo sapiens
  source 1..203: mol_type = other DNA
ggcgcgccagtccttatgtgtgatctgacacaactgtgttcactagcaacctcaaacagacaccatggtgcatctgactcctgaggagaagtctgccgttaccgtcaattcctttaaggtgaacgtggatgaagttggtggtgaggccctgggcaggctgctggtggtctacccttggaccggcgggtcgactcggaccgatg

SEQ ID NO: 14805 - DNA, 203 bp, Homo sapiens
  source 1..203: mol_type = other DNA
ggcgcgccagtcctcagacgtacactgacacaactgtgttcactagcaacctcaaacagacaccatggtgcatctgactcctgaggagaagtctgccgttactactccctggggcaaggtgaacgtggatgaagttggtggtgaggccctgggcaggctgctggtggtctacccttggaaccggccgtcgactcggaccgatg

SEQ ID NO: 14806 - DNA, 203 bp, Homo sapiens
  source 1..203: mol_type = other DNA
ggcgcgccagtcctagtagacgtactgacacaactgtgttcactagcaacctcaaacagacaccatggtgcatctgactcctgaggagaagtctgccgttactcacccacggaatcgagaaagagtggatgaagttggtggtgaggccctgggcaggctgctggtggtctacccttggacccagaggtcgactcggaccgatg

SEQ ID NO: 14807 - DNA, 203 bp, Homo sapiens
  source 1..203: mol_type = other DNA
ggcgcgccagtcctacgtctacgtctgacacaactgtgttcactagcaacctcaaacagacaccatggtgcatctgactcctgaggagaagtctgccgttactcttccgtcaattcctttaagtttggatgaagttggtggtgaggccctgggcaggctgctggtggtctacccttggacccagaggtcgactcggaccgatg

SEQ ID NO: 14808 - DNA, 203 bp, Homo sapiens
  source 1..203: mol_type = other DNA
ggcgcgccagtcctcgctacgtctctgacacaactgtgttcactagcaacctcaaacagacaccatggtgcatctgactcctgaggagaagtctgccgttactgaccggccgtgcaaggtgaaccggccgtaagttggtgaccggccgttgggcaggcaccggccgttctacccttaccggccgtggtcgactcggaccgatg

SEQ ID NO: 14809 - DNA, 203 bp, Homo sapiens
  source 1..203: mol_type = other DNA
ggcgcgccagtccttcacagacgtctgacacaactgtgttcactagcaacctcaaacagacaccatggtgcatctgactcctgaggagaagtctgccgttactgaccggccgtgcaaggtgaaccggccgtaagttggtgaccggccgttgggcaggcaccggccgttctacccttggacccagaggtcgactcggaccgatg

SEQ ID NO: 14810 - DNA, 203 bp, Homo sapiens
  source 1..203: mol_type = other DNA
ggcgcgccagtcctctaagacgtactgacacaactgtgttcactagcaacctcaaacagacaccatggtgcatctgactcctgaggagaagtctgccgttactgaccggccgtgcaaggtgaaccggccgtaagttggtgaccggccgttgggcaggctgctggtggtctacccttaccggccgtggtcgactcggaccgatg

SEQ ID NO: 14811 - DNA, 203 bp, Homo sapiens
  source 1..203: mol_type = other DNA
ggcgcgccagtcctagacgttgttctgacacaactgtgttcactagcaacctcaaacagacaccatggtgcatctgactcctgaggagaagtctgccgttactgaccggccgtgcaaggtgaaccggccgtaagttggtgaccggccgttgggcaggctgctggtggtctacccttggacccagaggtcgactcggaccgatg

SEQ ID NO: 14812 - DNA, 203 bp, Homo sapiens
  source 1..203: mol_type = other DNA
ggcgcgccagtcctaagagacgttctgacacaactgtgttcactagcaacctcaaacagacaccatggtgcatctgactcctgaggagaagtctgccgttactgaccggccgtgcaaggtgaaccggccgtaagttggtggtgaggccctgggcaggcaccggccgttctacccttaccggccgtggtcgactcggaccgatg

SEQ ID NO: 14813 - DNA, 203 bp, Homo sapiens
  source 1..203: mol_type = other DNA
ggcgcgccagtccttgaacgtcttctgacacaactgtgttcactagcaacctcaaacagacaccatggtgcatctgactcctgaggagaagtctgccgttactgaccggccgtgcaaggtgaaccggccgtaagttggtggtgaggccctgggcaggcaccggccgttctacccttggacccagaggtcgactcggaccgatg

SEQ ID NO: 14814 - DNA, 203 bp, Homo sapiens
  source 1..203: mol_type = other DNA
ggcgcgccagtcctaacgtctggactgacacaactgtgttcactagcaacctcaaacagacaccatggtgcatctgactcctgaggagaagtctgccgttactgaccggccgtgcaaggtgaaccggccgtaagttggtggtgaggccctgggcaggctgctggtggtctacccttggacccagaggtcgactcggaccgatg

SEQ ID NO: 14815 - DNA, 203 bp, Homo sapiens
  source 1..203: mol_type = other DNA
ggcgcgccagtcctgacacagtccctgacacaactgtgttcactagcaacctcaaacagacaccatggtgcatctgactcctgaggagaagtctgccgttactgaccggccgtgcaaggtgaacgtggatgaagttggtgaccggccgttgggcaggcaccggccgttctacccttaccggccgtggtcgactcggaccgatg

SEQ ID NO: 14816 - DNA, 203 bp, Homo sapiens
  source 1..203: mol_type = other DNA
ggcgcgccagtcctagttttgaaactgacacaactgtgttcactagcaacctcaaacagacaccatggtgcatctgactcctgaggagaagtctgccgttactgaccggccgtgcaaggtgaacgtggatgaagttggtgaccggccgttgggcaggcaccggccgttctacccttggacccagaggtcgactcggaccgatg

SEQ ID NO: 14817 - DNA, 203 bp, Homo sapiens
  source 1..203: mol_type = other DNA
ggcgcgccagtcctttgaagcgacctgacacaactgtgttcactagcaacctcaaacagacaccatggtgcatctgactcctgaggagaagtctgccgttactgaccggccgtgcaaggtgaacgtggatgaagttggtggtgaggccctgggcaggcaccggccgttctacccttggacccagaggtcgactcggaccgatg

SEQ ID NO: 14818 - DNA, 203 bp, Homo sapiens
  source 1..203: mol_type = other DNA
ggcgcgccagtcctactgtcgccactgacacaactgtgttcactagcaacctcaaacagacaccatggtgcatctgactcctgaggagaagtctgccgttactgacggccggtgcaaggtgaacggccggtaagttggtgacggccggttgggcaggcacggccggttctacccttggacccagaggtcgactcggaccgatg

SEQ ID NO: 14819 - DNA, 203 bp, Homo sapiens
  source 1..203: mol_type = other DNA
ggcgcgccagtcctgcgacttggtctgacacaactgtgttcactagcaacctcaaacagacaccatggtgcatctgactcctgaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 14820 - DNA, 203 bp, Homo sapiens
  source 1..203: mol_type = other DNA
ggcgcgccagtcctagagtcgcctctgacacaactgtgttcactagcaacctcaaacagacaccatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 14821 - DNA, 203 bp, Homo sapiens
  source 1..203: mol_type = other DNA
ggcgcgccagtccttaagtcgctactgacacaactgtgttcactagcaacctcaaacagacaccatggtgcatctgactcctgaggagaagtctgccgttactgcacggaatcgagaagtgacacggaatcgagaaggtgcacggaatcgagaaaggccacggaatcgagaaccttggacccagaggtcgactcggaccgatg

SEQ ID NO: 14822 - DNA, 203 bp, Homo sapiens
  source 1..203: mol_type = other DNA
ggcgcgccagtcctaaggcgactactgacacaactgtgttcactagcaacctcaaacagacaccatggtgcatctgactcctgaggagaagtctgccgttactgcacggaatcgagaagtgacacggaatcgagaaggtggtgaggccctgggcaggctgctggtggtctacccttggacccagaggtcgactcggaccgatg

SEQ ID NO: 14823 - DNA, 203 bp, Homo sapiens
  source 1..203: mol_type = other DNA
ggcgcgccagtcctatgaagtcgcctgacacaactgtgttcactagcaacctcaaacagacaccatggtgcatctgactcctgaggagaagtctgccgttactgcactgtaccggccgtgcgtcgtggatgaagttggtggtgaggccctgggcaggctgctggtggtctacccttggacccagaggtcgactcggaccgatg

SEQ ID NO: 14824 - DNA, 203 bp, Homo sapiens
  source 1..203: mol_type = other DNA
ggcgcgccagtcctcgagcgacagctgacacaactgtgttcactagcaacctcaaacagacaccatggtgcatctgactcctgaggagaagtctgccgttactgccccacggaatcgagaaaacgtggatgaagttggtggtgaggccctgggcaggctgctggtggtctacccttgttcttggcaaacgactcggaccgatg

SEQ ID NO: 14825 - DNA, 203 bp, Homo sapiens
  source 1..203: mol_type = other DNA
ggcgcgccagtccttgaatgtcgcctgacacaactgtgttcactagcaacctcaaacagacaccatggtgcatctgactcctgaggagaagtctgccgttactgccccattcttggcaaataacgtggatgaagttggtggtgaggccctgggcaggctgctggtggtctacccttggacccagaggtcgactcggaccgatg

SEQ ID NO: 14826 - DNA, 203 bp, Homo sapiens
  source 1..203: mol_type = other DNA
ggcgcgccagtcctggcgaccatactgacacaactgtgttcactagcaacctcaaacagacaccatggtgcatctgactcctgaggagaagtctgccgttactgccccgtcaattcctttaaacgtggatgaagttggtggtgaggccctgggcaggctgctggtggtctacccttgttcttggcaaacgactcggaccgatg

SEQ ID NO: 14827 - DNA, 203 bp, Homo sapiens
  source 1..203: mol_type = other DNA
ggcgcgccagtcctgtgtcgctcactgacacaactgtgttcactagcaacctcaaacagacaccatggtgcatctgactcctgaggagaagtctgccgttactgccctgaccggccgtgtgaacgtggatgaagttggtggtgaggccctgggcaggctgctggtggtctaccccacggaatcgagaacgactcggaccgatg

SEQ ID NO: 14828 - DNA, 203 bp, Homo sapiens
  source 1..203: mol_type = other DNA
ggcgcgccagtcctaggcgaccacctgacacaactgtgttcactagcaacctcaaacagacaccatggtgcatctgactcctgaggagaagtctgccgttactgccctgaccggccgtgtgaacgtggatgaagttggtggtgaggccctgggcaggctgctggtggtctaccccgtcaattcctttacgactcggaccgatg

SEQ ID NO: 14829 - DNA, 203 bp, Homo sapiens
  source 1..203: mol_type = other DNA
ggcgcgccagtcctatcgaccaccctgacacaactgtgttcactagcaacctcaaacagacaccatggtgcatctgactcctgaggagaagtctgccgttactgccctgcatactcccctgaacgtggatgaagttggtggtgaggccctgggcaggctgctggtggtctacccttggacccagaggtcgactcggaccgatg

SEQ ID NO: 14830 - DNA, 203 bp, Homo sapiens
  source 1..203: mol_type = other DNA
ggcgcgccagtcctaagtggtcgactgacacaactgtgttcactagcaacctcaaacagacaccatggtgcatctgactcctgaggagaagtctgccgttactgccctgcccggcgggtcatacgtggatgaagttggtggtgaggccctgggcaggctgctggtggtctacccttggacccagaggtcgactcggaccgatg

SEQ ID NO: 14831 - DNA, 203 bp, Homo sapiens
  source 1..203: mol_type = other DNA
ggcgcgccagtcctggtcgactaactgacacaactgtgttcactagcaacctcaaacagacaccatggtgcatctgactcctgaggagaagtctgccgttactgccctgcccggcgggtcgaacgtggatgaagttggtggtgaggccctgggcaggctgctggtggtctacccttggacccagaggtcgactcggaccgatg

SEQ ID NO: 14832 - DNA, 203 bp, Homo sapiens
  source 1..203: mol_type = other DNA
ggcgcgccagtcctctggtcgatcctgacacaactgtgttcactagcaacctcaaacagacaccatggtgcatctgactcctgaggagaagtctgccgttactgccctgcccggcgggttgaacgtggatgaagttggtggtgaggccctgggcaggctgctggtggtctacccttggacccagaggtcgactcggaccgatg

SEQ ID NO: 14833 - DNA, 203 bp, Homo sapiens
  source 1..203: mol_type = other DNA
ggcgcgccagtccttcacctagagctgacacaactgtgttcactagcaacctcaaacagacaccatggtgcatctgactcctgaggagaagtctgccgttactgccctgcggaatcgagtgaacgtggatgaagttggtggtgaggccctgggcaggctgctggtggtctacccttggacccagaggtcgactcggaccgatg

SEQ ID NO: 14834 - DNA, 203 bp, Homo sapiens
  source 1..203: mol_type = other DNA
ggcgcgccagtcctaactagaaaactgacacaactgtgttcactagcaacctcaaacagacaccatggtgcatctgactcctgaggagaagtctgccgttactgccctgcgtcaattcctttacgtggatgaagttggtggtgaggccctgggcaggctgctggtggtctacccttggaccggcgggtcgactcggaccgatg

SEQ ID NO: 14835 - DNA, 203 bp, Homo sapiens
  source 1..203: mol_type = other DNA
ggcgcgccagtcctgtactagaatctgacacaactgtgttcactagcaacctcaaacagacaccatggtgcatctgactcctgaggagaagtctgccgttactgccctgtaccggccgtgcgacgtggatgaagttggtggtgaggccctgggcaggctgctggtggtctacccttggacccagaggtcgactcggaccgatg

SEQ ID NO: 14836 - DNA, 203 bp, Homo sapiens
  source 1..203: mol_type = other DNA
ggcgcgccagtcctagcgactagactgacacaactgtgttcactagcaacctcaaacagacaccatggtgcatctgactcctgaggagaagtctgccgttactgccctgtactcccaggtgaacgtggatgaagttggtggtgaggccctgggcaggctgctggtggtctacccttggaaccggccgtcgactcggaccgatg

SEQ ID NO: 14837 - DNA, 203 bp, Homo sapiens
  source 1..203: mol_type = other DNA
ggcgcgccagtccttacttctagtctgacacaactgtgttcactagcaacctcaaacagacaccatggtgcatctgactcctgaggagaagtctgccgttactgccctgtgcgtcaattcctttatggatgaagttggtggtgaggccctgggcaggctgctggtggtctaccccgtcaattcctttacgactcggaccgatg

SEQ ID NO: 14838 - DNA, 203 bp, Homo sapiens
  source 1..203: mol_type = other DNA
ggcgcgccagtccttactctaggcctgacacaactgtgttcactagcaacctcaaacagacaccatggtgcatctgactcctgaggagaagtctgccgttactgccctgtgcgtcaattcctttatggatgaagttggtggtgaggccctgggcaggctgctggtggtctacccttggacccagaggtcgactcggaccgatg

SEQ ID NO: 14839 - DNA, 203 bp, Homo sapiens
  source 1..203: mol_type = other DNA
ggcgcgccagtccttctagttacgctgacacaactgtgttcactagcaacctcaaacagacaccatggtgcatctgactcctgaggagaagtctgccgttactgccctgtgcttggcggtgaacgtggatgaagttggtggtgaggccctgggcaggctgctggtggtctacccttggacccagaggtcgactcggaccgatg

SEQ ID NO: 14840 - DNA, 203 bp, Homo sapiens
  source 1..203: mol_type = other DNA
ggcgcgccagtccttctaggtcaactgacacaactgtgttcactagcaacctcaaacagacaccatggtgcatctgactcctgaggagaagtctgccgttactgccctgtggaccggccgtaacgtggatgaagttggtggtgaggccctgggcaggctgctggtggtctacccttgttcttggcaaacgactcggaccgatg

SEQ ID NO: 14841 - DNA, 203 bp, Homo sapiens
  source 1..203: mol_type = other DNA
ggcgcgccagtccttcaggtgagtctgacacaactgtgttcactagcaacctcaaacagacaccatggtgcatctgactcctgaggagaagtctgccgttactgccctgtggggaccggccgtcgtggatgaagttggtggtgaggccctgggcaggctgctggtggtctacccttggaccggcgggtcgactcggaccgatg

SEQ ID NO: 14842 - DNA, 203 bp, Homo sapiens
  source 1..203: mol_type = other DNA
ggcgcgccagtcctatcaggtctactgacacaactgtgttcactagcaacctcaaacagacaccatggtgcatctgactcctgaggagaagtctgccgttactgccctgtggggcaaccggccgttggatgaagttggtggtgaggccctgggcaggctgctggtggtctaccccgtcaattcctttacgactcggaccgatg

SEQ ID NO: 14843 - DNA, 203 bp, Homo sapiens
  source 1..203: mol_type = other DNA
ggcgcgccagtcctaaacctgatcctgacacaactgtgttcactagcaacctcaaacagacaccatggtgcatctgactcctgaggagaagtctgccgttactgccctgtggggcaaccggccgttggatgaagttggtggtgaggccctgggcaggctgctggtggtctacccttggacccagaggtcgactcggaccgatg

SEQ ID NO: 14844 - DNA, 203 bp, Homo sapiens
  source 1..203: mol_type = other DNA
ggcgcgccagtcctacctgaagaactgacacaactgtgttcactagcaacctcaaacagacaccatggtgcatctgactcctgaggagaagtctgccgttactgccctgtggggcaaccggccgttggatgaagttggtggtgaggccctgggcaggctgctggtggtctacccttggacctactccccgactcggaccgatg

SEQ ID NO: 14845 - DNA, 203 bp, Homo sapiens
  source 1..203: mol_type = other DNA
ggcgcgccagtcctggtagaacgtctgacacaactgtgttcactagcaacctcaaacagacaccatggtgcatctgactcctgaggagaagtctgccgttactgccctgtggggcaaggaccggccgtatgaagttggtggtgaggccctgggcaggctgctggtggtctacccttgttcttggcaaacgactcggaccgatg

SEQ ID NO: 14846 - DNA, 203 bp, Homo sapiens
  source 1..203: mol_type = other DNA
ggcgcgccagtcctcgttctagcactgacacaactgtgttcactagcaacctcaaacagacaccatggtgcatctgactcctgaggagaagtctgccgttactgccctgtggggcaaggccggcgggtatgaagttggtggtgaggccctgggcaggctgctggtggtctacccttgttcttggcaaacgactcggaccgatg

SEQ ID NO: 14847 - DNA, 203 bp, Homo sapiens
  source 1..203: mol_type = other DNA
ggcgcgccagtccttaaagcgttcctgacacaactgtgttcactagcaacctcaaacagacaccatggtgcatctgactcctgaggagaagtctgccgttactgccctgtggggcaaggtgaaaccggccgtagttggtggtgaggccctgggcaggctgctggtggtctaccccacggaatcgagaacgactcggaccgatg

SEQ ID NO: 14848 - DNA, 203 bp, Homo sapiens
  source 1..203: mol_type = other DNA
ggcgcgccagtcctactgcagaacctgacacaactgtgttcactagcaacctcaaacagacaccatggtgcatctgactcctgaggagaagtctgccgttactgccctgtggggcaaggtgaacacggaatcgagaagtggtgaggccctgggcaggctgctggtggtctacccttggaaccggccgtcgactcggaccgatg

SEQ ID NO: 14849 - DNA, 203 bp, Homo sapiens
  source 1..203: mol_type = other DNA
ggcgcgccagtcctcccgaccgtgctgacacaactgtgttcactagcaacctcaaacagacaccatggtgcatctgactcctgaggagaagtctgccgttactgccctgtggggcaaggtgaaccggccgtaagttggtgaccggccgttgggcaggctgctggtggtctacccttaccggccgtggtcgactcggaccgatg

SEQ ID NO: 14850 - DNA, 203 bp, Homo sapiens
  source 1..203: mol_type = other DNA
ggcgcgccagtccttcgtctcgggctgacacaactgtgttcactagcaacctcaaacagacaccatggtgcatctgactcctgaggagaagtctgccgttactgccctgtggggcaaggtgaaccggccgtaagttggtgaccggccgttgggcaggctgctggtggtctacccttggacccagaggtcgactcggaccgatg

SEQ ID NO: 14851 - DNA, 203 bp, Homo sapiens
  source 1..203: mol_type = other DNA
ggcgcgccagtcctcccgaggtgactgacacaactgtgttcactagcaacctcaaacagacaccatggtgcatctgactcctgaggagaagtctgccgttactgccctgtggggcaaggtgaaccggccgtaagttggtggtgaggccctgggcaggcaccggccgttctacccttggacccagaggtcgactcggaccgatg

SEQ ID NO: 14852 - DNA, 203 bp, Homo sapiens
  source 1..203: mol_type = other DNA
ggcgcgccagtcctcccgattcgtctgacacaactgtgttcactagcaacctcaaacagacaccatggtgcatctgactcctgaggagaagtctgccgttactgccctgtggggcaaggtgaaccggccgtaagttggtggtgaggccctgggcaggctgctggtggtctacccttaccggccgtggtcgactcggaccgatg

SEQ ID NO: 14853 - DNA, 203 bp, Homo sapiens
  source 1..203: mol_type = other DNA
ggcgcgccagtccttagtcatttcctgacacaactgtgttcactagcaacctcaaacagacaccatggtgcatctgactcctgaggagaagtctgccgttactgccctgtggggcaaggtgaaccggcgggtagttggtggtgaggccctgggcaggctgctggtggtctacccttggacccagaggtcgactcggaccgatg

SEQ ID NO: 14854 - DNA, 203 bp, Homo sapiens
  source 1..203: mol_type = other DNA
ggcgcgccagtcctaatgttgactctgacacaactgtgttcactagcaacctcaaacagacaccatggtgcatctgactcctgaggagaagtctgccgttactgccctgtggggcaaggtgaaccggcgggtagttggtggtgaggccctgggcaggctgctggtggtctacccttggacctactccccgactcggaccgatg

SEQ ID NO: 14855 - DNA, 203 bp, Homo sapiens
  source 1..203: mol_type = other DNA
ggcgcgccagtcctgtgagttaagctgacacaactgtgttcactagcaacctcaaacagacaccatggtgcatctgactcctgaggagaagtctgccgttactgccctgtggggcaaggtgaacgcacggaatcgagaaggtgaggccctgggcaggctgctggtggtctacccttggacctactccccgactcggaccgatg

SEQ ID NO: 14856 - DNA, 203 bp, Homo sapiens
  source 1..203: mol_type = other DNA
ggcgcgccagtcctctctgtcacgctgacacaactgtgttcactagcaacctcaaacagacaccatggtgcatctgactcctgaggagaagtctgccgttactgccctgtggggcaaggtgaacgcgtcaattcctttaggtgaggccctgggcaggctgctggtggtctaccccacggaatcgagaacgactcggaccgatg

SEQ ID NO: 14857 - DNA, 203 bp, Homo sapiens
  source 1..203: mol_type = other DNA
ggcgcgccagtcctagagtgacccctgacacaactgtgttcactagcaacctcaaacagacaccatggtgcatctgactcctgaggagaagtctgccgttactgccctgtggggcaaggtgaacgtaccggccgttggtggtgaggccctgggcaggctgctggtggtctacccttgttcttggcaaacgactcggaccgatg

SEQ ID NO: 14858 - DNA, 203 bp, Homo sapiens
  source 1..203: mol_type = other DNA
ggcgcgccagtcctgcctagacccctgacacaactgtgttcactagcaacctcaaacagacaccatggtgcatctgactcctgaggagaagtctgccgttactgccctgtggggcaaggtgaacgtactcccagttggtggtgaggccctgggcaggctgctggtggtctacccttggacccagaggtcgactcggaccgatg

SEQ ID NO: 14859 - DNA, 203 bp, Homo sapiens
  source 1..203: mol_type = other DNA
ggcgcgccagtcctggcaggacccctgacacaactgtgttcactagcaacctcaaacagacaccatggtgcatctgactcctgaggagaagtctgccgttactgccctgtggggcaaggtgaacgtggaccggccgtgtggtgaggccctgggcaggctgctggtggtctacccttggaccggcgggtcgactcggaccgatg

SEQ ID NO: 14860 - DNA, 203 bp, Homo sapiens
  source 1..203: mol_type = other DNA
ggcgcgccagtcctgggtccactactgacacaactgtgttcactagcaacctcaaacagacaccatggtgcatctgactcctgaggagaagtctgccgttactgccctgtggggcaaggtgaacgtggataccggccgtggtgaggccctgggcaggctgctggtggtctacccttggacctactccccgactcggaccgatg

SEQ ID NO: 14861 - DNA, 203 bp, Homo sapiens
  source 1..203: mol_type = other DNA
ggcgcgccagtcctgggtctcgttctgacacaactgtgttcactagcaacctcaaacagacaccatggtgcatctgactcctgaggagaagtctgccgttactgccctgtggggcaaggtgaacgtggatccggcgggtggtgaggccctgggcaggctgctggtggtctaccccgtcaattcctttacgactcggaccgatg

SEQ ID NO: 14862 - DNA, 203 bp, Homo sapiens
  source 1..203: mol_type = other DNA
ggcgcgccagtcctttgacttgcgctgacacaactgtgttcactagcaacctcaaacagacaccatggtgcatctgactcctgaggagaagtctgccgttactgccctgtggggcaaggtgaacgtggatgaagtccggcgggtggccctgggcaggctgctggtggtctacccttggaccggcgggtcgactcggaccgatg

SEQ ID NO: 14863 - DNA, 203 bp, Homo sapiens
  source 1..203: mol_type = other DNA
ggcgcgccagtccttaagtcagagctgacacaactgtgttcactagcaacctcaaacagacaccatggtgcatctgactcctgaggagaagtctgccgttactgccctgtggggcaaggtgaacgtggatgaagttactcccgaggccctgggcaggctgctggtggtctacccttgttcttggcaaacgactcggaccgatg

SEQ ID NO: 14864 - DNA, 203 bp, Homo sapiens
  source 1..203: mol_type = other DNA
ggcgcgccagtcctcgtgacttagctgacacaactgtgttcactagcaacctcaaacagacaccatggtgcatctgactcctgaggagaagtctgccgttactgccctgtggggcaaggtgaacgtggatgaagttgcacggaatcgagaaggcaggctgctggtggtctacccttggaaccggccgtcgactcggaccgatg

SEQ ID NO: 14865 - DNA, 203 bp, Homo sapiens
  source 1..203: mol_type = other DNA
ggcgcgccagtcctaagtcaggccctgacacaactgtgttcactagcaacctcaaacagacaccatggtgcatctgactcctgaggagaagtctgccgttactgccctgtggggcaaggtgaacgtggatgaagttgcacggaatcgagaaggcaggctgctggtggtctacccttggaccggcgggtcgactcggaccgatg

SEQ ID NO: 14866 - DNA, 203 bp, Homo sapiens
  source 1..203: mol_type = other DNA
ggcgcgccagtccttatgacttctctgacacaactgtgttcactagcaacctcaaacagacaccatggtgcatctgactcctgaggagaagtctgccgttactgccctgtggggcaaggtgaacgtggatgaagttgccggcgggtccctgggcaggctgctggtggtctaccccgtcaattcctttacgactcggaccgatg

SEQ ID NO: 14867 - DNA, 203 bp, Homo sapiens
  source 1..203: mol_type = other DNA
ggcgcgccagtcctcttaagtcaactgacacaactgtgttcactagcaacctcaaacagacaccatggtgcatctgactcctgaggagaagtctgccgttactgccctgtggggcaaggtgaacgtggatgaagttgccggcgggtccctgggcaggctgctggtggtctacccttggacccagaggtcgactcggaccgatg

SEQ ID NO: 14868 - DNA, 203 bp, Homo sapiens
  source 1..203: mol_type = other DNA
ggcgcgccagtcctcagaatcttcctgacacaactgtgttcactagcaacctcaaacagacaccatggtgcatctgactcctgaggagaagtctgccgttactgccctgtggggcaaggtgaacgtggatgaagttgcgtcaattcctttaggcaggctgctggtggtctacccttggaccggcgggtcgactcggaccgatg

SEQ ID NO: 14869 - DNA, 203 bp, Homo sapiens
  source 1..203: mol_type = other DNA
ggcgcgccagtcctctgctgactactgacacaactgtgttcactagcaacctcaaacagacaccatggtgcatctgactcctgaggagaagtctgccgttactgccctgtggggcaaggtgaacgtggatgaagttggtcgtcaattcctttacaggctgctggtggtctaccccacggaatcgagaacgactcggaccgatg

SEQ ID NO: 14870 - DNA, 203 bp, Homo sapiens
  source 1..203: mol_type = other DNA
ggcgcgccagtcctcaagtattctctgacacaactgtgttcactagcaacctcaaacagacaccatggtgcatctgactcctgaggagaagtctgccgttactgccctgtggggcaaggtgaacgtggatgaagttggtgaccggccgttgggcaggcaccggccgttctacccttaccggccgtggtcgactcggaccgatg

SEQ ID NO: 14871 - DNA, 203 bp, Homo sapiens
  source 1..203: mol_type = other DNA
ggcgcgccagtcctgctaagtatgctgacacaactgtgttcactagcaacctcaaacagacaccatggtgcatctgactcctgaggagaagtctgccgttactgccctgtggggcaaggtgaacgtggatgaagttggtgaccggccgttgggcaggcaccggccgttctacccttggacccagaggtcgactcggaccgatg

SEQ ID NO: 14872 - DNA, 203 bp, Homo sapiens
  source 1..203: mol_type = other DNA
ggcgcgccagtcctcatactttcgctgacacaactgtgttcactagcaacctcaaacagacaccatggtgcatctgactcctgaggagaagtctgccgttactgccctgtggggcaaggtgaacgtggatgaagttggtgaccggccgttgggcaggctgctggtggtctacccttgttcttggcaaacgactcggaccgatg

SEQ ID NO: 14873 - DNA, 203 bp, Homo sapiens
  source 1..203: mol_type = other DNA
ggcgcgccagtcctcatacttggtctgacacaactgtgttcactagcaacctcaaacagacaccatggtgcatctgactcctgaggagaagtctgccgttactgccctgtggggcaaggtgaacgtggatgaagttggtgcacggaatcgagaaaggccacggaatcgagaaccttggacccagaggtcgactcggaccgatg

SEQ ID NO: 14874 - DNA, 203 bp, Homo sapiens
  source 1..203: mol_type = other DNA
ggcgcgccagtcctacgatactttctgacacaactgtgttcactagcaacctcaaacagacaccatggtgcatctgactcctgaggagaagtctgccgttactgccctgtggggcaaggtgaacgtggatgaagttggtgcacggaatcgagaaaggctgctggtggtctacccttggacccagaggtcgactcggaccgatg

SEQ ID NO: 14875 - DNA, 203 bp, Homo sapiens
  source 1..203: mol_type = other DNA
ggcgcgccagtcctgtttgtatccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14876 - DNA, 203 bp, Homo sapiens
  source 1..203: mol_type = other DNA
ggcgcgccagtcctatctgaaaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14877 - DNA, 203 bp, Homo sapiens
  source 1..203: mol_type = other DNA
ggcgcgccagtcctgatacttaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14878 - DNA, 203 bp, Homo sapiens
  source 1..203: mol_type = other DNA
ggcgcgccagtcctaacagttaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14879 - DNA, 203 bp, Homo sapiens
  source 1..203: mol_type = other DNA
ggcgcgccagtcctttactagaccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14880 - DNA, 203 bp, Homo sapiens
  source 1..203: mol_type = other DNA
ggcgcgccagtcctaattctgtccctgacacaactgtgttcactagcaacctcaaacagacaccatggtgcatctgactcctgaggagaagtctgccgttactgccctgtggggcaaggtgaacgtggatgaagttggtgccggcgggttgggcaggcccggcgggttctacccttccggcgggtggtcgactcggaccgatg

SEQ ID NO: 14881 - DNA, 203 bp, Homo sapiens
  source 1..203: mol_type = other DNA
ggcgcgccagtcctggtcaagtatctgacacaactgtgttcactagcaacctcaaacagacaccatggtgcatctgactcctgaggagaagtctgccgttactgccctgtggggcaaggtgaacgtggatgaagttggtggggagtacctgggcaggcgggagtaggtctacccttggacccagaggtcgactcggaccgatg

SEQ ID NO: 14882 - DNA, 203 bp, Homo sapiens
  source 1..203: mol_type = other DNA
ggcgcgccagtcctggttgtaagactgacacaactgtgttcactagcaacctcaaacagacaccatggtgcatctgactcctgaggagaagtctgccgttactgccctgtggggcaaggtgaacgtggatgaagttggtggtcacggaatcgagaagctgctggtggtctacccttgttcttggcaaacgactcggaccgatg

SEQ ID NO: 14883 - DNA, 203 bp, Homo sapiens
  source 1..203: mol_type = other DNA
ggcgcgccagtcctggtgaagattctgacacaactgtgttcactagcaacctcaaacagacaccatggtgcatctgactcctgaggagaagtctgccgttactgccctgtggggcaaggtgaacgtggatgaagttggtggtcgtcaattcctttagctgctggtggtctacccttgttcttggcaaacgactcggaccgatg

SEQ ID NO: 14884 - DNA, 203 bp, Homo sapiens
  source 1..203: mol_type = other DNA
ggcgcgccagtccttcttgatctactgacacaactgtgttcactagcaacctcaaacagacaccatggtgcatctgactcctgaggagaagtctgccgttactgccctgtggggcaaggtgaacgtggatgaagttggtggtgaaccggccgtcaggctgctggtggtctaccccacggaatcgagaacgactcggaccgatg

SEQ ID NO: 14885 - DNA, 203 bp, Homo sapiens
  source 1..203: mol_type = other DNA
ggcgcgccagtcctatgtgatctactgacacaactgtgttcactagcaacctcaaacagacaccatggtgcatctgactcctgaggagaagtctgccgttactgccctgtggggcaaggtgaacgtggatgaagttggtggtgaaccggccgtcaggctgctggtggtctacccttggacctactccccgactcggaccgatg

SEQ ID NO: 14886 - DNA, 203 bp, Homo sapiens
  source 1..203: mol_type = other DNA
ggcgcgccagtcctggcttcacccctgacacaactgtgttcactagcaacctcaaacagacaccatggtgcatctgactcctgaggagaagtctgccgttactgccctgtggggcaaggtgaacgtggatgaagttggtggtgacacggaatcgagaatgctggtggtctacccttggaaccggccgtcgactcggaccgatg

SEQ ID NO: 14887 - DNA, 203 bp, Homo sapiens
  source 1..203: mol_type = other DNA
ggcgcgccagtcctgttcacccacctgacacaactgtgttcactagcaacctcaaacagacaccatggtgcatctgactcctgaggagaagtctgccgttactgccctgtggggcaaggtgaacgtggatgaagttggtggtgacacggaatcgagaatgctggtggtctacccttggaccggcgggtcgactcggaccgatg

SEQ ID NO: 14888 - DNA, 203 bp, Homo sapiens
  source 1..203: mol_type = other DNA
ggcgcgccagtcctaacctagcagctgacacaactgtgttcactagcaacctcaaacagacaccatggtgcatctgactcctgaggagaagtctgccgttactgccctgtggggcaaggtgaacgtggatgaagttggtggtgaccggcgggtcaggctgctggtggtctacccttggacccagaggtcgactcggaccgatg

SEQ ID NO: 14889 - DNA, 203 bp, Homo sapiens
  source 1..203: mol_type = other DNA
ggcgcgccagtccttaaccgagccctgacacaactgtgttcactagcaacctcaaacagacaccatggtgcatctgactcctgaggagaagtctgccgttactgccctgtggggcaaggtgaacgtggatgaagttggtggtgacgtcaattcctttatgctggtggtctacccttggaccggcgggtcgactcggaccgatg

SEQ ID NO: 14890 - DNA, 203 bp, Homo sapiens
  source 1..203: mol_type = other DNA
ggcgcgccagtcctcgacgtcctgctgacacaactgtgttcactagcaacctcaaacagacaccatggtgcatctgactcctgaggagaagtctgccgttactgccctgtggggcaaggtgaacgtggatgaagttggtggtgaggcccccggcgggttgctggtggtctacccttggaaccggccgtcgactcggaccgatg

SEQ ID NO: 14891 - DNA, 203 bp, Homo sapiens
  source 1..203: mol_type = other DNA
ggcgcgccagtcctggacgtttcgctgacacaactgtgttcactagcaacctcaaacagacaccatggtgcatctgactcctgaggagaagtctgccgttactgccctgtggggcaaggtgaacgtggatgaagttggtggtgaggccctactcccgctgctggtggtctacccttgttcttggcaaacgactcggaccgatg

SEQ ID NO: 14892 - DNA, 203 bp, Homo sapiens
  source 1..203: mol_type = other DNA
ggcgcgccagtcctggacgttctactgacacaactgtgttcactagcaacctcaaacagacaccatggtgcatctgactcctgaggagaagtctgccgttactgccctgtggggcaaggtgaacgtggatgaagttggtggtgaggccctgaccggccgtctggtggtctaccccgtcaattcctttacgactcggaccgatg

SEQ ID NO: 14893 - DNA, 203 bp, Homo sapiens
  source 1..203: mol_type = other DNA
ggcgcgccagtcctctggtagtaactgacacaactgtgttcactagcaacctcaaacagacaccatggtgcatctgactcctgaggagaagtctgccgttactgccctgtggggcaaggtgaacgtggatgaagttggtggtgaggccctgcacggaatcgagaaggtctacccttggaaccggccgtcgactcggaccgatg

SEQ ID NO: 14894 - DNA, 203 bp, Homo sapiens
  source 1..203: mol_type = other DNA
ggcgcgccagtcctagaggtagtactgacacaactgtgttcactagcaacctcaaacagacaccatggtgcatctgactcctgaggagaagtctgccgttactgccctgtggggcaaggtgaacgtggatgaagttggtggtgaggccctgcacggaatcgagaaggtctacccttggaccggcgggtcgactcggaccgatg

SEQ ID NO: 14895 - DNA, 203 bp, Homo sapiens
  source 1..203: mol_type = other DNA
ggcgcgccagtcctcgtgaatgaactgacacaactgtgttcactagcaacctcaaacagacaccatggtgcatctgactcctgaggagaagtctgccgttactgccctgtggggcaaggtgaacgtggatgaagttggtggtgaggccctgccggcgggtctggtggtctacccttggacctactccccgactcggaccgatg

SEQ ID NO: 14896 - DNA, 203 bp, Homo sapiens
  source 1..203: mol_type = other DNA
ggcgcgccagtccttgtctcgtgcctgacacaactgtgttcactagcaacctcaaacagacaccatggtgcatctgactcctgaggagaagtctgccgttactgccctgtggggcaaggtgaacgtggatgaagttggtggtgaggccctgggcaccggccgtgtggtctacccttgttcttggcaaacgactcggaccgatg

SEQ ID NO: 14897 - DNA, 203 bp, Homo sapiens
  source 1..203: mol_type = other DNA
ggcgcgccagtcctaggctgcgaactgacacaactgtgttcactagcaacctcaaacagacaccatggtgcatctgactcctgaggagaagtctgccgttactgccctgtggggcaaggtgaacgtggatgaagttggtggtgaggccctgggcaggcacccgccggtctacccttggacccagaggtcgactcggaccgatg

SEQ ID NO: 14898 - DNA, 203 bp, Homo sapiens
  source 1..203: mol_type = other DNA
ggcgcgccagtcctaccaagcgaactgacacaactgtgttcactagcaacctcaaacagacaccatggtgcatctgactcctgaggagaagtctgccgttactgccctgtggggcaaggtgaacgtggatgaagttggtggtgaggccctgggcaggcaccggccgttctaccccacggaatcgagaacgactcggaccgatg

SEQ ID NO: 14899 - DNA, 203 bp, Homo sapiens
  source 1..203: mol_type = other DNA
ggcgcgccagtcctaatgcgaatcctgacacaactgtgttcactagcaacctcaaacagacaccatggtgcatctgactcctgaggagaagtctgccgttactgccctgtggggcaaggtgaacgtggatgaagttggtggtgaggccctgggcaggcaccggccgttctacccttggacccagaggtcgactcggaccgatg

SEQ ID NO: 14900 - DNA, 203 bp, Homo sapiens
  source 1..203: mol_type = other DNA
ggcgcgccagtcctcaggcgaactctgacacaactgtgttcactagcaacctcaaacagacaccatggtgcatctgactcctgaggagaagtctgccgttactgccctgtggggcaaggtgaacgtggatgaagttggtggtgaggccctgggcaggccacggaatcgagaaccttggaccggcgggtcgactcggaccgatg

SEQ ID NO: 14901 - DNA, 203 bp, Homo sapiens
  source 1..203: mol_type = other DNA
ggcgcgccagtccttggcgaagtcctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctaccccacggaatcgagaacgactcggaccgatg

SEQ ID NO: 14902 - DNA, 203 bp, Homo sapiens
  source 1..203: mol_type = other DNA
ggcgcgccagtcctaaaagcgaagctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14903 - DNA, 203 bp, Homo sapiens
  source 1..203: mol_type = other DNA
ggcgcgccagtcctctcttcgccactgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14904 - DNA, 203 bp, Homo sapiens
  source 1..203: mol_type = other DNA
ggcgcgccagtcctacgctttcgcctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14905 - DNA, 203 bp, Homo sapiens
  source 1..203: mol_type = other DNA
ggcgcgccagtcctcttcgctgtgctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14906 - DNA, 203 bp, Homo sapiens
  source 1..203: mol_type = other DNA
ggcgcgccagtcctcgttcgctgcctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14907 - DNA, 203 bp, Homo sapiens
  source 1..203: mol_type = other DNA
ggcgcgccagtcctaggattcgctctgacacaactgtgttcactagcaacctcaaacagacaccatggtgcatctgactcctgaggagaagtctgccgttactgccctgtggggcaaggtgaacgtggatgaagttggtggtgaggccctgggcaggcccggcgggttctacccttccggcgggtggtcgactcggaccgatg

SEQ ID NO: 14908 - DNA, 203 bp, Homo sapiens
  source 1..203: mol_type = other DNA
ggcgcgccagtcctatttcgctcgctgacacaactgtgttcactagcaacctcaaacagacaccatggtgcatctgactcctgaggagaagtctgccgttactgccctgtggggcaaggtgaacgtggatgaagttggtggtgaggccctgggcaggccgtcaattcctttaccttggacccagaggtcgactcggaccgatg

SEQ ID NO: 14909 - DNA, 203 bp, Homo sapiens
  source 1..203: mol_type = other DNA
ggcgcgccagtcctaaattcgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctactcccggtctacccttggacccagaggtcgactcggaccgatg

SEQ ID NO: 14910 - DNA, 203 bp, Homo sapiens
  source 1..203: mol_type = other DNA
ggcgcgccagtcctggatttcgctctgacacaactgtgttcactagcaacctcaaacagacaccatggtgcatctgactcctgaggagaagtctgccgttactgccctgtggggcaaggtgaacgtggatgaagttggtggtgaggccctgggcaggctactcccggtctacccttggaccggcgggtcgactcggaccgatg

SEQ ID NO: 14911 - DNA, 203 bp, Homo sapiens
  source 1..203: mol_type = other DNA
ggcgcgccagtcctcttcgctagtctgacacaactgtgttcactagcaacctcaaacagacaccatggtgcatctgactcctgaggagaagtctgccgttactgccctgtggggcaaggtgaacgtggatgaagttggtggtgaggccctgggcaggctactcccggtctaccctttactcccgaggtcgactcggaccgatg

SEQ ID NO: 14912 - DNA, 203 bp, Homo sapiens
  source 1..203: mol_type = other DNA
ggcgcgccagtcctttgtcatgggctgacacaactgtgttcactagcaacctcaaacagacaccatggtgcatctgactcctgaggagaagtctgccgttactgccctgtggggcaaggtgaacgtggatgaagttggtggtgaggccctgggcaggctgcacggaatcgagaattggacctactccccgactcggaccgatg

SEQ ID NO: 14913 - DNA, 203 bp, Homo sapiens
  source 1..203: mol_type = other DNA
ggcgcgccagtccttgtaggtgccctgacacaactgtgttcactagcaacctcaaacagacaccatggtgcatctgactcctgaggagaagtctgccgttactgccctgtggggcaaggtgaacgtggatgaagttggtggtgaggccctgggcaggctgcccggcgggtacccttgttcttggcaaacgactcggaccgatg

SEQ ID NO: 14914 - DNA, 203 bp, Homo sapiens
  source 1..203: mol_type = other DNA
ggcgcgccagtcctgtgacgttctctgacacaactgtgttcactagcaacctcaaacagacaccatggtgcatctgactcctgaggagaagtctgccgttactgccctgtggggcaaggtgaacgtggatgaagttggtggtgaggccctgggcaggctgcgtcaattcctttacacggaatcgagaacgactcggaccgatg

SEQ ID NO: 14915 - DNA, 203 bp, Homo sapiens
  source 1..203: mol_type = other DNA
ggcgcgccagtcctaccttacgcactgacacaactgtgttcactagcaacctcaaacagacaccatggtgcatctgactcctgaggagaagtctgccgttactgccctgtggggcaaggtgaacgtggatgaagttggtggtgaggccctgggcaggctgctgaccggccgtccttggaaccggccgtcgactcggaccgatg

SEQ ID NO: 14916 - DNA, 203 bp, Homo sapiens
  source 1..203: mol_type = other DNA
ggcgcgccagtcctcttacgctctctgacacaactgtgttcactagcaacctcaaacagacaccatggtgcatctgactcctgaggagaagtctgccgttactgccctgtggggcaaggtgaacgtggatgaagttggtggtgaggccctgggcaggctgctgcacggaatcgagaattcttggcaaacgactcggaccgatg

SEQ ID NO: 14917 - DNA, 203 bp, Homo sapiens
  source 1..203: mol_type = other DNA
ggcgcgccagtccttgctgtgttcctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtcacggaatcgagaaccggcgggtcgactcggaccgatg

SEQ ID NO: 14918 - DNA, 203 bp, Homo sapiens
  source 1..203: mol_type = other DNA
ggcgcgccagtccttatcgtgttactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtccggcgggtttggacccagaggtcgactcggaccgatg

SEQ ID NO: 14919 - DNA, 203 bp, Homo sapiens
  source 1..203: mol_type = other DNA
ggcgcgccagtcctaacacgatcgctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtcgtcaattcctttaccggcgggtcgactcggaccgatg

SEQ ID NO: 14920 - DNA, 203 bp, Homo sapiens
  source 1..203: mol_type = other DNA
ggcgcgccagtcctgacctaagaactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggcgtcaattcctttatactccccgactcggaccgatg

SEQ ID NO: 14921 - DNA, 203 bp, Homo sapiens
  source 1..203: mol_type = other DNA
ggcgcgccagtccttcagcctaccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtactcccttggacctactccccgactcggaccgatg

SEQ ID NO: 14922 - DNA, 203 bp, Homo sapiens
  source 1..203: mol_type = other DNA
ggcgcgccagtcctctttcagcctctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 14923 - DNA, 203 bp, Homo sapiens
  source 1..203: mol_type = other DNA
ggcgcgccagtcctgtaagtcatgctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccctactccctactccccgactcggaccgatg

SEQ ID NO: 14924 - DNA, 203 bp, Homo sapiens
  source 1..203: mol_type = other DNA
ggcgcgccagtcctagaacctgtgctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14925 - DNA, 203 bp, Homo sapiens
  source 1..203: mol_type = other DNA
ggcgcgccagtcctttgaggttcactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14926 - DNA, 203 bp, Homo sapiens
  source 1..203: mol_type = other DNA
ggcgcgccagtcctgaccgaaacactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14927 - DNA, 203 bp, Homo sapiens
  source 1..203: mol_type = other DNA
ggcgcgccagtcctcgtgtacccactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttccggcgggtggtcgactcggaccgatg

SEQ ID NO: 14928 - DNA, 203 bp, Homo sapiens
  source 1..203: mol_type = other DNA
ggcgcgccagtcctgtcaacacgtctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14929 - DNA, 203 bp, Homo sapiens
  source 1..203: mol_type = other DNA
ggcgcgccagtcctccagtgttgactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14930 - DNA, 203 bp, Homo sapiens
  source 1..203: mol_type = other DNA
ggcgcgccagtccttcaacacttactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14931 - DNA, 203 bp, Homo sapiens
  source 1..203: mol_type = other DNA
ggcgcgccagtcctttgtaaacccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14932 - DNA, 203 bp, Homo sapiens
  source 1..203: mol_type = other DNA
ggcgcgccagtccttgtggtagaactgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 14933 - DNA, 203 bp, Homo sapiens
  source 1..203: mol_type = other DNA
ggcgcgccagtcctgctggactttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctactactcccaccggccgtcgactcggaccgatg

SEQ ID NO: 14934 - DNA, 203 bp, Homo sapiens
  source 1..203: mol_type = other DNA
ggcgcgccagtcctagttggtcccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctccggcgggtaccggccgtcgactcggaccgatg

SEQ ID NO: 14935 - DNA, 203 bp, Homo sapiens
  source 1..203: mol_type = other DNA
ggcgcgccagtccttagaagtcccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtttcttggcaaaaccggccgtcgactcggaccgatg

SEQ ID NO: 14936 - DNA, 203 bp, Homo sapiens
  source 1..203: mol_type = other DNA
ggcgcgccagtccttcccaaccgtctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggttactcccccttggaaccggccgtcgactcggaccgatg

SEQ ID NO: 14937 - DNA, 203 bp, Homo sapiens
  source 1..203: mol_type = other DNA
ggcgcgccagtcctatcccaaggactgacacaactgtgttcactagcaacctcaaacagacaccatggtgcatctgactcctgaggagaagtctgccgttactgccctgtggggcaaggtgaacgtggatgaagttggtggtgaggccctgggcaggctgctgttcttggcaaattggacccagaggtcgactcggaccgatg

SEQ ID NO: 14938 - DNA, 203 bp, Homo sapiens
  source 1..203: mol_type = other DNA
ggcgcgccagtcctgcatgatcccctgacacaactgtgttcactagcaacctcaaacagacaccatggtgcatctgactcctgaggagaagtctgccgttactgccctgtggggcaaggtgaacgtggatgaagttggtggtgaggccctgggcaggctgctgttcttggcaaattggacctactccccgactcggaccgatg

SEQ ID NO: 14939 - DNA, 203 bp, Homo sapiens
  source 1..203: mol_type = other DNA
ggcgcgccagtcctgggatcctaactgacacaactgtgttcactagcaacctcaaacagacaccatggtgcatctgactcctgaggagaagtctgccgttactgccctgtggggcaaggtgaacgtggatgaagttggtggtgaggccctgggcaggctgtactccctctaccccgtcaattcctttacgactcggaccgatg

SEQ ID NO: 14940 - DNA, 203 bp, Homo sapiens
  source 1..203: mol_type = other DNA
ggcgcgccagtcctttgggacctcctgacacaactgtgttcactagcaacctcaaacagacaccatggtgcatctgactcctgaggagaagtctgccgttactgccctgtggggcaaggtgaacgtggatgaagttggtggtgaggccctgggcaggcttctcgattccgtgccttggacccagaggtcgactcggaccgatg

SEQ ID NO: 14941 - DNA, 203 bp, Homo sapiens
  source 1..203: mol_type = other DNA
ggcgcgccagtcctatttgggaccctgacacaactgtgttcactagcaacctcaaacagacaccatggtgcatctgactcctgaggagaagtctgccgttactgccctgtggggcaaggtgaacgtggatgaagttggtggtgaggccctgggcagttcttggcaaatctacccttggacccagaggtcgactcggaccgatg

SEQ ID NO: 14942 - DNA, 203 bp, Homo sapiens
  source 1..203: mol_type = other DNA
ggcgcgccagtcctgggatactcgctgacacaactgtgttcactagcaacctcaaacagacaccatggtgcatctgactcctgaggagaagtctgccgttactgccctgtggggcaaggtgaacgtggatgaagttggtggtgaggccctgggcccggcgggtgtggtctacccttgttcttggcaaacgactcggaccgatg

SEQ ID NO: 14943 - DNA, 203 bp, Homo sapiens
  source 1..203: mol_type = other DNA
ggcgcgccagtcctagagcgttgtctgacacaactgtgttcactagcaacctcaaacagacaccatggtgcatctgactcctgaggagaagtctgccgttactgccctgtggggcaaggtgaacgtggatgaagttggtggtgaggccctgggcgtcaattcctttatctacccttggacccagaggtcgactcggaccgatg

SEQ ID NO: 14944 - DNA, 203 bp, Homo sapiens
  source 1..203: mol_type = other DNA
ggcgcgccagtcctggcgttgaacctgacacaactgtgttcactagcaacctcaaacagacaccatggtgcatctgactcctgaggagaagtctgccgttactgccctgtggggcaaggtgaacgtggatgaagttggtggtgaggccctgggcttcttggcaaaggtctacccttggaaccggccgtcgactcggaccgatg

SEQ ID NO: 14945 - DNA, 203 bp, Homo sapiens
  source 1..203: mol_type = other DNA
ggcgcgccagtccttgtcgtgagcctgacacaactgtgttcactagcaacctcaaacagacaccatggtgcatctgactcctgaggagaagtctgccgttactgccctgtggggcaaggtgaacgtggatgaagttggtggtgaggccctgggtactcccctggtggtctaccccgtcaattcctttacgactcggaccgatg

SEQ ID NO: 14946 - DNA, 203 bp, Homo sapiens
  source 1..203: mol_type = other DNA
ggcgcgccagtcctacacgacgaactgacacaactgtgttcactagcaacctcaaacagacaccatggtgcatctgactcctgaggagaagtctgccgttactgccctgtggggcaaggtgaacgtggatgaagttggtggtgaggcccttcttggcaaactggtggtctaccccacggaatcgagaacgactcggaccgatg

SEQ ID NO: 14947 - DNA, 203 bp, Homo sapiens
  source 1..203: mol_type = other DNA
ggcgcgccagtcctcacgactgggctgacacaactgtgttcactagcaacctcaaacagacaccatggtgcatctgactcctgaggagaagtctgccgttactgccctgtggggcaaggtgaacgtggatgaagttggtggtgaggcccttcttggcaaactggtggtctacccttggacctactccccgactcggaccgatg

SEQ ID NO: 14948 - DNA, 203 bp, Homo sapiens
  source 1..203: mol_type = other DNA
ggcgcgccagtcctacctgtcgtgctgacacaactgtgttcactagcaacctcaaacagacaccatggtgcatctgactcctgaggagaagtctgccgttactgccctgtggggcaaggtgaacgtggatgaagttggtggtgaggcgtcaattcctttactggtggtctaccccgtcaattcctttacgactcggaccgatg

SEQ ID NO: 14949 - DNA, 203 bp, Homo sapiens
  source 1..203: mol_type = other DNA
ggcgcgccagtccttgcggtctttctgacacaactgtgttcactagcaacctcaaacagacaccatggtgcatctgactcctgaggagaagtctgccgttactgccctgtggggcaaggtgaacgtggatgaagttggtggtgaggcttcttggcaaatgctggtggtctacccttggaccggcgggtcgactcggaccgatg

SEQ ID NO: 14950 - DNA, 203 bp, Homo sapiens
  source 1..203: mol_type = other DNA
ggcgcgccagtccttcgcggtctactgacacaactgtgttcactagcaacctcaaacagacaccatggtgcatctgactcctgaggagaagtctgccgttactgccctgtggggcaaggtgaacgtggatgaagttggtggtgaggtactccccaggctgctggtggtctaccccgtcaattcctttacgactcggaccgatg

SEQ ID NO: 14951 - DNA, 203 bp, Homo sapiens
  source 1..203: mol_type = other DNA
ggcgcgccagtccttgcggttgcactgacacaactgtgttcactagcaacctcaaacagacaccatggtgcatctgactcctgaggagaagtctgccgttactgccctgtggggcaaggtgaacgtggatgaagttggtggtgagttcttggcaaagctgctggtggtctacccttgttcttggcaaacgactcggaccgatg

SEQ ID NO: 14952 - DNA, 203 bp, Homo sapiens
  source 1..203: mol_type = other DNA
ggcgcgccagtcctgcggttaggtctgacacaactgtgttcactagcaacctcaaacagacaccatggtgcatctgactcctgaggagaagtctgccgttactgccctgtggggcaaggtgaacgtggatgaagttggtggtgatactcccggcaggctgctggtggtctacccttggaaccggccgtcgactcggaccgatg

SEQ ID NO: 14953 - DNA, 203 bp, Homo sapiens
  source 1..203: mol_type = other DNA
ggcgcgccagtcctgcggtttgccctgacacaactgtgttcactagcaacctcaaacagacaccatggtgcatctgactcctgaggagaagtctgccgttactgccctgtggggcaaggtgaacgtggatgaagttggtggttactccctgggcaggctgctggtggtctacccttgttcttggcaaacgactcggaccgatg

SEQ ID NO: 14954 - DNA, 203 bp, Homo sapiens
  source 1..203: mol_type = other DNA
ggcgcgccagtcctagttagcggtctgacacaactgtgttcactagcaacctcaaacagacaccatggtgcatctgactcctgaggagaagtctgccgttactgccctgtggggcaaggtgaacgtggatgaagttggtgtactccccctgggcaggctactcccggtctacccttggacccagaggtcgactcggaccgatg

SEQ ID NO: 14955 - DNA, 203 bp, Homo sapiens
  source 1..203: mol_type = other DNA
ggcgcgccagtcctctgagcggtcctgacacaactgtgttcactagcaacctcaaacagacaccatggtgcatctgactcctgaggagaagtctgccgttactgccctgtggggcaaggtgaacgtggatgaagttggtgttcttggcaaaggcaggctgctggtggtctacccttggaaccggccgtcgactcggaccgatg

SEQ ID NO: 14956 - DNA, 203 bp, Homo sapiens
  source 1..203: mol_type = other DNA
ggcgcgccagtcctcagcggtttcctgacacaactgtgttcactagcaacctcaaacagacaccatggtgcatctgactcctgaggagaagtctgccgttactgccctgtggggcaaggtgaacgtggatgaagttggtgttcttggcaaaggcaggctgctggtggtctacccttggaccggcgggtcgactcggaccgatg

SEQ ID NO: 14957 - DNA, 203 bp, Homo sapiens
  source 1..203: mol_type = other DNA
ggcgcgccagtccttagaccgcatctgacacaactgtgttcactagcaacctcaaacagacaccatggtgcatctgactcctgaggagaagtctgccgttactgccctgtggggcaaggtgaacgtggatgaagttggttactcccccctgggcaggctgctggtggtctaccccacggaatcgagaacgactcggaccgatg

SEQ ID NO: 14958 - DNA, 203 bp, Homo sapiens
  source 1..203: mol_type = other DNA
ggcgcgccagtccttaccgcttgactgacacaactgtgttcactagcaacctcaaacagacaccatggtgcatctgactcctgaggagaagtctgccgttactgccctgtggggcaaggtgaacgtggatgaagttggttactcccccctgggcaggctgctggtggtctacccttggacccagaggtcgactcggaccgatg

SEQ ID NO: 14959 - DNA, 203 bp, Homo sapiens
  source 1..203: mol_type = other DNA
ggcgcgccagtccttaccgcaactctgacacaactgtgttcactagcaacctcaaacagacaccatggtgcatctgactcctgaggagaagtctgccgttactgccctgtggggcaaggtgaacgtggatgaagttggttcttggcaaatgggcaggctgctggtggtctacccttgttcttggcaaacgactcggaccgatg

SEQ ID NO: 14960 - DNA, 203 bp, Homo sapiens
  source 1..203: mol_type = other DNA
ggcgcgccagtcctataccgcttcctgacacaactgtgttcactagcaacctcaaacagacaccatggtgcatctgactcctgaggagaagtctgccgttactgccctgtggggcaaggtgaacgtggatgaagttgtactcccggccctgggcaggctgctggtggtctacccttggaccggcgggtcgactcggaccgatg

SEQ ID NO: 14961 - DNA, 203 bp, Homo sapiens
  source 1..203: mol_type = other DNA
ggcgcgccagtcctcgcaaccgcactgacacaactgtgttcactagcaacctcaaacagacaccatggtgcatctgactcctgaggagaagtctgccgttactgccctgtggggcaaggtgaacgtggatgaagtttcttggcaaaccctgggcaggctgctggtggtctaccccgtcaattcctttacgactcggaccgatg

SEQ ID NO: 14962 - DNA, 203 bp, Homo sapiens
  source 1..203: mol_type = other DNA
ggcgcgccagtcctagtcaccgcgctgacacaactgtgttcactagcaacctcaaacagacaccatggtgcatctgactcctgaggagaagtctgccgttactgccctgtggggcaaggtgaacgtggatgacacggaatcgagaaccctgggcaggctgctggtggtctaccccgtcaattcctttacgactcggaccgatg

SEQ ID NO: 14963 - DNA, 203 bp, Homo sapiens
  source 1..203: mol_type = other DNA
ggcgcgccagtcctcgaccgctttctgacacaactgtgttcactagcaacctcaaacagacaccatggtgcatctgactcctgaggagaagtctgccgttactgccctgtggggcaaggtgaacgtggatgacacggaatcgagaaccctgggcaggctgctggtggtctacccttggacctactccccgactcggaccgatg

SEQ ID NO: 14964 - DNA, 203 bp, Homo sapiens
  source 1..203: mol_type = other DNA
ggcgcgccagtcctgtaccgcacactgacacaactgtgttcactagcaacctcaaacagacaccatggtgcatctgactcctgaggagaagtctgccgttactgccctgtggggcaaggtgaacgtggatgatactcccggtgaggccctgggcaggctgctggtggtctaccccgtcaattcctttacgactcggaccgatg

SEQ ID NO: 14965 - DNA, 203 bp, Homo sapiens
  source 1..203: mol_type = other DNA
ggcgcgccagtccttagtgaccgcctgacacaactgtgttcactagcaacctcaaacagacaccatggtgcatctgactcctgaggagaagtctgccgttactgccctgtggggcaaggtgaacgtggatgatactcccggtgaggccctgggcaggctgctggtggtctacccttggacctactccccgactcggaccgatg

SEQ ID NO: 14966 - DNA, 203 bp, Homo sapiens
  source 1..203: mol_type = other DNA
ggcgcgccagtcctccattctgcactgacacaactgtgttcactagcaacctcaaacagacaccatggtgcatctgactcctgaggagaagtctgccgttactgccctgtggggcaaggtgaacgtggccggcgggtgtggtgaggccctgggcaggctgctggtggtctacccttggaccggcgggtcgactcggaccgatg

SEQ ID NO: 14967 - DNA, 203 bp, Homo sapiens
  source 1..203: mol_type = other DNA
ggcgcgccagtcctccagaatgacctgacacaactgtgttcactagcaacctcaaacagacaccatggtgcatctgactcctgaggagaagtctgccgttactgccctgtggggcaaggtgaacgtggtactccctggtggtgaggccctgggcaggctgctggtggtctacccttgttcttggcaaacgactcggaccgatg

SEQ ID NO: 14968 - DNA, 203 bp, Homo sapiens
  source 1..203: mol_type = other DNA
ggcgcgccagtcctgtacacacagctgacacaactgtgttcactagcaacctcaaacagacaccatggtgcatctgactcctgaggagaagtctgccgttactgccctgtggggcaaggtgaacgtggttcttggcaaaggtgaggccctgggcaggctgctggtggtctacccttggacctactccccgactcggaccgatg

SEQ ID NO: 14969 - DNA, 203 bp, Homo sapiens
  source 1..203: mol_type = other DNA
ggcgcgccagtccttttgaattcgctgacacaactgtgttcactagcaacctcaaacagacaccatggtgcatctgactcctgaggagaagtctgccgttactgccctgtggggcaaggtgaacgtttcttggcaaagtggtgaggccctgggcaggctgctggtggtctacccttggaaccggccgtcgactcggaccgatg

SEQ ID NO: 14970 - DNA, 203 bp, Homo sapiens
  source 1..203: mol_type = other DNA
ggcgcgccagtccttaaagtctacctgacacaactgtgttcactagcaacctcaaacagacaccatggtgcatctgactcctgaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 14971 - DNA, 203 bp, Homo sapiens
  source 1..203: mol_type = other DNA
ggcgcgccagtcctgtcaaagtctctgacacaactgtgttcactagcaacctcaaacagacaccatggtgcatctgactcctgaggagaagtctgccgttactgccctgtggggcaaggtgacacggaatcgagaaggtgcacggaatcgagaaaggctgctggtggtctacccttggacccagaggtcgactcggaccgatg

SEQ ID NO: 14972 - DNA, 203 bp, Homo sapiens
  source 1..203: mol_type = other DNA
ggcgcgccagtcctgctgaagtctctgacacaactgtgttcactagcaacctcaaacagacaccatggtgcatctgactcctgaggagaagtctgccgttactgccctgtggggcaaggtgacacggaatcgagaaggtggtgaggccctgggcaggctgctggtggtctacccttggacccagaggtcgactcggaccgatg

SEQ ID NO: 14973 - DNA, 203 bp, Homo sapiens
  source 1..203: mol_type = other DNA
ggcgcgccagtcctcaagtctacactgacacaactgtgttcactagcaacctcaaacagacaccatggtgcatctgactcctgaggagaagtctgccgttactgccctgtggggcaaggtgaccggccgtgaagttggtggtgaggccctgggcaggctgctggtggtctacccttggaccggcgggtcgactcggaccgatg

SEQ ID NO: 14974 - DNA, 203 bp, Homo sapiens
  source 1..203: mol_type = other DNA
ggcgcgccagtcctagctagacttctgacacaactgtgttcactagcaacctcaaacagacaccatggtgcatctgactcctgaggagaagtctgccgttactgccctgtggggcaaggtgaccggcgggtaagttggtgccggcgggttgggcaggcccggcgggttctacccttccggcgggtggtcgactcggaccgatg

SEQ ID NO: 14975 - DNA, 203 bp, Homo sapiens
  source 1..203: mol_type = other DNA
ggcgcgccagtcctgggtacgcttctgacacaactgtgttcactagcaacctcaaacagacaccatggtgcatctgactcctgaggagaagtctgccgttactgccctgtggggcaaggtgaccggcgggtaagttggtgccggcgggttgggcaggcccggcgggttctacccttccggcgggtggtcgactcggaccgatg

SEQ ID NO: 14976 - DNA, 203 bp, Homo sapiens
  source 1..203: mol_type = other DNA
ggcgcgccagtccttgagtacgccctgacacaactgtgttcactagcaacctcaaacagacaccatggtgcatctgactcctgaggagaagtctgccgttactgccctgtggggcaaggtgaccggcgggtaagttggtgccggcgggttgggcaggctgctggtggtctacccttccggcgggtggtcgactcggaccgatg

SEQ ID NO: 14977 - DNA, 203 bp, Homo sapiens
  source 1..203: mol_type = other DNA
ggcgcgccagtccttagagtgtgactgacacaactgtgttcactagcaacctcaaacagacaccatggtgcatctgactcctgaggagaagtctgccgttactgccctgtggggcaaggtgaccggcgggtaagttggtggtgaggccctgggcaggcccggcgggttctacccttccggcgggtggtcgactcggaccgatg

SEQ ID NO: 14978 - DNA, 203 bp, Homo sapiens
  source 1..203: mol_type = other DNA
ggcgcgccagtcctattgcggtggctgacacaactgtgttcactagcaacctcaaacagacaccatggtgcatctgactcctgaggagaagtctgccgttactgccctgtggggcaaggtgatactccctgaagttggtgtactccccctgggcaggctactcccggtctacccttggacccagaggtcgactcggaccgatg

SEQ ID NO: 14979 - DNA, 203 bp, Homo sapiens
  source 1..203: mol_type = other DNA
ggcgcgccagtcctaattgaacgtctgacacaactgtgttcactagcaacctcaaacagacaccatggtgcatctgactcctgaggagaagtctgccgttactgccctgtggggcaaggtgatactccctgaagttggtgtactccccctgggcaggctgctggtggtctacccttggacccagaggtcgactcggaccgatg

SEQ ID NO: 14980 - DNA, 203 bp, Homo sapiens
  source 1..203: mol_type = other DNA
ggcgcgccagtcctgctcattgacctgacacaactgtgttcactagcaacctcaaacagacaccatggtgcatctgactcctgaggagaagtctgccgttactgccctgtggggcaaggtgattcttggcaaagttggtggtgaggccctgggcaggctgctggtggtctacccttggacccagaggtcgactcggaccgatg

SEQ ID NO: 14981 - DNA, 203 bp, Homo sapiens
  source 1..203: mol_type = other DNA
ggcgcgccagtcctcaattctcgtctgacacaactgtgttcactagcaacctcaaacagacaccatggtgcatctgactcctgaggagaagtctgccgttactgccctgtggggcaaggtgcacggaatcgagaatggtggtgaggccctgggcaggctgctggtggtctacccttgttcttggcaaacgactcggaccgatg

SEQ ID NO: 14982 - DNA, 203 bp, Homo sapiens
  source 1..203: mol_type = other DNA
ggcgcgccagtcctttcattgcagctgacacaactgtgttcactagcaacctcaaacagacaccatggtgcatctgactcctgaggagaagtctgccgttactgccctgtggggcaaggtgcgtcaattcctttatggtggtgaggccctgggcaggctgctggtggtctacccttgttcttggcaaacgactcggaccgatg

SEQ ID NO: 14983 - DNA, 203 bp, Homo sapiens
  source 1..203: mol_type = other DNA
ggcgcgccagtcctggtgatcaatctgacacaactgtgttcactagcaacctcaaacagacaccatggtgcatctgactcctgaggagaagtctgccgttactgccctgtggggcaaggtgtactcccatgaagttggtggtgaggccctgggcaggctgctggtggtctacccttgttcttggcaaacgactcggaccgatg

SEQ ID NO: 14984 - DNA, 203 bp, Homo sapiens
  source 1..203: mol_type = other DNA
ggcgcgccagtcctatcagaattgctgacacaactgtgttcactagcaacctcaaacagacaccatggtgcatctgactcctgaggagaagtctgccgttactgccctgtggggcaaggtgttcttggcaaaagttggtggtgaggccctgggcaggctgctggtggtctaccccgtcaattcctttacgactcggaccgatg

SEQ ID NO: 14985 - DNA, 203 bp, Homo sapiens
  source 1..203: mol_type = other DNA
ggcgcgccagtcctggtcaattcgctgacacaactgtgttcactagcaacctcaaacagacaccatggtgcatctgactcctgaggagaagtctgccgttactgccctgtggggcaagtactccctggatgaagttggtggtgaggccctgggcaggctgctggtggtctaccccgtcaattcctttacgactcggaccgatg

SEQ ID NO: 14986 - DNA, 203 bp, Homo sapiens
  source 1..203: mol_type = other DNA
ggcgcgccagtcctacttcaattcctgacacaactgtgttcactagcaacctcaaacagacaccatggtgcatctgactcctgaggagaagtctgccgttactgccctgtggggcaagtactccctggatgaagttggtggtgaggccctgggcaggctgctggtggtctacccttggacccagaggtcgactcggaccgatg

SEQ ID NO: 14987 - DNA, 203 bp, Homo sapiens
  source 1..203: mol_type = other DNA
ggcgcgccagtcctgaggattgatctgacacaactgtgttcactagcaacctcaaacagacaccatggtgcatctgactcctgaggagaagtctgccgttactgccctgtggggcaattcttggcaaaatgaagttggtggtgaggccctgggcaggctgctggtggtctacccttgttcttggcaaacgactcggaccgatg

SEQ ID NO: 14988 - DNA, 203 bp, Homo sapiens
  source 1..203: mol_type = other DNA
ggcgcgccagtcctacaatctaagctgacacaactgtgttcactagcaacctcaaacagacaccatggtgcatctgactcctgaggagaagtctgccgttactgccctgtggggcacacggaatcgagaagaagttggtggtgaggccctgggcaggctgctggtggtctacccttggaaccggccgtcgactcggaccgatg

SEQ ID NO: 14989 - DNA, 203 bp, Homo sapiens
  source 1..203: mol_type = other DNA
ggcgcgccagtcctccacattgatctgacacaactgtgttcactagcaacctcaaacagacaccatggtgcatctgactcctgaggagaagtctgccgttactgccctgtggggcacacggaatcgagaagaagttggtggtgaggccctgggcaggctgctggtggtctacccttggaccggcgggtcgactcggaccgatg

SEQ ID NO: 14990 - DNA, 203 bp, Homo sapiens
  source 1..203: mol_type = other DNA
ggcgcgccagtcctctcagcaatgctgacacaactgtgttcactagcaacctcaaacagacaccatggtgcatctgactcctgaggagaagtctgccgttactgccctgtggggcacgtcaattcctttagaagttggtggtgaggccctgggcaggctgctggtggtctacccttggaccggcgggtcgactcggaccgatg

SEQ ID NO: 14991 - DNA, 203 bp, Homo sapiens
  source 1..203: mol_type = other DNA
ggcgcgccagtcctaacgatcaatctgacacaactgtgttcactagcaacctcaaacagacaccatggtgcatctgactcctgaggagaagtctgccgttactgccctgtggttcttggcaaacgtggatgaagttggtggtgaggccctgggcaggctgctggtggtctacccttggaccggcgggtcgactcggaccgatg

SEQ ID NO: 14992 - DNA, 203 bp, Homo sapiens
  source 1..203: mol_type = other DNA
ggcgcgccagtccttctgattgctctgacacaactgtgttcactagcaacctcaaacagacaccatggtgcatctgactcctgaggagaagtctgccgttactgccctgtgtactcccgtgaacgtggatgaagttggtggtgaggccctgggcaggctgctggtggtctaccccacggaatcgagaacgactcggaccgatg

SEQ ID NO: 14993 - DNA, 203 bp, Homo sapiens
  source 1..203: mol_type = other DNA
ggcgcgccagtccttcgctcaatgctgacacaactgtgttcactagcaacctcaaacagacaccatggtgcatctgactcctgaggagaagtctgccgttactgccctgtgtactcccgtgaacgtggatgaagttggtggtgaggccctgggcaggctgctggtggtctaccccgtcaattcctttacgactcggaccgatg

SEQ ID NO: 14994 - DNA, 203 bp, Homo sapiens
  source 1..203: mol_type = other DNA
ggcgcgccagtcctttcattgattctgacacaactgtgttcactagcaacctcaaacagacaccatggtgcatctgactcctgaggagaagtctgccgttactgccctgtgtactcccgtgaacgtggatgaagttggtggtgaggccctgggcaggctgctggtggtctacccttggacccagaggtcgactcggaccgatg

SEQ ID NO: 14995 - DNA, 203 bp, Homo sapiens
  source 1..203: mol_type = other DNA
ggcgcgccagtcctactgtattgcctgacacaactgtgttcactagcaacctcaaacagacaccatggtgcatctgactcctgaggagaagtctgccgttactgccctgtgtactccggtgaacgtggatgaagttggtggtgaggccctgggcaggctgctggtggtctacccttggacccagaggtcgactcggaccgatg

SEQ ID NO: 14996 - DNA, 203 bp, Homo sapiens
  source 1..203: mol_type = other DNA
ggcgcgccagtcctcagagcaattctgacacaactgtgttcactagcaacctcaaacagacaccatggtgcatctgactcctgaggagaagtctgccgttactgcccttcttggcaaagtgaacgtggatgaagttggtggtgaggccctgggcaggctgctggtggtctaccccacggaatcgagaacgactcggaccgatg

SEQ ID NO: 14997 - DNA, 203 bp, Homo sapiens
  source 1..203: mol_type = other DNA
ggcgcgccagtcctcgcaatactcctgacacaactgtgttcactagcaacctcaaacagacaccatggtgcatctgactcctgaggagaagtctgccgttactgccggcgggtgcaaggtgaacgtggatgaagttggtggtgaggccctgggcaggcccggcgggttctacccttccggcgggtggtcgactcggaccgatg

SEQ ID NO: 14998 - DNA, 203 bp, Homo sapiens
  source 1..203: mol_type = other DNA
ggcgcgccagtcctgatcgattgtctgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 14999 - DNA, 203 bp, Homo sapiens
  source 1..203: mol_type = other DNA
ggcgcgccagtcctacattgaggtctgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 15000 - DNA, 203 bp, Homo sapiens
  source 1..203: mol_type = other DNA
ggcgcgccagtcctattgatcacactgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 15001 - DNA, 203 bp, Homo sapiens
  source 1..203: mol_type = other DNA
ggcgcgccagtcctcagcattgttctgacacaactgtgttcactagcaacctcaaacagacaccatggtgcatctgactcctgaggagaagtctgccgttactgccggcgggtgcaaggtgaccggcgggtaagttggtgccggcgggttgggcaggcccggcgggttctacccttccggcgggtggtcgactcggaccgatg

SEQ ID NO: 15002 - DNA, 203 bp, Homo sapiens
  source 1..203: mol_type = other DNA
ggcgcgccagtccttattgcatttctgacacaactgtgttcactagcaacctcaaacagacaccatggtgcatctgactcctgaggagaagtctgccgttactgccggcgggtgcaaggtgaccggcgggtaagttggtgccggcgggttgggcaggctgctggtggtctacccttggacccagaggtcgactcggaccgatg

SEQ ID NO: 15003 - DNA, 203 bp, Homo sapiens
  source 1..203: mol_type = other DNA
ggcgcgccagtcctacttgcaatgctgacacaactgtgttcactagcaacctcaaacagacaccatggtgcatctgactcctgaggagaagtctgccgttactgcgtcaattcctttagtgaacgtggatgaagttggtgcgtcaattcctttaaggctgctggtggtctacccttggacccagaggtcgactcggaccgatg

SEQ ID NO: 15004 - DNA, 203 bp, Homo sapiens
  source 1..203: mol_type = other DNA
ggcgcgccagtcctggtattgccactgacacaactgtgttcactagcaacctcaaacagacaccatggtgcatctgactcctgaggagaagtctgccgttactgcgtcaattcctttagtgaacgtggatgaagttggtggtgaggccctgggcaggctgctggtggtctaccccgtcaattcctttacgactcggaccgatg

SEQ ID NO: 15005 - DNA, 203 bp, Homo sapiens
  source 1..203: mol_type = other DNA
ggcgcgccagtcctttacacattgctgacacaactgtgttcactagcaacctcaaacagacaccatggtgcatctgactcctgaggagaagtctgccgttactgcgtcaattcctttagtgaacgtggatgaagttggtggtgaggccctgggcaggctgctggtggtctacccttggacccagaggtcgactcggaccgatg

SEQ ID NO: 15006 - DNA, 203 bp, Homo sapiens
  source 1..203: mol_type = other DNA
ggcgcgccagtcctgggtcaattcctgacacaactgtgttcactagcaacctcaaacagacaccatggtgcatctgactcctgaggagaagtctgccgttactgcgtcaattcctttagtgacgtcaattcctttaggtggtgaggccctgggcaggctgctggtggtctacccttggacccagaggtcgactcggaccgatg

SEQ ID NO: 15007 - DNA, 203 bp, Homo sapiens
  source 1..203: mol_type = other DNA
ggcgcgccagtccttgcattgagactgacacaactgtgttcactagcaacctcaaacagacaccatggtgcatctgactcctgaggagaagtctgccgttactgtactcccgggcaaggtgaacgtggatgaagttggtggtgaggccctgggcaggctactcccggtctacccttggacccagaggtcgactcggaccgatg

SEQ ID NO: 15008 - DNA, 203 bp, Homo sapiens
  source 1..203: mol_type = other DNA
ggcgcgccagtccttcaatttgaactgacacaactgtgttcactagcaacctcaaacagacaccatggtgcatctgactcctgaggagaagtctgccgttactgtactcccgggcaaggtgaacgtggatgaagttggtggtgaggccctgggcaggctactcccggtctaccctttactcccgaggtcgactcggaccgatg

SEQ ID NO: 15009 - DNA, 203 bp, Homo sapiens
  source 1..203: mol_type = other DNA
ggcgcgccagtcctaacagcaatactgacacaactgtgttcactagcaacctcaaacagacaccatggtgcatctgactcctgaggagaagtctgccgttactgtactcccgggcaaggtgaacgtggatgaagttggtggtgaggccctgggcaggctgctggtggtctaccccacggaatcgagaacgactcggaccgatg

SEQ ID NO: 15010 - DNA, 203 bp, Homo sapiens
  source 1..203: mol_type = other DNA
ggcgcgccagtcctgcaatctcttctgacacaactgtgttcactagcaacctcaaacagacaccatggtgcatctgactcctgaggagaagtctgccgttactgtactcccgggcaaggtgaacgtggatgaagttggtggtgaggccctgggcaggctgctggtggtctacccttggacctactccccgactcggaccgatg

SEQ ID NO: 15011 - DNA, 203 bp, Homo sapiens
  source 1..203: mol_type = other DNA
ggcgcgccagtcctcaatcgttgcctgacacaactgtgttcactagcaacctcaaacagacaccatggtgcatctgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 15012 - DNA, 203 bp, Homo sapiens
  source 1..203: mol_type = other DNA
ggcgcgccagtcctattgcaacgcctgacacaactgtgttcactagcaacctcaaacagacaccatggtgcatctgactcctgaggagaagtctgccgttactgtactcccgggcaaggtgatactccctgaagttggtggtgaggccctgggcaggctactcccggtctaccctttactcccgaggtcgactcggaccgatg

SEQ ID NO: 15013 - DNA, 203 bp, Homo sapiens
  source 1..203: mol_type = other DNA
ggcgcgccagtccttagtccattgctgacacaactgtgttcactagcaacctcaaacagacaccatggtgcatctgactcctgaggagaagtctgccgttactgtactcccgggcaaggtgatactccctgaagttggtgtactccccctgggcaggctactcccggtctaccctttactcccgaggtcgactcggaccgatg

SEQ ID NO: 15014 - DNA, 203 bp, Homo sapiens
  source 1..203: mol_type = other DNA
ggcgcgccagtcctcctgattgtcctgacacaactgtgttcactagcaacctcaaacagacaccatggtgcatctgactcctgaggagaagtctgccgttactgtactcccgggcaaggtgatactccctgaagttggtgtactccccctgggcaggctgctggtggtctaccctttactcccgaggtcgactcggaccgatg

SEQ ID NO: 15015 - DNA, 203 bp, Homo sapiens
  source 1..203: mol_type = other DNA
ggcgcgccagtcctgtcgtaagagctgacacaactgtgttcactagcaacctcaaacagacaccatggtgcatctgactcctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15016 - DNA, 203 bp, Homo sapiens
  source 1..203: mol_type = other DNA
ggcgcgccagtcctgtattcgtaactgacacaactgtgttcactagcaacctcaaacagacaccatggtgcatctgactcctgaggagaagtctgccgttactgttcttggcaaaaaggtgattcttggcaaagttggtgttcttggcaaaggcaggcttcttggcaaatacccttggacccagaggtcgactcggaccgatg

SEQ ID NO: 15017 - DNA, 203 bp, Homo sapiens
  source 1..203: mol_type = other DNA
ggcgcgccagtcctttcgtaacccctgacacaactgtgttcactagcaacctcaaacagacaccatggtgcatctgactcctgaggagaagtctgccgttactgtttgccaagaaaaggtgatttgccaagaagttggtgtttgccaagaaggcaggctttgccaagaatacccttggacccagaggtcgactcggaccgatg

SEQ ID NO: 15018 - DNA, 203 bp, Homo sapiens
  source 1..203: mol_type = other DNA
ggcgcgccagtcctacgttcgtaactgacacaactgtgttcactagcaacctcaaacagacaccatggtgcatctgactcctgaggagaagtctgccgttacttcactgtaccggccgtgcgtactggatgaagttggtggtgaggccctgggcaggctgctggtggtctacccttggacccagaggtcgactcggaccgatg

SEQ ID NO: 15019 - DNA, 203 bp, Homo sapiens
  source 1..203: mol_type = other DNA
ggcgcgccagtcctgggtcgtaaactgacacaactgtgttcactagcaacctcaaacagacaccatggtgcatctgactcctgaggagaagtctgccgttacttgcaaccatactccccccggaatggatgaagttggtggtgaggccctgggcaggctgctggtggtctacccttggacccagaggtcgactcggaccgatg

SEQ ID NO: 15020 - DNA, 203 bp, Homo sapiens
  source 1..203: mol_type = other DNA
ggcgcgccagtcctcttacgacgactgacacaactgtgttcactagcaacctcaaacagacaccatggtgcatctgactcctgaggagaagtctgccgttcgtcaattcctttacaaggtgaacgtggatgaagttggtggtgaggccctgggcaggctgctggtggtctacccttgttcttggcaaacgactcggaccgatg

SEQ ID NO: 15021 - DNA, 203 bp, Homo sapiens
  source 1..203: mol_type = other DNA
ggcgcgccagtcctagtatcgacgctgacacaactgtgttcactagcaacctcaaacagacaccatggtgcatctgactcctgaggagaagtctgccgttgcccttccgtcaattcctttaagtttcaatgaagttggtggtgaggccctgggcaggctgctggtggtctacccttggacccagaggtcgactcggaccgatg

SEQ ID NO: 15022 - DNA, 203 bp, Homo sapiens
  source 1..203: mol_type = other DNA
ggcgcgccagtcctacgtcgactcctgacacaactgtgttcactagcaacctcaaacagacaccatggtgcatctgactcctgaggagaagtctgccgtttactccctgtggggcaaggtgaacgtggatgaagttggtggtgaggccctgggcaggctgctggtggtctacccttgttcttggcaaacgactcggaccgatg

SEQ ID NO: 15023 - DNA, 203 bp, Homo sapiens
  source 1..203: mol_type = other DNA
ggcgcgccagtcctaagcaaggttctgacacaactgtgttcactagcaacctcaaacagacaccatggtgcatctgactcctgaggagaagtctgcctactcccccctgtggggcaaggtgaacgtggatgaagttggtggtgaggccctgggcaggctgctggtggtctaccccacggaatcgagaacgactcggaccgatg

SEQ ID NO: 15024 - DNA, 203 bp, Homo sapiens
  source 1..203: mol_type = other DNA
ggcgcgccagtcctacagaagcaactgacacaactgtgttcactagcaacctcaaacagacaccatggtgcatctgactcctgaggagaagtctgcctcccggaagctgcccggcgggtcatgggaataacaagttggtggtgaggccctgggcaggctgctggtggtctacccttggacccagaggtcgactcggaccgatg

SEQ ID NO: 15025 - DNA, 203 bp, Homo sapiens
  source 1..203: mol_type = other DNA
ggcgcgccagtcctccaagcaatcctgacacaactgtgttcactagcaacctcaaacagacaccatggtgcatctgactcctgaggagaagtctgcgcaccaccacccacggaatcgagaaagagctatcaaagttggtggtgaggccctgggcaggctgctggtggtctacccttggacccagaggtcgactcggaccgatg

SEQ ID NO: 15026 - DNA, 203 bp, Homo sapiens
  source 1..203: mol_type = other DNA
ggcgcgccagtccttattgcttggctgacacaactgtgttcactagcaacctcaaacagacaccatggtgcatctgactcctgaggagaagtctgctcagctttgcaaccatactccccccggaacccaaagagttggtggtgaggccctgggcaggctgctggtggtctacccttggacccagaggtcgactcggaccgatg

SEQ ID NO: 15027 - DNA, 203 bp, Homo sapiens
  source 1..203: mol_type = other DNA
ggcgcgccagtcctaatttgcttactgacacaactgtgttcactagcaacctcaaacagacaccatggtgcatctgactcctgaggagaagtctgctggtgcccttccgtcaattcctttaagtttcagcttagttggtggtgaggccctgggcaggctgctggtggtctacccttggacccagaggtcgactcggaccgatg

SEQ ID NO: 15028 - DNA, 203 bp, Homo sapiens
  source 1..203: mol_type = other DNA
ggcgcgccagtcctccttgcttcactgacacaactgtgttcactagcaacctcaaacagacaccatggtgcatctgactcctgaggagaagtctgcttcccggaagctgcccggcgggtcatgggaataacgagttggtggtgaggccctgggcaggctgctggtggtctacccttggacccagaggtcgactcggaccgatg

SEQ ID NO: 15029 - DNA, 203 bp, Homo sapiens
  source 1..203: mol_type = other DNA
ggcgcgccagtcctatgattgcttctgacacaactgtgttcactagcaacctcaaacagacaccatggtgcatctgactcctgaggagaagtctgcttcttggcaaatgtggggcaaggtgaacgtggatgaagttggtggtgaggccctgggcaggctgctggtggtctacccttgttcttggcaaacgactcggaccgatg

SEQ ID NO: 15030 - DNA, 203 bp, Homo sapiens
  source 1..203: mol_type = other DNA
ggcgcgccagtcctaagaaatggactgacacaactgtgttcactagcaacctcaaacagacaccatggtgcatctgactcctgaggagaagtcttcttggcaaaccctgtggggcaaggtgaacgtggatgaagttggtggtgaggccctgggcaggctgctggtggtctaccccacggaatcgagaacgactcggaccgatg

SEQ ID NO: 15031 - DNA, 203 bp, Homo sapiens
  source 1..203: mol_type = other DNA
ggcgcgccagtccttgtactgcccctgacacaactgtgttcactagcaacctcaaacagacaccatggtgcatctgactcctgaggagaagtcttttcagctttgcaaccatactccccccggaacccaaagacttggtggtgaggccctgggcaggctgctggtggtctacccttggacccagaggtcgactcggaccgatg

SEQ ID NO: 15032 - DNA, 203 bp, Homo sapiens
  source 1..203: mol_type = other DNA
ggcgcgccagtcctgggctcagcactgacacaactgtgttcactagcaacctcaaacagacaccatggtgcatctgactcctgaggagaatactcccgttactgccctgtggggcaaggtgaacgtggatgaagttggtggtgaggccctgggcaggctgctggtggtctaccccgtcaattcctttacgactcggaccgatg

SEQ ID NO: 15033 - DNA, 203 bp, Homo sapiens
  source 1..203: mol_type = other DNA
ggcgcgccagtcctgggctacgtcctgacacaactgtgttcactagcaacctcaaacagacaccatggtgcatctgactcctgaggagaatcctggtggtgcccttccgtcaattcctttaagtttcagctttgcaactggtgaggccctgggcaggctgctggtggtctacccttggacccagaggtcgactcggaccgatg

SEQ ID NO: 15034 - DNA, 203 bp, Homo sapiens
  source 1..203: mol_type = other DNA
ggcgcgccagtcctgggcagcactctgacacaactgtgttcactagcaacctcaaacagacaccatggtgcatctgactcctgaggagaattcttgattaatgaaaacattcttggcaaatgctttcgctctggtccgtggtgaggccctgggcaggctgctggtggtctacccttggacccagaggtcgactcggaccgatg

SEQ ID NO: 15035 - DNA, 203 bp, Homo sapiens
  source 1..203: mol_type = other DNA
ggcgcgccagtcctaccacgttgtctgacacaactgtgttcactagcaacctcaaacagacaccatggtgcatctgactcctgaggagaccggccgtgttactgccctgtggggcaaggtgaacgtggatgaagttggtggtgaggccctgggcaggctgctggtggtctacccttggacccagaggtcgactcggaccgatg

SEQ ID NO: 15036 - DNA, 203 bp, Homo sapiens
  source 1..203: mol_type = other DNA
ggcgcgccagtcctctgaaactctctgacacaactgtgttcactagcaacctcaaacagacaccatggtgcatctgactcctgaggagactcctggtggtgcccttccgtcaattcctttaagtttcagctttgcaaccagtgaggccctgggcaggctgctggtggtctacccttggacccagaggtcgactcggaccgatg

SEQ ID NO: 15037 - DNA, 203 bp, Homo sapiens
  source 1..203: mol_type = other DNA
ggcgcgccagtcctatccacgaagctgacacaactgtgttcactagcaacctcaaacagacaccatggtgcatctgactcctgaggagactttggtttcccggaagctgcccggcgggtcatgggaataacgccgccgcatcgaggccctgggcaggctgctggtggtctacccttggacccagaggtcgactcggaccgatg

SEQ ID NO: 15038 - DNA, 203 bp, Homo sapiens
  source 1..203: mol_type = other DNA
ggcgcgccagtccttccacgaagactgacacaactgtgttcactagcaacctcaaacagacaccatggtgcatctgactcctgaggagattaagtttcagctttgcaaccatactccccccggaacccaaagactttggggtgaggccctgggcaggctgctggtggtctacccttggacccagaggtcgactcggaccgatg

SEQ ID NO: 15039 - DNA, 203 bp, Homo sapiens
  source 1..203: mol_type = other DNA
ggcgcgccagtcctagttcgtgttctgacacaactgtgttcactagcaacctcaaacagacaccatggtgcatctgactcctgaggagcacggaatcgagaatgccctgtggggcaaggtgaacgtggatgaagttggtggtgaggccctgggcaggctgctggtggtctacccttggaccggcgggtcgactcggaccgatg

SEQ ID NO: 15040 - DNA, 203 bp, Homo sapiens
  source 1..203: mol_type = other DNA
ggcgcgccagtcctacgcactgcgctgacacaactgtgttcactagcaacctcaaacagacaccatggtgcatctgactcctgaggagctccctgccgttactgagctcccgggcaaggtgaagctccctgaagttggtgagctccccctgggcaggcagctcccggtctacccttggacccagaggtcgactcggaccgatg

SEQ ID NO: 15041 - DNA, 203 bp, Homo sapiens
  source 1..203: mol_type = other DNA
ggcgcgccagtcctcttgctgcatctgacacaactgtgttcactagcaacctcaaacagacaccatggtgcatctgactcctgaggagggcgggtccgttactgagggcgggtgcaaggtgaagggcgggtaagttggtgagggcgggttgggcaggcagggcgggttctacccttggacccagaggtcgactcggaccgatg

SEQ ID NO: 15042 - DNA, 203 bp, Homo sapiens
  source 1..203: mol_type = other DNA
ggcgcgccagtcctcttgttacacctgacacaactgtgttcactagcaacctcaaacagacaccatggtgcatctgactcctgaggagtactcccccgttactgccctgtggggcaaggtgaacgtggatgaagttggtggtgaggccctgggcaggctgctggtggtctacccttggaccggcgggtcgactcggaccgatg

SEQ ID NO: 15043 - DNA, 203 bp, Homo sapiens
  source 1..203: mol_type = other DNA
ggcgcgccagtcctagtgtaagagctgacacaactgtgttcactagcaacctcaaacagacaccatggtgcatctgactcctgaggagtcaattcctttaactgagtcaattcctttagtgaagtcaattcctttaggtgagtcaattcctttaaggcagtcaattcctttaccttggacccagaggtcgactcggaccgatg

SEQ ID NO: 15044 - DNA, 203 bp, Homo sapiens
  source 1..203: mol_type = other DNA
ggcgcgccagtcctcgagcgtatgctgacacaactgtgttcactagcaacctcaaacagacaccatggtgcatctgactcctgaggatcggccgtccgttactgatcggccgtgcaaggtgaatcggccgtaagttggtgatcggccgttgggcaggcatcggccgttctacccttggacccagaggtcgactcggaccgatg

SEQ ID NO: 15045 - DNA, 203 bp, Homo sapiens
  source 1..203: mol_type = other DNA
ggcgcgccagtcctttcatacgctctgacacaactgtgttcactagcaacctcaaacagacaccatggtgcatctgactcctgaggatcgttcttgattaatgaaaacattcttggcaaatgctttcgctctggtccgtcttgaggccctgggcaggctgctggtggtctacccttggacccagaggtcgactcggaccgatg

SEQ ID NO: 15046 - DNA, 203 bp, Homo sapiens
  source 1..203: mol_type = other DNA
ggcgcgccagtcctacagtacgggctgacacaactgtgttcactagcaacctcaaacagacaccatggtgcatctgactcctgaggattcaattcctttaactgattcaattcctttagtgaattcaattcctttaggtgattcaattcctttaaggcattcaattcctttaccttggacccagaggtcgactcggaccgatg

SEQ ID NO: 15047 - DNA, 203 bp, Homo sapiens
  source 1..203: mol_type = other DNA
ggcgcgccagtcctcaccaacgggctgacacaactgtgttcactagcaacctcaaacagacaccatggtgcatctgactcctgaggcaacgaatcgagaaactgcaacgaatcgagaagtgacaacgaatcgagaaggtgcaacgaatcgagaaaggccaacgaatcgagaaccttggacccagaggtcgactcggaccgatg

SEQ ID NO: 15048 - DNA, 203 bp, Homo sapiens
  source 1..203: mol_type = other DNA
ggcgcgccagtcctcccgtttggactgacacaactgtgttcactagcaacctcaaacagacaccatggtgcatctgactcctgaggcacagaatcgagaaactgcacagaatcgagaagtgacacagaatcgagaaggtgcacagaatcgagaaaggccacagaatcgagaaccttggacccagaggtcgactcggaccgatg

SEQ ID NO: 15049 - DNA, 203 bp, Homo sapiens
  source 1..203: mol_type = other DNA
ggcgcgccagtcctagtcgacgggctgacacaactgtgttcactagcaacctcaaacagacaccatggtgcatctgactcctgaggcacgaaatcgagaaactgcacgaaatcgagaagtgacacgaaatcgagaaggtgcacgaaatcgagaaaggccacgaaatcgagaaccttggacccagaggtcgactcggaccgatg

SEQ ID NO: 15050 - DNA, 203 bp, Homo sapiens
  source 1..203: mol_type = other DNA
ggcgcgccagtcctcccgttaaagctgacacaactgtgttcactagcaacctcaaacagacaccatggtgcatctgactcctgaggcacgatatcgagaaactgcacgatatcgagaagtgacacgatatcgagaaggtgcacgatatcgagaaaggccacgatatcgagaaccttggacccagaggtcgactcggaccgatg

SEQ ID NO: 15051 - DNA, 203 bp, Homo sapiens
  source 1..203: mol_type = other DNA
ggcgcgccagtcctgcttctaactctgacacaactgtgttcactagcaacctcaaacagacaccatggtgcatctgactcctgaggcacggaaccgagaaactgcacggaaccgagaagtgacacggaaccgagaaggtgcacggaaccgagaaaggccacggaaccgagaaccttggacccagaggtcgactcggaccgatg

SEQ ID NO: 15052 - DNA, 203 bp, Homo sapiens
  source 1..203: mol_type = other DNA
ggcgcgccagtcctttagaatggtctgacacaactgtgttcactagcaacctcaaacagacaccatggtgcatctgactcctgaggcacggaatcaagaaactgcacggaatcaagaagtgacacggaatcaagaaggtgcacggaatcaagaaaggccacggaatcaagaaccttggacccagaggtcgactcggaccgatg

SEQ ID NO: 15053 - DNA, 203 bp, Homo sapiens
  source 1..203: mol_type = other DNA
ggcgcgccagtcctcgccttagaactgacacaactgtgttcactagcaacctcaaacagacaccatggtgcatctgactcctgaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 15054 - DNA, 203 bp, Homo sapiens
  source 1..203: mol_type = other DNA
ggcgcgccagtcctttagaaacacctgacacaactgtgttcactagcaacctcaaacagacaccatggtgcatctgactcctgaggcacggaatcgagaaactgcacggaatcgagaagtgacacggaatcgagaaggtgcacggaatcgagaaaggccacggaatcgagaaccttggacccagaggtcgactcggaccgatg

SEQ ID NO: 15055 - DNA, 203 bp, Homo sapiens
  source 1..203: mol_type = other DNA
ggcgcgccagtcctagtgtgtacgctgacacaactgtgttcactagcaacctcaaacagacaccatggtgcatctgactcctgaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 15056 - DNA, 203 bp, Homo sapiens
  source 1..203: mol_type = other DNA
ggcgcgccagtcctagtgcacgtcctgacacaactgtgttcactagcaacctcaaacagacaccatggtgcatctgactcctgaggcacggaatcgagaaactgccctgtggggcaaggtgaacgtggatgaagttggtgcacggaatcgagaaaggccacggaatcgagaaccttggacccagaggtcgactcggaccgatg

SEQ ID NO: 15057 - DNA, 203 bp, Homo sapiens
  source 1..203: mol_type = other DNA
ggcgcgccagtcctaaacaaggccctgacacaactgtgttcactagcaacctcaaacagacaccatggtgcatctgactcctgaggcacggaatcgagaaactgccctgtggggcaaggtgacacggaatcgagaaggtgcacggaatcgagaaaggctgctggtggtctacccttggacccagaggtcgactcggaccgatg

SEQ ID NO: 15058 - DNA, 203 bp, Homo sapiens
  source 1..203: mol_type = other DNA
ggcgcgccagtcctatcatgcagtctgacacaactgtgttcactagcaacctcaaacagacaccatggtgcatctgactcctgaggcacggaatcgagagactgcacggaatcgagaggtgacacggaatcgagagggtgcacggaatcgagagaggccacggaatcgagagccttggacccagaggtcgactcggaccgatg

SEQ ID NO: 15059 - DNA, 203 bp, Homo sapiens
  source 1..203: mol_type = other DNA
ggcgcgccagtcctgtaaagactgctgacacaactgtgttcactagcaacctcaaacagacaccatggtgcatctgactcctgaggcacggaatcgagctactgcacggaatcgagctgtgacacggaatcgagctggtgcacggaatcgagctaggccacggaatcgagctccttggacccagaggtcgactcggaccgatg

SEQ ID NO: 15060 - DNA, 203 bp, Homo sapiens
  source 1..203: mol_type = other DNA
ggcgcgccagtcctggcctgggacctgacacaactgtgttcactagcaacctcaaacagacaccatggtgcatctgactcctgaggcacggaatcgaggcactgcacggaatcgaggcgtgacacggaatcgaggcggtgcacggaatcgaggcaggccacggaatcgaggcccttggacccagaggtcgactcggaccgatg

SEQ ID NO: 15061 - DNA, 203 bp, Homo sapiens
  source 1..203: mol_type = other DNA
ggcgcgccagtcctatacgtgcttctgacacaactgtgttcactagcaacctcaaacagacaccatggtgcatctgactcctgaggcacggaatcgaggtactgcacggaatcgaggtgtgacacggaatcgaggtggtgcacggaatcgaggtaggccacggaatcgaggtccttggacccagaggtcgactcggaccgatg

SEQ ID NO: 15062 - DNA, 203 bp, Homo sapiens
  source 1..203: mol_type = other DNA
ggcgcgccagtcctgtaaatgactctgacacaactgtgttcactagcaacctcaaacagacaccatggtgcatctgactcctgaggcacggaatcgcgaaactgcacggaatcgcgaagtgacacggaatcgcgaaggtgcacggaatcgcgaaaggccacggaatcgcgaaccttggacccagaggtcgactcggaccgatg

SEQ ID NO: 15063 - DNA, 203 bp, Homo sapiens
  source 1..203: mol_type = other DNA
ggcgcgccagtccttaaatctctgctgacacaactgtgttcactagcaacctcaaacagacaccatggtgcatctgactcctgaggcacggaatcgggaaactgcacggaatcgggaagtgacacggaatcgggaaggtgcacggaatcgggaaaggccacggaatcgggaaccttggacccagaggtcgactcggaccgatg

SEQ ID NO: 15064 - DNA, 203 bp, Homo sapiens
  source 1..203: mol_type = other DNA
ggcgcgccagtcctagatttaggactgacacaactgtgttcactagcaacctcaaacagacaccatggtgcatctgactcctgaggcacggaatcgtgaaactgcacggaatcgtgaagtgacacggaatcgtgaaggtgcacggaatcgtgaaaggccacggaatcgtgaaccttggacccagaggtcgactcggaccgatg

SEQ ID NO: 15065 - DNA, 203 bp, Homo sapiens
  source 1..203: mol_type = other DNA
ggcgcgccagtcctcatttacttcctgacacaactgtgttcactagcaacctcaaacagacaccatggtgcatctgactcctgaggcacggaatggagaaactgcacggaatggagaagtgacacggaatggagaaggtgcacggaatggagaaaggccacggaatggagaaccttggacccagaggtcgactcggaccgatg

SEQ ID NO: 15066 - DNA, 203 bp, Homo sapiens
  source 1..203: mol_type = other DNA
ggcgcgccagtcctctctaaatcgctgacacaactgtgttcactagcaacctcaaacagacaccatggtgcatctgactcctgaggcacggaattaagaaactgcacggaattaagaagtgacacggaattaagaaggtgcacggaattaagaaaggccacggaattaagaaccttggacccagaggtcgactcggaccgatg

SEQ ID NO: 15067 - DNA, 203 bp, Homo sapiens
  source 1..203: mol_type = other DNA
ggcgcgccagtcctaatttaggacctgacacaactgtgttcactagcaacctcaaacagacaccatggtgcatctgactcctgaggcacggaattgagaaactgcacggaattgagaagtgacacggaattgagaaggtgcacggaattgagaaaggccacggaattgagaaccttggacccagaggtcgactcggaccgatg

SEQ ID NO: 15068 - DNA, 203 bp, Homo sapiens
  source 1..203: mol_type = other DNA
ggcgcgccagtcctgaaagtgattctgacacaactgtgttcactagcaacctcaaacagacaccatggtgcatctgactcctgaggcacggccgtccgttactgcacggccgtgcaaggtgacacggccgtaagttggtgcacggccgttgggcaggccacggccgttctacccttggacccagaggtcgactcggaccgatg

SEQ ID NO: 15069 - DNA, 203 bp, Homo sapiens
  source 1..203: mol_type = other DNA
ggcgcgccagtcctcgttcaagatctgacacaactgtgttcactagcaacctcaaacagacaccatggtgcatctgactcctgaggcacgggatcgagaaactgcacgggatcgagaagtgacacgggatcgagaaggtgcacgggatcgagaaaggccacgggatcgagaaccttggacccagaggtcgactcggaccgatg

SEQ ID NO: 15070 - DNA, 203 bp, Homo sapiens
  source 1..203: mol_type = other DNA
ggcgcgccagtcctagatttggttctgacacaactgtgttcactagcaacctcaaacagacaccatggtgcatctgactcctgaggcactccctgccgttactgcactcccgggcaaggtgacactccctgaagttggtgcactccccctgggcaggccactcccggtctacccttggacccagaggtcgactcggaccgatg

SEQ ID NO: 15071 - DNA, 203 bp, Homo sapiens
  source 1..203: mol_type = other DNA
ggcgcgccagtccttttaaccaacctgacacaactgtgttcactagcaacctcaaacagacaccatggtgcatctgactcctgaggcagagaatcgagaaactgcagagaatcgagaagtgacagagaatcgagaaggtgcagagaatcgagaaaggccagagaatcgagaaccttggacccagaggtcgactcggaccgatg

SEQ ID NO: 15072 - DNA, 203 bp, Homo sapiens
  source 1..203: mol_type = other DNA
ggcgcgccagtcctccaaccaagtctgacacaactgtgttcactagcaacctcaaacagacaccatggtgcatctgactcctgaggcagcgaatcgagaaactgcagcgaatcgagaagtgacagcgaatcgagaaggtgcagcgaatcgagaaaggccagcgaatcgagaaccttggacccagaggtcgactcggaccgatg

SEQ ID NO: 15073 - DNA, 203 bp, Homo sapiens
  source 1..203: mol_type = other DNA
ggcgcgccagtccttctgcgagcgctgacacaactgtgttcactagcaacctcaaacagacaccatggtgcatctgactcctgaggcatggaatcgagaaactgcatggaatcgagaagtgacatggaatcgagaaggtgcatggaatcgagaaaggccatggaatcgagaaccttggacccagaggtcgactcggaccgatg

SEQ ID NO: 15074 - DNA, 203 bp, Homo sapiens
  source 1..203: mol_type = other DNA
ggcgcgccagtccttgcgaggacgctgacacaactgtgttcactagcaacctcaaacagacaccatggtgcatctgactcctgaggcattgaatcgagaaactgcattgaatcgagaagtgacattgaatcgagaaggtgcattgaatcgagaaaggccattgaatcgagaaccttggacccagaggtcgactcggaccgatg

SEQ ID NO: 15075 - DNA, 203 bp, Homo sapiens
  source 1..203: mol_type = other DNA
ggcgcgccagtccttctttgcgagctgacacaactgtgttcactagcaacctcaaacagacaccatggtgcatctgactcctgaggccatcgggtccgttactgccatcgggtgcaaggtgaccatcgggtaagttggtgccatcgggttgggcaggcccatcgggttctacccttggacccagaggtcgactcggaccgatg

SEQ ID NO: 15076 - DNA, 203 bp, Homo sapiens
  source 1..203: mol_type = other DNA
ggcgcgccagtcctggcgagctaactgacacaactgtgttcactagcaacctcaaacagacaccatggtgcatctgactcctgaggccctccctgccgttactgccctcccgggcaaggtgaccctccctgaagttggtgccctccccctgggcaggcccctcccggtctacccttggacccagaggtcgactcggaccgatg

SEQ ID NO: 15077 - DNA, 203 bp, Homo sapiens
  source 1..203: mol_type = other DNA
ggcgcgccagtcctaagagcgagtctgacacaactgtgttcactagcaacctcaaacagacaccatggtgcatctgactcctgaggccctcgggtccgttactgccctcgggtgcaaggtgaccctcgggtaagttggtgccctcgggttgggcaggcccctcgggttctacccttggacccagaggtcgactcggaccgatg

SEQ ID NO: 15078 - DNA, 203 bp, Homo sapiens
  source 1..203: mol_type = other DNA
ggcgcgccagtcctgcctgcgagcctgacacaactgtgttcactagcaacctcaaacagacaccatggtgcatctgactcctgaggccgacgggtccgttactgccgacgggtgcaaggtgaccgacgggtaagttggtgccgacgggttgggcaggcccgacgggttctacccttggacccagaggtcgactcggaccgatg

SEQ ID NO: 15079 - DNA, 203 bp, Homo sapiens
  source 1..203: mol_type = other DNA
ggcgcgccagtcctgtgctgcgagctgacacaactgtgttcactagcaacctcaaacagacaccatggtgcatctgactcctgaggccggaaggtccgttactgccggaaggtgcaaggtgaccggaaggtaagttggtgccggaaggttgggcaggcccggaaggttctacccttggacccagaggtcgactcggaccgatg

SEQ ID NO: 15080 - DNA, 203 bp, Homo sapiens
  source 1..203: mol_type = other DNA
ggcgcgccagtcctctcgcaaactctgacacaactgtgttcactagcaacctcaaacagacaccatggtgcatctgactcctgaggccggatggtccgttactgccggatggtgcaaggtgaccggatggtaagttggtgccggatggttgggcaggcccggatggttctacccttggacccagaggtcgactcggaccgatg

SEQ ID NO: 15081 - DNA, 203 bp, Homo sapiens
  source 1..203: mol_type = other DNA
ggcgcgccagtcctgtgacctcgcctgacacaactgtgttcactagcaacctcaaacagacaccatggtgcatctgactcctgaggccggcaggtccgttactgccggcaggtgcaaggtgaccggcaggtaagttggtgccggcaggttgggcaggcccggcaggttctacccttggacccagaggtcgactcggaccgatg

SEQ ID NO: 15082 - DNA, 203 bp, Homo sapiens
  source 1..203: mol_type = other DNA
ggcgcgccagtccttcactcgcatctgacacaactgtgttcactagcaacctcaaacagacaccatggtgcatctgactcctgaggccggcgcatccgttactgccggcgcatgcaaggtgaccggcgcataagttggtgccggcgcattgggcaggcccggcgcattctacccttggacccagaggtcgactcggaccgatg

SEQ ID NO: 15083 - DNA, 203 bp, Homo sapiens
  source 1..203: mol_type = other DNA
ggcgcgccagtcctaggcctcgccctgacacaactgtgttcactagcaacctcaaacagacaccatggtgcatctgactcctgaggccggcgcctccgttactgccggcgcctgcaaggtgaccggcgcctaagttggtgccggcgccttgggcaggcccggcgccttctacccttggacccagaggtcgactcggaccgatg

SEQ ID NO: 15084 - DNA, 203 bp, Homo sapiens
  source 1..203: mol_type = other DNA
ggcgcgccagtcctcctctcgctcctgacacaactgtgttcactagcaacctcaaacagacaccatggtgcatctgactcctgaggccggcgcgtccgttactgccggcgcgtgcaaggtgaccggcgcgtaagttggtgccggcgcgttgggcaggcccggcgcgttctacccttggacccagaggtcgactcggaccgatg

SEQ ID NO: 15085 - DNA, 203 bp, Homo sapiens
  source 1..203: mol_type = other DNA
ggcgcgccagtcctcccgtctcgcctgacacaactgtgttcactagcaacctcaaacagacaccatggtgcatctgactcctgaggccggcggaaccgttactgccggcggaagcaaggtgaccggcggaaaagttggtgccggcggaatgggcaggcccggcggaatctacccttggacccagaggtcgactcggaccgatg

SEQ ID NO: 15086 - DNA, 203 bp, Homo sapiens
  source 1..203: mol_type = other DNA
ggcgcgccagtcctctactcgcagctgacacaactgtgttcactagcaacctcaaacagacaccatggtgcatctgactcctgaggccggcggccccgttactgccggcggccgcaaggtgaccggcggccaagttggtgccggcggcctgggcaggcccggcggcctctacccttggacccagaggtcgactcggaccgatg

SEQ ID NO: 15087 - DNA, 203 bp, Homo sapiens
  source 1..203: mol_type = other DNA
ggcgcgccagtcctcccagacgacctgacacaactgtgttcactagcaacctcaaacagacaccatggtgcatctgactcctgaggccggcgggtccgttactgccctgtggggcaaggtgaacgtggatgaagttggtggtgaggccctgggcaggctgctggtggtctacccttggaaccggccgtcgactcggaccgatg

SEQ ID NO: 15088 - DNA, 203 bp, Homo sapiens
  source 1..203: mol_type = other DNA
ggcgcgccagtcctcccagagccactgacacaactgtgttcactagcaacctcaaacagacaccatggtgcatctgactcctgaggccggcgggtccgttactgccctgtggggcaaggtgaccggcgggtaagttggtgccggcgggttgggcaggcccggcgggttctacccttggacccagaggtcgactcggaccgatg

SEQ ID NO: 15089 - DNA, 203 bp, Homo sapiens
  source 1..203: mol_type = other DNA
ggcgcgccagtcctcggtgaccagctgacacaactgtgttcactagcaacctcaaacagacaccatggtgcatctgactcctgaggccggcgggtccgttactgccctgtggggcaaggtgaccggcgggtaagttggtggtgaggccctgggcaggctgctggtggtctacccttccggcgggtggtcgactcggaccgatg

SEQ ID NO: 15090 - DNA, 203 bp, Homo sapiens
  source 1..203: mol_type = other DNA
ggcgcgccagtcctcggcggttgtctgacacaactgtgttcactagcaacctcaaacagacaccatggtgcatctgactcctgaggccggcgggtccgttactgccctgtggggcaaggtgaccggcgggtaagttggtggtgaggccctgggcaggctgctggtggtctacccttggacccagaggtcgactcggaccgatg

SEQ ID NO: 15091 - DNA, 203 bp, Homo sapiens
  source 1..203: mol_type = other DNA
ggcgcgccagtcctcggtctgcccctgacacaactgtgttcactagcaacctcaaacagacaccatggtgcatctgactcctgaggccggcgggtccgttactgccggcgggtgcaaggtgaacgtggatgaagttggtggtgaggccctgggcaggcccggcgggttctacccttggacccagaggtcgactcggaccgatg

SEQ ID NO: 15092 - DNA, 203 bp, Homo sapiens
  source 1..203: mol_type = other DNA
ggcgcgccagtcctgcaaggaccgctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15093 - DNA, 203 bp, Homo sapiens
  source 1..203: mol_type = other DNA
ggcgcgccagtcctgtacgtagcgctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15094 - DNA, 203 bp, Homo sapiens
  source 1..203: mol_type = other DNA
ggcgcgccagtccttgttaagtgactgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15095 - DNA, 203 bp, Homo sapiens
  source 1..203: mol_type = other DNA
ggcgcgccagtccttttaaggatactgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15096 - DNA, 203 bp, Homo sapiens
  source 1..203: mol_type = other DNA
ggcgcgccagtcctgtttaagacactgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15097 - DNA, 203 bp, Homo sapiens
  source 1..203: mol_type = other DNA
ggcgcgccagtcctcgacttaaagctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15098 - DNA, 203 bp, Homo sapiens
  source 1..203: mol_type = other DNA
ggcgcgccagtcctcttaaagtttctgacacaactgtgttcactagcaacctcaaacagacaccatggtgcatctgactcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15099 - DNA, 203 bp, Homo sapiens
  source 1..203: mol_type = other DNA
ggcgcgccagtcctatgctgcagactgacacaactgtgttcactagcaacctcaaacagacaccatggtgcatctgactcctgaggccggcggtaccgttactgccggcggtagcaaggtgaccggcggtaaagttggtgccggcggtatgggcaggcccggcggtatctacccttggacccagaggtcgactcggaccgatg

SEQ ID NO: 15100 - DNA, 203 bp, Homo sapiens
  source 1..203: mol_type = other DNA
ggcgcgccagtcctgaatgtccaactgacacaactgtgttcactagcaacctcaaacagacaccatggtgcatctgactcctgaggccggcggtcccgttactgccggcggtcgcaaggtgaccggcggtcaagttggtgccggcggtctgggcaggcccggcggtctctacccttggacccagaggtcgactcggaccgatg

SEQ ID NO: 15101 - DNA, 203 bp, Homo sapiens
  source 1..203: mol_type = other DNA
ggcgcgccagtcctcacgaaaggtctgacacaactgtgttcactagcaacctcaaacagacaccatggtgcatctgactcctgaggccggcgtctccgttactgccggcgtctgcaaggtgaccggcgtctaagttggtgccggcgtcttgggcaggcccggcgtcttctacccttggacccagaggtcgactcggaccgatg

SEQ ID NO: 15102 - DNA, 203 bp, Homo sapiens
  source 1..203: mol_type = other DNA
ggcgcgccagtcctaatcacgaaactgacacaactgtgttcactagcaacctcaaacagacaccatggtgcatctgactcctgaggccggcgtgtccgttactgccggcgtgtgcaaggtgaccggcgtgtaagttggtgccggcgtgttgggcaggcccggcgtgttctacccttggacccagaggtcgactcggaccgatg

SEQ ID NO: 15103 - DNA, 203 bp, Homo sapiens
  source 1..203: mol_type = other DNA
ggcgcgccagtcctgactttcgtgctgacacaactgtgttcactagcaacctcaaacagacaccatggtgcatctgactcctgaggccggcgtttccgttactgccggcgtttgcaaggtgaccggcgtttaagttggtgccggcgttttgggcaggcccggcgttttctacccttggacccagaggtcgactcggaccgatg

SEQ ID NO: 15104 - DNA, 203 bp, Homo sapiens
  source 1..203: mol_type = other DNA
ggcgcgccagtcctcgatttcgtgctgacacaactgtgttcactagcaacctcaaacagacaccatggtgcatctgactcctgaggccggctggtccgttactgccggctggtgcaaggtgaccggctggtaagttggtgccggctggttgggcaggcccggctggttctacccttggacccagaggtcgactcggaccgatg

SEQ ID NO: 15105 - DNA, 203 bp, Homo sapiens
  source 1..203: mol_type = other DNA
ggcgcgccagtcctacctggatcactgacacaactgtgttcactagcaacctcaaacagacaccatggtgcatctgactcctgaggccggggggtccgttactgccggggggtgcaaggtgaccggggggtaagttggtgccggggggttgggcaggcccggggggttctacccttggacccagaggtcgactcggaccgatg

SEQ ID NO: 15106 - DNA, 203 bp, Homo sapiens
  source 1..203: mol_type = other DNA
ggcgcgccagtcctcttacatgtcctgacacaactgtgttcactagcaacctcaaacagacaccatggtgcatctgactcctgaggcctacgggtccgttactgcctacgggtgcaaggtgacctacgggtaagttggtgcctacgggttgggcaggccctacgggttctacccttggacccagaggtcgactcggaccgatg

SEQ ID NO: 15107 - DNA, 203 bp, Homo sapiens
  source 1..203: mol_type = other DNA
ggcgcgccagtccttcttacatgcctgacacaactgtgttcactagcaacctcaaacagacaccatggtgcatctgactcctgaggcctcaattcctttaactgcctcaattcctttagtgacctcaattcctttaggtgcctcaattcctttaaggccctcaattcctttaccttggacccagaggtcgactcggaccgatg

SEQ ID NO: 15108 - DNA, 203 bp, Homo sapiens
  source 1..203: mol_type = other DNA
ggcgcgccagtcctttacagatcactgacacaactgtgttcactagcaacctcaaacagacaccatggtgcatctgactcctgaggcctgcgggtccgttactgcctgcgggtgcaaggtgacctgcgggtaagttggtgcctgcgggttgggcaggccctgcgggttctacccttggacccagaggtcgactcggaccgatg

SEQ ID NO: 15109 - DNA, 203 bp, Homo sapiens
  source 1..203: mol_type = other DNA
ggcgcgccagtccttctacagatcctgacacaactgtgttcactagcaacctcaaacagacaccatggtgcatctgactcctgaggccttcgggtccgttactgccttcgggtgcaaggtgaccttcgggtaagttggtgccttcgggttgggcaggcccttcgggttctacccttggacccagaggtcgactcggaccgatg

SEQ ID NO: 15110 - DNA, 203 bp, Homo sapiens
  source 1..203: mol_type = other DNA
ggcgcgccagtcctagcattgcccctgacacaactgtgttcactagcaacctcaaacagacaccatggtgcatctgactcctgaggcgacaattcctttaactgcgacaattcctttagtgacgacaattcctttaggtgcgacaattcctttaaggccgacaattcctttaccttggacccagaggtcgactcggaccgatg

SEQ ID NO: 15111 - DNA, 203 bp, Homo sapiens
  source 1..203: mol_type = other DNA
ggcgcgccagtcctgaagtactgtctgacacaactgtgttcactagcaacctcaaacagacaccatggtgcatctgactcctgaggcgcggaatcgagaaactgcgcggaatcgagaagtgacgcggaatcgagaaggtgcgcggaatcgagaaaggccgcggaatcgagaaccttggacccagaggtcgactcggaccgatg

SEQ ID NO: 15112 - DNA, 203 bp, Homo sapiens
  source 1..203: mol_type = other DNA
ggcgcgccagtccttaggtgtagtctgacacaactgtgttcactagcaacctcaaacagacaccatggtgcatctgactcctgaggcgctccctgccgttactgcgctcccgggcaaggtgacgctccctgaagttggtgcgctccccctgggcaggccgctcccggtctacccttggacccagaggtcgactcggaccgatg

SEQ ID NO: 15113 - DNA, 203 bp, Homo sapiens
  source 1..203: mol_type = other DNA
ggcgcgccagtcctgcttacacctctgacacaactgtgttcactagcaacctcaaacagacaccatggtgcatctgactcctgaggcgcttggcaaagttactgcgcttggcaaaaaggtgacgcttggcaaagttggtgcgcttggcaaaggcaggccgcttggcaaatacccttggacccagaggtcgactcggaccgatg

SEQ ID NO: 15114 - DNA, 203 bp, Homo sapiens
  source 1..203: mol_type = other DNA
ggcgcgccagtcctgcatatgtggctgacacaactgtgttcactagcaacctcaaacagacaccatggtgcatctgactcctgaggcgtcaaagcctttaactgcgtcaaagcctttagtgacgtcaaagcctttaggtgcgtcaaagcctttaaggccgtcaaagcctttaccttggacccagaggtcgactcggaccgatg

SEQ ID NO: 15115 - DNA, 203 bp, Homo sapiens
  source 1..203: mol_type = other DNA
ggcgcgccagtcctgatatcttacctgacacaactgtgttcactagcaacctcaaacagacaccatggtgcatctgactcctgaggcgtcaaatcctttaactgcgtcaaatcctttagtgacgtcaaatcctttaggtgcgtcaaatcctttaaggccgtcaaatcctttaccttggacccagaggtcgactcggaccgatg

SEQ ID NO: 15116 - DNA, 203 bp, Homo sapiens
  source 1..203: mol_type = other DNA
ggcgcgccagtcctggcagaatatctgacacaactgtgttcactagcaacctcaaacagacaccatggtgcatctgactcctgaggcgtcaacacctttaactgcgtcaacacctttagtgacgtcaacacctttaggtgcgtcaacacctttaaggccgtcaacacctttaccttggacccagaggtcgactcggaccgatg

SEQ ID NO: 15117 - DNA, 203 bp, Homo sapiens
  source 1..203: mol_type = other DNA
ggcgcgccagtcctatatcgtgccctgacacaactgtgttcactagcaacctcaaacagacaccatggtgcatctgactcctgaggcgtcaacccctttaactgcgtcaacccctttagtgacgtcaacccctttaggtgcgtcaacccctttaaggccgtcaacccctttaccttggacccagaggtcgactcggaccgatg

SEQ ID NO: 15118 - DNA, 203 bp, Homo sapiens
  source 1..203: mol_type = other DNA
ggcgcgccagtcctgaatattgccctgacacaactgtgttcactagcaacctcaaacagacaccatggtgcatctgactcctgaggcgtcaacgcctttaactgcgtcaacgcctttagtgacgtcaacgcctttaggtgcgtcaacgcctttaaggccgtcaacgcctttaccttggacccagaggtcgactcggaccgatg

SEQ ID NO: 15119 - DNA, 203 bp, Homo sapiens
  source 1..203: mol_type = other DNA
ggcgcgccagtccttgcatatcccctgacacaactgtgttcactagcaacctcaaacagacaccatggtgcatctgactcctgaggcgtcaagacctttaactgcgtcaagacctttagtgacgtcaagacctttaggtgcgtcaagacctttaaggccgtcaagacctttaccttggacccagaggtcgactcggaccgatg

SEQ ID NO: 15120 - DNA, 203 bp, Homo sapiens
  source 1..203: mol_type = other DNA
ggcgcgccagtccttacaatatgcctgacacaactgtgttcactagcaacctcaaacagacaccatggtgcatctgactcctgaggcgtcaaggcctttaactgcgtcaaggcctttagtgacgtcaaggcctttaggtgcgtcaaggcctttaaggccgtcaaggcctttaccttggacccagaggtcgactcggaccgatg

SEQ ID NO: 15121 - DNA, 203 bp, Homo sapiens
  source 1..203: mol_type = other DNA
ggcgcgccagtcctgatatgcgaactgacacaactgtgttcactagcaacctcaaacagacaccatggtgcatctgactcctgaggcgtcaatacctttaactgcgtcaatacctttagtgacgtcaatacctttaggtgcgtcaatacctttaaggccgtcaatacctttaccttggacccagaggtcgactcggaccgatg

SEQ ID NO: 15122 - DNA, 203 bp, Homo sapiens
  source 1..203: mol_type = other DNA
ggcgcgccagtccttctcatattgctgacacaactgtgttcactagcaacctcaaacagacaccatggtgcatctgactcctgaggcgtcaatccctttaactgcgtcaatccctttagtgacgtcaatccctttaggtgcgtcaatccctttaaggccgtcaatccctttaccttggacccagaggtcgactcggaccgatg

SEQ ID NO: 15123 - DNA, 203 bp, Homo sapiens
  source 1..203: mol_type = other DNA
ggcgcgccagtcctaggatattgtctgacacaactgtgttcactagcaacctcaaacagacaccatggtgcatctgactcctgaggcgtcaattccgataactgcgtcaattccgatagtgacgtcaattccgataggtgcgtcaattccgataaggccgtcaattccgataccttggacccagaggtcgactcggaccgatg

SEQ ID NO: 15124 - DNA, 203 bp, Homo sapiens
  source 1..203: mol_type = other DNA
ggcgcgccagtcctaccgcatatcctgacacaactgtgttcactagcaacctcaaacagacaccatggtgcatctgactcctgaggcgtcaattccgttaactgcgtcaattccgttagtgacgtcaattccgttaggtgcgtcaattccgttaaggccgtcaattccgttaccttggacccagaggtcgactcggaccgatg

SEQ ID NO: 15125 - DNA, 203 bp, Homo sapiens
  source 1..203: mol_type = other DNA
ggcgcgccagtcctcgatattcacctgacacaactgtgttcactagcaacctcaaacagacaccatggtgcatctgactcctgaggcgtcaattccttaaactgcgtcaattccttaagtgacgtcaattccttaaggtgcgtcaattccttaaaggccgtcaattccttaaccttggacccagaggtcgactcggaccgatg

SEQ ID NO: 15126 - DNA, 203 bp, Homo sapiens
  source 1..203: mol_type = other DNA
ggcgcgccagtcctatatcttaacctgacacaactgtgttcactagcaacctcaaacagacaccatggtgcatctgactcctgaggcgtcaattccttacactgcgtcaattccttacgtgacgtcaattccttacggtgcgtcaattccttacaggccgtcaattccttacccttggacccagaggtcgactcggaccgatg

SEQ ID NO: 15127 - DNA, 203 bp, Homo sapiens
  source 1..203: mol_type = other DNA
ggcgcgccagtcctgggatatccactgacacaactgtgttcactagcaacctcaaacagacaccatggtgcatctgactcctgaggcgtcaattccttgcactgcgtcaattccttgcgtgacgtcaattccttgcggtgcgtcaattccttgcaggccgtcaattccttgcccttggacccagaggtcgactcggaccgatg

SEQ ID NO: 15128 - DNA, 203 bp, Homo sapiens
  source 1..203: mol_type = other DNA
ggcgcgccagtccttacacatattctgacacaactgtgttcactagcaacctcaaacagacaccatggtgcatctgactcctgaggcgtcaattccttgtactgcgtcaattccttgtgtgacgtcaattccttgtggtgcgtcaattccttgtaggccgtcaattccttgtccttggacccagaggtcgactcggaccgatg

SEQ ID NO: 15129 - DNA, 203 bp, Homo sapiens
  source 1..203: mol_type = other DNA
ggcgcgccagtcctctgcatatccctgacacaactgtgttcactagcaacctcaaacagacaccatggtgcatctgactcctgaggcgtcaattcctttaactgccctgtggggcaaggtgaacgtggatgaagttggtgcgtcaattcctttaaggccgtcaattcctttaccttggacccagaggtcgactcggaccgatg

SEQ ID NO: 15130 - DNA, 203 bp, Homo sapiens
  source 1..203: mol_type = other DNA
ggcgcgccagtccttcgatatcgtctgacacaactgtgttcactagcaacctcaaacagacaccatggtgcatctgactcctgaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15131 - DNA, 203 bp, Homo sapiens
  source 1..203: mol_type = other DNA
ggcgcgccagtcctatatctacttctgacacaactgtgttcactagcaacctcaaacagacaccatggtgcatctgactcctgaggcgtcaattcctttaactgccctgtggggcaaggtgacgtcaattcctttaggtggtgaggccctgggcaggctgctggtggtctacccttggacccagaggtcgactcggaccgatg

SEQ ID NO: 15132 - DNA, 203 bp, Homo sapiens
  source 1..203: mol_type = other DNA
ggcgcgccagtcctatatgttctcctgacacaactgtgttcactagcaacctcaaacagacaccatggtgcatctgactcctgaggcgtcaattcctttaactgcgtcaattcctttagtgaacgtggatgaagttggtgcgtcaattcctttaaggccgtcaattcctttaccttggacccagaggtcgactcggaccgatg

SEQ ID NO: 15133 - DNA, 203 bp, Homo sapiens
  source 1..203: mol_type = other DNA
ggcgcgccagtcctcggcactggactgacacaactgtgttcactagcaacctcaaacagacaccatggtgcatctgactcctgaggcgtcaattcctttcactgcgtcaattcctttcgtgacgtcaattcctttcggtgcgtcaattcctttcaggccgtcaattcctttcccttggacccagaggtcgactcggaccgatg

SEQ ID NO: 15134 - DNA, 203 bp, Homo sapiens
  source 1..203: mol_type = other DNA
ggcgcgccagtcctcggcagtcccctgacacaactgtgttcactagcaacctcaaacagacaccatggtgcatctgactcctgaggcgtcaattccttttactgcgtcaattccttttgtgacgtcaattccttttggtgcgtcaattccttttaggccgtcaattccttttccttggacccagaggtcgactcggaccgatg

SEQ ID NO: 15135 - DNA, 203 bp, Homo sapiens
  source 1..203: mol_type = other DNA
ggcgcgccagtcctcgtaacaggtctgacacaactgtgttcactagcaacctcaaacagacaccatggtgcatctgactcctgaggcgtcaattcgtttaactgcgtcaattcgtttagtgacgtcaattcgtttaggtgcgtcaattcgtttaaggccgtcaattcgtttaccttggacccagaggtcgactcggaccgatg

SEQ ID NO: 15136 - DNA, 203 bp, Homo sapiens
  source 1..203: mol_type = other DNA
ggcgcgccagtcctagtcgatctgctgacacaactgtgttcactagcaacctcaaacagacaccatggtgcatctgactcctgaggcgtcaattgctttaactgcgtcaattgctttagtgacgtcaattgctttaggtgcgtcaattgctttaaggccgtcaattgctttaccttggacccagaggtcgactcggaccgatg

SEQ ID NO: 15137 - DNA, 203 bp, Homo sapiens
  source 1..203: mol_type = other DNA
ggcgcgccagtcctaagtcgatctctgacacaactgtgttcactagcaacctcaaacagacaccatggtgcatctgactcctgaggcgtcaattggtttaactgcgtcaattggtttagtgacgtcaattggtttaggtgcgtcaattggtttaaggccgtcaattggtttaccttggacccagaggtcgactcggaccgatg

SEQ ID NO: 15138 - DNA, 203 bp, Homo sapiens
  source 1..203: mol_type = other DNA
ggcgcgccagtcctcccgatcgacctgacacaactgtgttcactagcaacctcaaacagacaccatggtgcatctgactcctgaggcgtcaattgttttaactgcgtcaattgttttagtgacgtcaattgttttaggtgcgtcaattgttttaaggccgtcaattgttttaccttggacccagaggtcgactcggaccgatg

SEQ ID NO: 15139 - DNA, 203 bp, Homo sapiens
  source 1..203: mol_type = other DNA
ggcgcgccagtccttgcgatattgctgacacaactgtgttcactagcaacctcaaacagacaccatggtgcatctgactcctgaggcgtcccttcctttaactgcgtcccttcctttagtgacgtcccttcctttaggtgcgtcccttcctttaaggccgtcccttcctttaccttggacccagaggtcgactcggaccgatg

SEQ ID NO: 15140 - DNA, 203 bp, Homo sapiens
  source 1..203: mol_type = other DNA
ggcgcgccagtcctggtgcgatcgctgacacaactgtgttcactagcaacctcaaacagacaccatggtgcatctgactcctgaggcgtcctttcctttaactgcgtcctttcctttagtgacgtcctttcctttaggtgcgtcctttcctttaaggccgtcctttcctttaccttggacccagaggtcgactcggaccgatg

SEQ ID NO: 15141 - DNA, 203 bp, Homo sapiens
  source 1..203: mol_type = other DNA
ggcgcgccagtcctaaaggcgattctgacacaactgtgttcactagcaacctcaaacagacaccatggtgcatctgactcctgaggcgtcgtttcctttaactgcgtcgtttcctttagtgacgtcgtttcctttaggtgcgtcgtttcctttaaggccgtcgtttcctttaccttggacccagaggtcgactcggaccgatg

SEQ ID NO: 15142 - DNA, 203 bp, Homo sapiens
  source 1..203: mol_type = other DNA
ggcgcgccagtcctctagcgattgctgacacaactgtgttcactagcaacctcaaacagacaccatggtgcatctgactcctgaggcgtctattcctttaactgcgtctattcctttagtgacgtctattcctttaggtgcgtctattcctttaaggccgtctattcctttaccttggacccagaggtcgactcggaccgatg

SEQ ID NO: 15143 - DNA, 203 bp, Homo sapiens
  source 1..203: mol_type = other DNA
ggcgcgccagtcctatcgctcgtgctgacacaactgtgttcactagcaacctcaaacagacaccatggtgcatctgactcctgaggcgttaattcctttaactgcgttaattcctttagtgacgttaattcctttaggtgcgttaattcctttaaggccgttaattcctttaccttggacccagaggtcgactcggaccgatg

SEQ ID NO: 15144 - DNA, 203 bp, Homo sapiens
  source 1..203: mol_type = other DNA
ggcgcgccagtcctctgatcgccgctgacacaactgtgttcactagcaacctcaaacagacaccatggtgcatctgactcctgaggctcggccgtccgttactgctcggccgtgcaaggtgactcggccgtaagttggtgctcggccgttgggcaggcctcggccgttctacccttggacccagaggtcgactcggaccgatg

SEQ ID NO: 15145 - DNA, 203 bp, Homo sapiens
  source 1..203: mol_type = other DNA
ggcgcgccagtccttgatcgcagactgacacaactgtgttcactagcaacctcaaacagacaccatggtgcatctgactcctgagggacggccgtccgttactggacggccgtgcaaggtgagacggccgtaagttggtggacggccgttgggcaggcgacggccgttctacccttggacccagaggtcgactcggaccgatg

SEQ ID NO: 15146 - DNA, 203 bp, Homo sapiens
  source 1..203: mol_type = other DNA
ggcgcgccagtcctagcgtaggtgctgacacaactgtgttcactagcaacctcaaacagacaccatggtgcatctgactcctgagggatcaattcctttaactggatcaattcctttagtgagatcaattcctttaggtggatcaattcctttaaggcgatcaattcctttaccttggacccagaggtcgactcggaccgatg

SEQ ID NO: 15147 - DNA, 203 bp, Homo sapiens
  source 1..203: mol_type = other DNA
ggcgcgccagtcctaactgcgtagctgacacaactgtgttcactagcaacctcaaacagacaccatggtgcatctgactcctgagggccggccgtccgttactggccggccgtgcaaggtgagccggccgtaagttggtggccggccgttgggcaggcgccggccgttctacccttggacccagaggtcgactcggaccgatg

SEQ ID NO: 15148 - DNA, 203 bp, Homo sapiens
  source 1..203: mol_type = other DNA
ggcgcgccagtcctggcgtagcttctgacacaactgtgttcactagcaacctcaaacagacaccatggtgcatctgactcctgagggcggcgggtccgttactggcggcgggtgcaaggtgagcggcgggtaagttggtggcggcgggttgggcaggcgcggcgggttctacccttggacccagaggtcgactcggaccgatg

SEQ ID NO: 15149 - DNA, 203 bp, Homo sapiens
  source 1..203: mol_type = other DNA
ggcgcgccagtccttgcgtagtaactgacacaactgtgttcactagcaacctcaaacagacaccatggtgcatctgactcctgaggggcggccgtccgttactgggcggccgtgcaaggtgaggcggccgtaagttggtgggcggccgttgggcaggcggcggccgttctacccttggacccagaggtcgactcggaccgatg

SEQ ID NO: 15150 - DNA, 203 bp, Homo sapiens
  source 1..203: mol_type = other DNA
ggcgcgccagtcctcaaattcaacctgacacaactgtgttcactagcaacctcaaacagacaccatggtgcatctgactcctgagggtcggaatcgagaaactggtcggaatcgagaagtgagtcggaatcgagaaggtggtcggaatcgagaaaggcgtcggaatcgagaaccttggacccagaggtcgactcggaccgatg

SEQ ID NO: 15151 - DNA, 203 bp, Homo sapiens
  source 1..203: mol_type = other DNA
ggcgcgccagtcctgcgtgttgtcctgacacaactgtgttcactagcaacctcaaacagacaccatggtgcatctgactcctgagggtcggccgtccgttactggtcggccgtgcaaggtgagtcggccgtaagttggtggtcggccgttgggcaggcgtcggccgttctacccttggacccagaggtcgactcggaccgatg

SEQ ID NO: 15152 - DNA, 203 bp, Homo sapiens
  source 1..203: mol_type = other DNA
ggcgcgccagtcctgcgtgttagactgacacaactgtgttcactagcaacctcaaacagacaccatggtgcatctgactcctgagggtcttggcaaagttactggtcttggcaaaaaggtgagtcttggcaaagttggtggtcttggcaaaggcaggcgtcttggcaaatacccttggacccagaggtcgactcggaccgatg

SEQ ID NO: 15153 - DNA, 203 bp, Homo sapiens
  source 1..203: mol_type = other DNA
ggcgcgccagtcctcctgggcgtcctgacacaactgtgttcactagcaacctcaaacagacaccatggtgcatctgactcctgaggtaccccctgccgttactgtacccccgggcaaggtgataccccctgaagttggtgtaccccccctgggcaggctacccccggtctacccttggacccagaggtcgactcggaccgatg

SEQ ID NO: 15154 - DNA, 203 bp, Homo sapiens
  source 1..203: mol_type = other DNA
ggcgcgccagtccttcttgggccgctgacacaactgtgttcactagcaacctcaaacagacaccatggtgcatctgactcctgaggtacggccgtccgttactgtacggccgtgcaaggtgatacggccgtaagttggtgtacggccgttgggcaggctacggccgttctacccttggacccagaggtcgactcggaccgatg

SEQ ID NO: 15155 - DNA, 203 bp, Homo sapiens
  source 1..203: mol_type = other DNA
ggcgcgccagtcctaagagcccaactgacacaactgtgttcactagcaacctcaaacagacaccatggtgcatctgactcctgaggtactcaatgccgttactgtactcaagggcaaggtgatactcaatgaagttggtgtactcaacctgggcaggctactcaaggtctacccttggacccagaggtcgactcggaccgatg

SEQ ID NO: 15156 - DNA, 203 bp, Homo sapiens
  source 1..203: mol_type = other DNA
ggcgcgccagtcctcgttgggccactgacacaactgtgttcactagcaacctcaaacagacaccatggtgcatctgactcctgaggtactcagtgccgttactgtactcaggggcaaggtgatactcagtgaagttggtgtactcagcctgggcaggctactcagggtctacccttggacccagaggtcgactcggaccgatg

SEQ ID NO: 15157 - DNA, 203 bp, Homo sapiens
  source 1..203: mol_type = other DNA
ggcgcgccagtcctttgcccatgactgacacaactgtgttcactagcaacctcaaacagacaccatggtgcatctgactcctgaggtactccatgccgttactgtactccagggcaaggtgatactccatgaagttggtgtactccacctgggcaggctactccaggtctacccttggacccagaggtcgactcggaccgatg

SEQ ID NO: 15158 - DNA, 203 bp, Homo sapiens
  source 1..203: mol_type = other DNA
ggcgcgccagtcctgagcccatatctgacacaactgtgttcactagcaacctcaaacagacaccatggtgcatctgactcctgaggtactccctgccgttactgccctgtggggcaaggtgaacgtggatgaagttggtggtgaggccctgggcaggctactcccggtctaccctttactcccgaggtcgactcggaccgatg

SEQ ID NO: 15159 - DNA, 203 bp, Homo sapiens
  source 1..203: mol_type = other DNA
ggcgcgccagtcctacgcccaaatctgacacaactgtgttcactagcaacctcaaacagacaccatggtgcatctgactcctgaggtactccctgccgttactgccctgtggggcaaggtgaacgtggatgaagttggtggtgaggccctgggcaggctgctggtggtctaccctttactcccgaggtcgactcggaccgatg

SEQ ID NO: 15160 - DNA, 203 bp, Homo sapiens
  source 1..203: mol_type = other DNA
ggcgcgccagtccttgaactgggcctgacacaactgtgttcactagcaacctcaaacagacaccatggtgcatctgactcctgaggtactccctgccgttactgccctgtggggcaaggtgaacgtggatgaagttggtgtactccccctgggcaggctactcccggtctacccttggacccagaggtcgactcggaccgatg

SEQ ID NO: 15161 - DNA, 203 bp, Homo sapiens
  source 1..203: mol_type = other DNA
ggcgcgccagtcctgctcagcccactgacacaactgtgttcactagcaacctcaaacagacaccatggtgcatctgactcctgaggtactccctgccgttactgccctgtggggcaaggtgaacgtggatgaagttggtgtactccccctgggcaggctgctggtggtctaccctttactcccgaggtcgactcggaccgatg

SEQ ID NO: 15162 - DNA, 203 bp, Homo sapiens
  source 1..203: mol_type = other DNA
ggcgcgccagtcctactactgggcctgacacaactgtgttcactagcaacctcaaacagacaccatggtgcatctgactcctgaggtactccctgccgttactgccctgtggggcaaggtgatactccctgaagttggtggtgaggccctgggcaggctactcccggtctacccttggacccagaggtcgactcggaccgatg

SEQ ID NO: 15163 - DNA, 203 bp, Homo sapiens
  source 1..203: mol_type = other DNA
ggcgcgccagtcctatatgcccagctgacacaactgtgttcactagcaacctcaaacagacaccatggtgcatctgactcctgaggtactccctgccgttactgccctgtggggcaaggtgatactccctgaagttggtggtgaggccctgggcaggctgctggtggtctacccttggacccagaggtcgactcggaccgatg

SEQ ID NO: 15164 - DNA, 203 bp, Homo sapiens
  source 1..203: mol_type = other DNA
ggcgcgccagtccttgtttgcccactgacacaactgtgttcactagcaacctcaaacagacaccatggtgcatctgactcctgaggtactccctgccgttactgccctgtggggcaaggtgatactccctgaagttggtgtactccccctgggcaggctgctggtggtctacccttggacccagaggtcgactcggaccgatg

SEQ ID NO: 15165 - DNA, 203 bp, Homo sapiens
  source 1..203: mol_type = other DNA
ggcgcgccagtccttcatgggcatctgacacaactgtgttcactagcaacctcaaacagacaccatggtgcatctgactcctgaggtactccctgccgttactgtactcccgggcaaggtgaacgtggatgaagttggtggtgaggccctgggcaggctactcccggtctaccctttactcccgaggtcgactcggaccgatg

SEQ ID NO: 15166 - DNA, 203 bp, Homo sapiens
  source 1..203: mol_type = other DNA
ggcgcgccagtccttgaatgggcactgacacaactgtgttcactagcaacctcaaacagacaccatggtgcatctgactcctgaggtactccctgccgttactgtactcccgggcaaggtgaacgtggatgaagttggtgtactccccctgggcaggctactcccggtctacccttggacccagaggtcgactcggaccgatg

SEQ ID NO: 15167 - DNA, 203 bp, Homo sapiens
  source 1..203: mol_type = other DNA
ggcgcgccagtcctgtagcccatgctgacacaactgtgttcactagcaacctcaaacagacaccatggtgcatctgactcctgaggtactccctgccgttactgtactcccgggcaaggtgaacgtggatgaagttggtgtactccccctgggcaggctactcccggtctaccctttactcccgaggtcgactcggaccgatg

SEQ ID NO: 15168 - DNA, 203 bp, Homo sapiens
  source 1..203: mol_type = other DNA
ggcgcgccagtcctctgggcctgtctgacacaactgtgttcactagcaacctcaaacagacaccatggtgcatctgactcctgaggtactccctgccgttactgtactcccgggcaaggtgaacgtggatgaagttggtgtactccccctgggcaggctgctggtggtctacccttggacccagaggtcgactcggaccgatg

SEQ ID NO: 15169 - DNA, 203 bp, Homo sapiens
  source 1..203: mol_type = other DNA
ggcgcgccagtcctgctgcccaagctgacacaactgtgttcactagcaacctcaaacagacaccatggtgcatctgactcctgaggtactccctgccgttactgtactcccgggcaaggtgaacgtggatgaagttggtgtactccccctgggcaggctgctggtggtctaccctttactcccgaggtcgactcggaccgatg

SEQ ID NO: 15170 - DNA, 203 bp, Homo sapiens
  source 1..203: mol_type = other DNA
ggcgcgccagtcctactaagattcctgacacaactgtgttcactagcaacctcaaacagacaccatggtgcatctgactcctgaggtactccctgccgttactgtactcccgggcaaggtgatactccctgaagttggtggtgaggccctgggcaggctactcccggtctaccctttactcccgaggtcgactcggaccgatg

SEQ ID NO: 15171 - DNA, 203 bp, Homo sapiens
  source 1..203: mol_type = other DNA
ggcgcgccagtcctcgactaaggcctgacacaactgtgttcactagcaacctcaaacagacaccatggtgcatctgactcctgaggtactccctgccgttactgtactcccgggcaaggtgatactccctgaagttggtgtactccccctgggcaggctactcccggtctacccttggacccagaggtcgactcggaccgatg

SEQ ID NO: 15172 - DNA, 203 bp, Homo sapiens
  source 1..203: mol_type = other DNA
ggcgcgccagtcctgctactaagcctgacacaactgtgttcactagcaacctcaaacagacaccatggtgcatctgactcctgaggtactccctgccgttactgtactcccgggcaaggtgatactccctgaagttggtgtactccccctgggcaggctgctggtggtctacccttggacccagaggtcgactcggaccgatg

SEQ ID NO: 15173 - DNA, 203 bp, Homo sapiens
  source 1..203: mol_type = other DNA
ggcgcgccagtcctcttagttgcgctgacacaactgtgttcactagcaacctcaaacagacaccatggtgcatctgactcctgaggtactccgtgccgttactgtactccggggcaaggtgatactccgtgaagttggtgtactccgcctgggcaggctactccgggtctacccttggacccagaggtcgactcggaccgatg

SEQ ID NO: 15174 - DNA, 203 bp, Homo sapiens
  source 1..203: mol_type = other DNA
ggcgcgccagtcctttcttagtgactgacacaactgtgttcactagcaacctcaaacagacaccatggtgcatctgactcctgaggtactccttgccgttactgtactcctgggcaaggtgatactccttgaagttggtgtactcctcctgggcaggctactcctggtctacccttggacccagaggtcgactcggaccgatg

SEQ ID NO: 15175 - DNA, 203 bp, Homo sapiens
  source 1..203: mol_type = other DNA
ggcgcgccagtcctcttagtgtatctgacacaactgtgttcactagcaacctcaaacagacaccatggtgcatctgactcctgaggtactctctgccgttactgtactctcgggcaaggtgatactctctgaagttggtgtactctccctgggcaggctactctcggtctacccttggacccagaggtcgactcggaccgatg

SEQ ID NO: 15176 - DNA, 203 bp, Homo sapiens
  source 1..203: mol_type = other DNA
ggcgcgccagtcctagctttgacgctgacacaactgtgttcactagcaacctcaaacagacaccatggtgcatctgactcctgaggtactggctgccgttactgtactggcgggcaaggtgatactggctgaagttggtgtactggccctgggcaggctactggcggtctacccttggacccagaggtcgactcggaccgatg

SEQ ID NO: 15177 - DNA, 203 bp, Homo sapiens
  source 1..203: mol_type = other DNA
ggcgcgccagtcctcttgcttttgctgacacaactgtgttcactagcaacctcaaacagacaccatggtgcatctgactcctgaggtacttactgccgttactgtacttacgggcaaggtgatacttactgaagttggtgtacttaccctgggcaggctacttacggtctacccttggacccagaggtcgactcggaccgatg

SEQ ID NO: 15178 - DNA, 203 bp, Homo sapiens
  source 1..203: mol_type = other DNA
ggcgcgccagtcctcaaggtgtccctgacacaactgtgttcactagcaacctcaaacagacaccatggtgcatctgactcctgaggtacttcctgccgttactgtacttccgggcaaggtgatacttcctgaagttggtgtacttcccctgggcaggctacttccggtctacccttggacccagaggtcgactcggaccgatg

SEQ ID NO: 15179 - DNA, 203 bp, Homo sapiens
  source 1..203: mol_type = other DNA
ggcgcgccagtcctgcgcttgcgactgacacaactgtgttcactagcaacctcaaacagacaccatggtgcatctgactcctgaggtactttctgccgttactgtactttcgggcaaggtgatactttctgaagttggtgtactttccctgggcaggctactttcggtctacccttggacccagaggtcgactcggaccgatg

SEQ ID NO: 15180 - DNA, 203 bp, Homo sapiens
  source 1..203: mol_type = other DNA
ggcgcgccagtccttagaagcgctctgacacaactgtgttcactagcaacctcaaacagacaccatggtgcatctgactcctgaggtagcccctgccgttactgtagccccgggcaaggtgatagcccctgaagttggtgtagcccccctgggcaggctagccccggtctacccttggacccagaggtcgactcggaccgatg

SEQ ID NO: 15181 - DNA, 203 bp, Homo sapiens
  source 1..203: mol_type = other DNA
ggcgcgccagtcctagtcaagcgcctgacacaactgtgttcactagcaacctcaaacagacaccatggtgcatctgactcctgaggtaggccctgccgttactgtaggcccgggcaaggtgataggccctgaagttggtgtaggccccctgggcaggctaggcccggtctacccttggacccagaggtcgactcggaccgatg

SEQ ID NO: 15182 - DNA, 203 bp, Homo sapiens
  source 1..203: mol_type = other DNA
ggcgcgccagtcctcccgaagcgcctgacacaactgtgttcactagcaacctcaaacagacaccatggtgcatctgactcctgaggtagtccctgccgttactgtagtcccgggcaaggtgatagtccctgaagttggtgtagtccccctgggcaggctagtcccggtctacccttggacccagaggtcgactcggaccgatg

SEQ ID NO: 15183 - DNA, 203 bp, Homo sapiens
  source 1..203: mol_type = other DNA
ggcgcgccagtcctttgcgatcttctgacacaactgtgttcactagcaacctcaaacagacaccatggtgcatctgactcctgaggtataccctgccgttactgtatacccgggcaaggtgatataccctgaagttggtgtataccccctgggcaggctatacccggtctacccttggacccagaggtcgactcggaccgatg

SEQ ID NO: 15184 - DNA, 203 bp, Homo sapiens
  source 1..203: mol_type = other DNA
ggcgcgccagtcctcgagcctcaactgacacaactgtgttcactagcaacctcaaacagacaccatggtgcatctgactcctgaggtatcaattcctttaactgtatcaattcctttagtgatatcaattcctttaggtgtatcaattcctttaaggctatcaattcctttaccttggacccagaggtcgactcggaccgatg

SEQ ID NO: 15185 - DNA, 203 bp, Homo sapiens
  source 1..203: mol_type = other DNA
ggcgcgccagtcctcctgacgtccctgacacaactgtgttcactagcaacctcaaacagacaccatggtgcatctgactcctgaggtatcccctgccgttactgtatccccgggcaaggtgatatcccctgaagttggtgtatcccccctgggcaggctatccccggtctacccttggacccagaggtcgactcggaccgatg

SEQ ID NO: 15186 - DNA, 203 bp, Homo sapiens
  source 1..203: mol_type = other DNA
ggcgcgccagtccttatgaccatgctgacacaactgtgttcactagcaacctcaaacagacaccatggtgcatctgactcctgaggtatgccctgccgttactgtatgcccgggcaaggtgatatgccctgaagttggtgtatgccccctgggcaggctatgcccggtctacccttggacccagaggtcgactcggaccgatg

SEQ ID NO: 15187 - DNA, 203 bp, Homo sapiens
  source 1..203: mol_type = other DNA
ggcgcgccagtcctttggacgtggctgacacaactgtgttcactagcaacctcaaacagacaccatggtgcatctgactcctgaggtccggccgtccgttactgtccggccgtgcaaggtgatccggccgtaagttggtgtccggccgttgggcaggctccggccgttctacccttggacccagaggtcgactcggaccgatg

SEQ ID NO: 15188 - DNA, 203 bp, Homo sapiens
  source 1..203: mol_type = other DNA
ggcgcgccagtccttccacgtccactgacacaactgtgttcactagcaacctcaaacagacaccatggtgcatctgactcctgaggtcctccctgccgttactgtcctcccgggcaaggtgatcctccctgaagttggtgtcctccccctgggcaggctcctcccggtctacccttggacccagaggtcgactcggaccgatg

SEQ ID NO: 15189 - DNA, 203 bp, Homo sapiens
  source 1..203: mol_type = other DNA
ggcgcgccagtccttcgtcggtacctgacacaactgtgttcactagcaacctcaaacagacaccatggtgcatctgactcctgaggtgcggaatcgagaaactgtgcggaatcgagaagtgatgcggaatcgagaaggtgtgcggaatcgagaaaggctgcggaatcgagaaccttggacccagaggtcgactcggaccgatg

SEQ ID NO: 15190 - DNA, 203 bp, Homo sapiens
  source 1..203: mol_type = other DNA
ggcgcgccagtccttaccgatccactgacacaactgtgttcactagcaacctcaaacagacaccatggtgcatctgactcctgaggtgcttggcaaagttactgtgcttggcaaaaaggtgatgcttggcaaagttggtgtgcttggcaaaggcaggctgcttggcaaatacccttggacccagaggtcgactcggaccgatg

SEQ ID NO: 15191 - DNA, 203 bp, Homo sapiens
  source 1..203: mol_type = other DNA
ggcgcgccagtcctgtaccgaaatctgacacaactgtgttcactagcaacctcaaacagacaccatggtgcatctgactcctgaggtgtcaattcctttaactgtgtcaattcctttagtgatgtcaattcctttaggtgtgtcaattcctttaaggctgtcaattcctttaccttggacccagaggtcgactcggaccgatg

SEQ ID NO: 15192 - DNA, 203 bp, Homo sapiens
  source 1..203: mol_type = other DNA
ggcgcgccagtcctaataccgaacctgacacaactgtgttcactagcaacctcaaacagacaccatggtgcatctgactcctgaggttactggcaaagttactgttactggcaaaaaggtgattactggcaaagttggtgttactggcaaaggcaggcttactggcaaatacccttggacccagaggtcgactcggaccgatg

SEQ ID NO: 15193 - DNA, 203 bp, Homo sapiens
  source 1..203: mol_type = other DNA
ggcgcgccagtcctcgtgcaccatctgacacaactgtgttcactagcaacctcaaacagacaccatggtgcatctgactcctgaggttcgtggcaaagttactgttcgtggcaaaaaggtgattcgtggcaaagttggtgttcgtggcaaaggcaggcttcgtggcaaatacccttggacccagaggtcgactcggaccgatg

SEQ ID NO: 15194 - DNA, 203 bp, Homo sapiens
  source 1..203: mol_type = other DNA
ggcgcgccagtcctacgttgaacgctgacacaactgtgttcactagcaacctcaaacagacaccatggtgcatctgactcctgaggttctaagcaaagttactgttctaagcaaaaaggtgattctaagcaaagttggtgttctaagcaaaggcaggcttctaagcaaatacccttggacccagaggtcgactcggaccgatg

SEQ ID NO: 15195 - DNA, 203 bp, Homo sapiens
  source 1..203: mol_type = other DNA
ggcgcgccagtccttgggtgtgaactgacacaactgtgttcactagcaacctcaaacagacaccatggtgcatctgactcctgaggttctatgcaaagttactgttctatgcaaaaaggtgattctatgcaaagttggtgttctatgcaaaggcaggcttctatgcaaatacccttggacccagaggtcgactcggaccgatg

SEQ ID NO: 15196 - DNA, 203 bp, Homo sapiens
  source 1..203: mol_type = other DNA
ggcgcgccagtcctatgggtgtcgctgacacaactgtgttcactagcaacctcaaacagacaccatggtgcatctgactcctgaggttctcagcaaagttactgttctcagcaaaaaggtgattctcagcaaagttggtgttctcagcaaaggcaggcttctcagcaaatacccttggacccagaggtcgactcggaccgatg

SEQ ID NO: 15197 - DNA, 203 bp, Homo sapiens
  source 1..203: mol_type = other DNA
ggcgcgccagtccttactgacgtactgacacaactgtgttcactagcaacctcaaacagacaccatggtgcatctgactcctgaggttctccctgccgttactgttctcccgggcaaggtgattctccctgaagttggtgttctccccctgggcaggcttctcccggtctacccttggacccagaggtcgactcggaccgatg

SEQ ID NO: 15198 - DNA, 203 bp, Homo sapiens
  source 1..203: mol_type = other DNA
ggcgcgccagtcctgctacattttctgacacaactgtgttcactagcaacctcaaacagacaccatggtgcatctgactcctgaggttctccgcaaagttactgttctccgcaaaaaggtgattctccgcaaagttggtgttctccgcaaaggcaggcttctccgcaaatacccttggacccagaggtcgactcggaccgatg

SEQ ID NO: 15199 - DNA, 203 bp, Homo sapiens
  source 1..203: mol_type = other DNA
ggcgcgccagtcctcagatccagcctgacacaactgtgttcactagcaacctcaaacagacaccatggtgcatctgactcctgaggttctcgattccgtgactgttctcgattccgtggtgattctcgattccgtgggtgttctcgattccgtgaggcttctcgattccgtgccttggacccagaggtcgactcggaccgatg

SEQ ID NO: 15200 - DNA, 203 bp, Homo sapiens
  source 1..203: mol_type = other DNA
ggcgcgccagtcctgtgacagcaactgacacaactgtgttcactagcaacctcaaacagacaccatggtgcatctgactcctgaggttctgggcaaagttactgttctgggcaaaaaggtgattctgggcaaagttggtgttctgggcaaaggcaggcttctgggcaaatacccttggacccagaggtcgactcggaccgatg

SEQ ID NO: 15201 - DNA, 203 bp, Homo sapiens
  source 1..203: mol_type = other DNA
ggcgcgccagtccttgtctggaccctgacacaactgtgttcactagcaacctcaaacagacaccatggtgcatctgactcctgaggttcttagcaaagttactgttcttagcaaaaaggtgattcttagcaaagttggtgttcttagcaaaggcaggcttcttagcaaatacccttggacccagaggtcgactcggaccgatg

SEQ ID NO: 15202 - DNA, 203 bp, Homo sapiens
  source 1..203: mol_type = other DNA
ggcgcgccagtccttcgcccaggtctgacacaactgtgttcactagcaacctcaaacagacaccatggtgcatctgactcctgaggttcttcgcaaagttactgttcttcgcaaaaaggtgattcttcgcaaagttggtgttcttcgcaaaggcaggcttcttcgcaaatacccttggacccagaggtcgactcggaccgatg

SEQ ID NO: 15203 - DNA, 203 bp, Homo sapiens
  source 1..203: mol_type = other DNA
ggcgcgccagtcctttcgcccaagctgacacaactgtgttcactagcaacctcaaacagacaccatggtgcatctgactcctgaggttcttgacaaagttactgttcttgacaaaaaggtgattcttgacaaagttggtgttcttgacaaaggcaggcttcttgacaaatacccttggacccagaggtcgactcggaccgatg

SEQ ID NO: 15204 - DNA, 203 bp, Homo sapiens
  source 1..203: mol_type = other DNA
ggcgcgccagtcctcaggtcgcccctgacacaactgtgttcactagcaacctcaaacagacaccatggtgcatctgactcctgaggttcttgagaaagttactgttcttgagaaaaaggtgattcttgagaaagttggtgttcttgagaaaggcaggcttcttgagaaatacccttggacccagaggtcgactcggaccgatg

SEQ ID NO: 15205 - DNA, 203 bp, Homo sapiens
  source 1..203: mol_type = other DNA
ggcgcgccagtccttgggcgatcactgacacaactgtgttcactagcaacctcaaacagacaccatggtgcatctgactcctgaggttcttgcgaaagttactgttcttgcgaaaaaggtgattcttgcgaaagttggtgttcttgcgaaaggcaggcttcttgcgaaatacccttggacccagaggtcgactcggaccgatg

SEQ ID NO: 15206 - DNA, 203 bp, Homo sapiens
  source 1..203: mol_type = other DNA
ggcgcgccagtcctcgaccacaatctgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctaccccacggaatcgagaacgactcggaccgatg

SEQ ID NO: 15207 - DNA, 203 bp, Homo sapiens
  source 1..203: mol_type = other DNA
ggcgcgccagtcctcaccacaatgctgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctaccccgtcaattcctttacgactcggaccgatg

SEQ ID NO: 15208 - DNA, 203 bp, Homo sapiens
  source 1..203: mol_type = other DNA
ggcgcgccagtccttcacccgaaactgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15209 - DNA, 203 bp, Homo sapiens
  source 1..203: mol_type = other DNA
ggcgcgccagtcctactacgggtactgacacaactgtgttcactagcaacctcaaacagacaccatggtgcatctgactcctgaggttcttggcaaagttactgccctgtggggcaaggtgaacgtggatgaagttggtggtgaggccctgggcaggctgctggtggtctacccttggacctactccccgactcggaccgatg

SEQ ID NO: 15210 - DNA, 203 bp, Homo sapiens
  source 1..203: mol_type = other DNA
ggcgcgccagtcctaacgggttaactgacacaactgtgttcactagcaacctcaaacagacaccatggtgcatctgactcctgaggttcttggcaaagttactgccctgtggggcaaggtgattcttggcaaagttggtgttcttggcaaaggcaggctgctggtggtctacccttggacccagaggtcgactcggaccgatg

SEQ ID NO: 15211 - DNA, 203 bp, Homo sapiens
  source 1..203: mol_type = other DNA
ggcgcgccagtcctacccgtcagcctgacacaactgtgttcactagcaacctcaaacagacaccatggtgcatctgactcctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15212 - DNA, 203 bp, Homo sapiens
  source 1..203: mol_type = other DNA
ggcgcgccagtcctcgtcgggtttctgacacaactgtgttcactagcaacctcaaacagacaccatggtgcatctgactcctgaggttcttggcaaagttactgttcttggcaaaaaggtgattcttggcaaagttggtggtgaggccctgggcaggctgctggtggtctacccttggacccagaggtcgactcggaccgatg

SEQ ID NO: 15213 - DNA, 203 bp, Homo sapiens
  source 1..203: mol_type = other DNA
ggcgcgccagtcctgaaacccgtgctgacacaactgtgttcactagcaacctcaaacagacaccatggtgcatctgactcctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15214 - DNA, 203 bp, Homo sapiens
  source 1..203: mol_type = other DNA
ggcgcgccagtcctgcgacccgtactgacacaactgtgttcactagcaacctcaaacagacaccatggtgcatctgactcctgaggttcttggcaaagttactgttcttggcaaaaaggtgattcttggcaaagttggtgttcttggcaaaggcaggctgctggtggtctacccttggacccagaggtcgactcggaccgatg

SEQ ID NO: 15215 - DNA, 203 bp, Homo sapiens
  source 1..203: mol_type = other DNA
ggcgcgccagtcctccttcgggtgctgacacaactgtgttcactagcaacctcaaacagacaccatggtgcatctgactcctgaggttcttggcaaggttactgttcttggcaagaaggtgattcttggcaaggttggtgttcttggcaagggcaggcttcttggcaagtacccttggacccagaggtcgactcggaccgatg

SEQ ID NO: 15216 - DNA, 203 bp, Homo sapiens
  source 1..203: mol_type = other DNA
ggcgcgccagtcctaaacgggtttctgacacaactgtgttcactagcaacctcaaacagacaccatggtgcatctgactcctgaggttcttggcacagttactgttcttggcacaaaggtgattcttggcacagttggtgttcttggcacaggcaggcttcttggcacatacccttggacccagaggtcgactcggaccgatg

SEQ ID NO: 15217 - DNA, 203 bp, Homo sapiens
  source 1..203: mol_type = other DNA
ggcgcgccagtcctcacccgtactctgacacaactgtgttcactagcaacctcaaacagacaccatggtgcatctgactcctgaggttcttggcaccgttactgttcttggcaccaaggtgattcttggcaccgttggtgttcttggcaccggcaggcttcttggcacctacccttggacccagaggtcgactcggaccgatg

SEQ ID NO: 15218 - DNA, 203 bp, Homo sapiens
  source 1..203: mol_type = other DNA
ggcgcgccagtcctgtaacgggtcctgacacaactgtgttcactagcaacctcaaacagacaccatggtgcatctgactcctgaggttcttggcactgttactgttcttggcactaaggtgattcttggcactgttggtgttcttggcactggcaggcttcttggcacttacccttggacccagaggtcgactcggaccgatg

SEQ ID NO: 15219 - DNA, 203 bp, Homo sapiens
  source 1..203: mol_type = other DNA
ggcgcgccagtcctgtttcgggtactgacacaactgtgttcactagcaacctcaaacagacaccatggtgcatctgactcctgaggttcttggcagagttactgttcttggcagaaaggtgattcttggcagagttggtgttcttggcagaggcaggcttcttggcagatacccttggacccagaggtcgactcggaccgatg

SEQ ID NO: 15220 - DNA, 203 bp, Homo sapiens
  source 1..203: mol_type = other DNA
ggcgcgccagtcctacccgaaatcctgacacaactgtgttcactagcaacctcaaacagacaccatggtgcatctgactcctgaggttcttggcagggttactgttcttggcaggaaggtgattcttggcagggttggtgttcttggcaggggcaggcttcttggcaggtacccttggacccagaggtcgactcggaccgatg

SEQ ID NO: 15221 - DNA, 203 bp, Homo sapiens
  source 1..203: mol_type = other DNA
ggcgcgccagtcctttgatctggactgacacaactgtgttcactagcaacctcaaacagacaccatggtgcatctgactcctgaggttcttggcatagttactgttcttggcataaaggtgattcttggcatagttggtgttcttggcataggcaggcttcttggcatatacccttggacccagaggtcgactcggaccgatg

SEQ ID NO: 15222 - DNA, 203 bp, Homo sapiens
  source 1..203: mol_type = other DNA
ggcgcgccagtcctcggtacgtagctgacacaactgtgttcactagcaacctcaaacagacaccatggtgcatctgactcctgaggttcttggccaagttactgttcttggccaaaaggtgattcttggccaagttggtgttcttggccaaggcaggcttcttggccaatacccttggacccagaggtcgactcggaccgatg

SEQ ID NO: 15223 - DNA, 203 bp, Homo sapiens
  source 1..203: mol_type = other DNA
ggcgcgccagtcctcggcatacacctgacacaactgtgttcactagcaacctcaaacagacaccatggtgcatctgactcctgaggttcttggcccagttactgttcttggcccaaaggtgattcttggcccagttggtgttcttggcccaggcaggcttcttggcccatacccttggacccagaggtcgactcggaccgatg

SEQ ID NO: 15224 - DNA, 203 bp, Homo sapiens
  source 1..203: mol_type = other DNA
ggcgcgccagtcctgtgtaagccgctgacacaactgtgttcactagcaacctcaaacagacaccatggtgcatctgactcctgaggttcttggcgcagttactgttcttggcgcaaaggtgattcttggcgcagttggtgttcttggcgcaggcaggcttcttggcgcatacccttggacccagaggtcgactcggaccgatg

SEQ ID NO: 15225 - DNA, 203 bp, Homo sapiens
  source 1..203: mol_type = other DNA
ggcgcgccagtcctcggttgtccactgacacaactgtgttcactagcaacctcaaacagacaccatggtgcatctgactcctgaggttcttggcggagttactgttcttggcggaaaggtgattcttggcggagttggtgttcttggcggaggcaggcttcttggcggatacccttggacccagaggtcgactcggaccgatg

SEQ ID NO: 15226 - DNA, 203 bp, Homo sapiens
  source 1..203: mol_type = other DNA
ggcgcgccagtcctcggctaaccactgacacaactgtgttcactagcaacctcaaacagacaccatggtgcatctgactcctgaggttcttggctcagttactgttcttggctcaaaggtgattcttggctcagttggtgttcttggctcaggcaggcttcttggctcatacccttggacccagaggtcgactcggaccgatg

SEQ ID NO: 15227 - DNA, 203 bp, Homo sapiens
  source 1..203: mol_type = other DNA
ggcgcgccagtcctcggttggtctctgacacaactgtgttcactagcaacctcaaacagacaccatggtgcatctgactcctgaggttcttgggaaagttactgttcttgggaaaaaggtgattcttgggaaagttggtgttcttgggaaaggcaggcttcttgggaaatacccttggacccagaggtcgactcggaccgatg

SEQ ID NO: 15228 - DNA, 203 bp, Homo sapiens
  source 1..203: mol_type = other DNA
ggcgcgccagtccttgcaacaccgctgacacaactgtgttcactagcaacctcaaacagacaccatggtgcatctgactcctgaggttcttggtaaagttactgttcttggtaaaaaggtgattcttggtaaagttggtgttcttggtaaaggcaggcttcttggtaaatacccttggacccagaggtcgactcggaccgatg

SEQ ID NO: 15229 - DNA, 203 bp, Homo sapiens
  source 1..203: mol_type = other DNA
ggcgcgccagtcctcggcgtagtactgacacaactgtgttcactagcaacctcaaacagacaccatggtgcatctgactcctgaggttcttgttaaagttactgttcttgttaaaaaggtgattcttgttaaagttggtgttcttgttaaaggcaggcttcttgttaaatacccttggacccagaggtcgactcggaccgatg

SEQ ID NO: 15230 - DNA, 203 bp, Homo sapiens
  source 1..203: mol_type = other DNA
ggcgcgccagtcctaaaaccgccgctgacacaactgtgttcactagcaacctcaaacagacaccatggtgcatctgactcctgaggtttatggcaaagttactgtttatggcaaaaaggtgatttatggcaaagttggtgtttatggcaaaggcaggctttatggcaaatacccttggacccagaggtcgactcggaccgatg

SEQ ID NO: 15231 - DNA, 203 bp, Homo sapiens
  source 1..203: mol_type = other DNA
ggcgcgccagtcctttagacgtaactgacacaactgtgttcactagcaacctcaaacagacaccatggtgcatctgactcctgaggtttgccaagaagttactgtttgccaagaaaaggtgatttgccaagaagttggtgtttgccaagaaggcaggctttgccaagaatacccttggacccagaggtcgactcggaccgatg

SEQ ID NO: 15232 - DNA, 203 bp, Homo sapiens
  source 1..203: mol_type = other DNA
ggcgcgccagtcctcgacgtaagactgacacaactgtgttcactagcaacctcaaacagacaccatggtgcatctgactcctgaggtttgtggcaaagttactgtttgtggcaaaaaggtgatttgtggcaaagttggtgtttgtggcaaaggcaggctttgtggcaaatacccttggacccagaggtcgactcggaccgatg

SEQ ID NO: 15233 - DNA, 203 bp, Homo sapiens
  source 1..203: mol_type = other DNA
ggcgcgccagtcctcgtaggacatctgacacaactgtgttcactagcaacctcaaacagacaccatggtgcatctgactcctgattcctttaagtttcagctttgcaaccatactccccccggaacccaaagactttggtttcccgccctgggcaggctgctggtggtctacccttggacccagaggtcgactcggaccgatg

SEQ ID NO: 15234 - DNA, 203 bp, Homo sapiens
  source 1..203: mol_type = other DNA
ggcgcgccagtcctccaagatcggctgacacaactgtgttcactagcaacctcaaacagacaccatggtgcatctgactcctgattcttggcaaaccgttactgccctgtggggcaaggtgaacgtggatgaagttggtggtgaggccctgggcaggctgctggtggtctacccttggaccggcgggtcgactcggaccgatg

SEQ ID NO: 15235 - DNA, 203 bp, Homo sapiens
  source 1..203: mol_type = other DNA
ggcgcgccagtcctgcagtatcggctgacacaactgtgttcactagcaacctcaaacagacaccatggtgcatctgactcctgcacggaatcgagaagttactgccctgtggggcaaggtgaacgtggatgaagttggtggtgaggccctgggcaggctgctggtggtctacccttggacctactccccgactcggaccgatg

SEQ ID NO: 15236 - DNA, 203 bp, Homo sapiens
  source 1..203: mol_type = other DNA
ggcgcgccagtcctcagcggtcggctgacacaactgtgttcactagcaacctcaaacagacaccatggtgcatctgactcctgcgtcaattcctttagttactgccctgtggggcaaggtgaacgtggatgaagttggtggtgaggccctgggcaggctgctggtggtctaccccgtcaattcctttacgactcggaccgatg

SEQ ID NO: 15237 - DNA, 203 bp, Homo sapiens
  source 1..203: mol_type = other DNA
ggcgcgccagtcctgaatgatcggctgacacaactgtgttcactagcaacctcaaacagacaccatggtgcatctgactcctggctccactcctggtggtgcccttccgtcaattcctttaagtttcagctttgcaaccatactccccctgggcaggctgctggtggtctacccttggacccagaggtcgactcggaccgatg

SEQ ID NO: 15238 - DNA, 203 bp, Homo sapiens
  source 1..203: mol_type = other DNA
ggcgcgccagtcctttactctcggctgacacaactgtgttcactagcaacctcaaacagacaccatggtgcatctgactcctggctccactcctggtggtgcccttccgtcaattcctttaagtttcagctttgcaaccatactcgccctgggcaggctgctggtggtctacccttggacccagaggtcgactcggaccgatg

SEQ ID NO: 15239 - DNA, 203 bp, Homo sapiens
  source 1..203: mol_type = other DNA
ggcgcgccagtcctagaacgtcggctgacacaactgtgttcactagcaacctcaaacagacaccatggtgcatctgactcctgtactcccgtctgccgttactgccctgtggggcaaggtgaacgtggatgaagttggtggtgaggccctgggcaggctgctggtggtctaccccacggaatcgagaacgactcggaccgatg

SEQ ID NO: 15240 - DNA, 203 bp, Homo sapiens
  source 1..203: mol_type = other DNA
ggcgcgccagtcctgacacctcggctgacacaactgtgttcactagcaacctcaaacagacaccatggtgcatctgactcctgtactcccgtctgccgttactgccctgtggggcaaggtgaacgtggatgaagttggtggtgaggccctgggcaggctgctggtggtctacccttggacccagaggtcgactcggaccgatg

SEQ ID NO: 15241 - DNA, 203 bp, Homo sapiens
  source 1..203: mol_type = other DNA
ggcgcgccagtcctccgatcaacgctgacacaactgtgttcactagcaacctcaaacagacaccatggtgcatctgactttcttggcaaagtctgccgttactgccctgtggggcaaggtgaacgtggatgaagttggtggtgaggccctgggcaggctgctggtggtctaccccgtcaattcctttacgactcggaccgatg

SEQ ID NO: 15242 - DNA, 203 bp, Homo sapiens
  source 1..203: mol_type = other DNA
ggcgcgccagtcctccgaagttgtctgacacaactgtgttcactagcaacctcaaacagacaccatggtgcatctgactttcttggcaaagtctgccgttactgccctgtggggcaaggtgaacgtggatgaagttggtggtgaggccctgggcaggctgctggtggtctacccttggacccagaggtcgactcggaccgatg

SEQ ID NO: 15243 - DNA, 203 bp, Homo sapiens
  source 1..203: mol_type = other DNA
ggcgcgccagtcctccgacccgagctgacacaactgtgttcactagcaacctcaaacagacaccatggtgcatctgactttcttggcaaagtctgccgttactgccctgtggggcaaggtgaacgtggatgaagttggtggtgaggccctgggcaggctgctggtggtctacccttggacctactccccgactcggaccgatg

SEQ ID NO: 15244 - DNA, 203 bp, Homo sapiens
  source 1..203: mol_type = other DNA
ggcgcgccagtcctgctggtgaacctgacacaactgtgttcactagcaacctcaaacagacaccatggtgcatctgcacggaatcgagaagtctgccgttactgccctgtggggcaaggtgaacgtggatgaagttggtggtgaggccctgggcaggctgctggtggtctaccccgtcaattcctttacgactcggaccgatg

SEQ ID NO: 15245 - DNA, 203 bp, Homo sapiens
  source 1..203: mol_type = other DNA
ggcgcgccagtccttaaatccaggctgacacaactgtgttcactagcaacctcaaacagacaccatggtgcatctgcacggaatcgagaagtctgccgttactgccctgtggggcaaggtgaacgtggatgaagttggtggtgaggccctgggcaggctgctggtggtctacccttggacctactccccgactcggaccgatg

SEQ ID NO: 15246 - DNA, 203 bp, Homo sapiens
  source 1..203: mol_type = other DNA
ggcgcgccagtcctactaggacgcctgacacaactgtgttcactagcaacctcaaacagacaccatggtgcatctgcgtcaattcctttagtctgccgttactgccctgtggggcaaggtgaacgtggatgaagttggtggtgaggccctgggcaggctgctggtggtctaccccacggaatcgagaacgactcggaccgatg

SEQ ID NO: 15247 - DNA, 203 bp, Homo sapiens
  source 1..203: mol_type = other DNA
ggcgcgccagtcctactggacgcactgacacaactgtgttcactagcaacctcaaacagacaccatggtgcatctgcgtcaattcctttagtctgccgttactgccctgtggggcaaggtgaacgtggatgaagttggtggtgaggccctgggcaggctgctggtggtctaccccgtcaattcctttacgactcggaccgatg

SEQ ID NO: 15248 - DNA, 203 bp, Homo sapiens
  source 1..203: mol_type = other DNA
ggcgcgccagtccttggacgctaactgacacaactgtgttcactagcaacctcaaacagacaccatggtgcatctgcgtcaattcctttagtctgccgttactgccctgtggggcaaggtgaacgtggatgaagttggtggtgaggccctgggcaggctgctggtggtctacccttggacccagaggtcgactcggaccgatg

SEQ ID NO: 15249 - DNA, 203 bp, Homo sapiens
  source 1..203: mol_type = other DNA
ggcgcgccagtcctgcgtcccagactgacacaactgtgttcactagcaacctcaaacagacaccatggtgcatctgtactcccaggagaagtctgccgttactgccctgtggggcaaggtgaacgtggatgaagttggtggtgaggccctgggcaggctgctggtggtctacccttggacctactccccgactcggaccgatg

SEQ ID NO: 15250 - DNA, 203 bp, Homo sapiens
  source 1..203: mol_type = other DNA
ggcgcgccagtcctggatccaagactgacacaactgtgttcactagcaacctcaaacagacaccatggtgcattaagccgcaggctccactcctggtggtgcccttccgtcaattcctttaagtttcagctttgcaaccatactccccccggaacccctgctggtggtctacccttggacccagaggtcgactcggaccgatg

SEQ ID NO: 15251 - DNA, 203 bp, Homo sapiens
  source 1..203: mol_type = other DNA
ggcgcgccagtcctatacccgagcctgacacaactgtgttcactagcaacctcaaacagacaccatggtgcgcccttccgtcaattcctttaagtttcagctttgcaaccatactccccccggaacccaaagactttggtttcccggaagctgcccgctgctggtggtctacccttggacccagaggtcgactcggaccgatg

SEQ ID NO: 15252 - DNA, 203 bp, Homo sapiens
  source 1..203: mol_type = other DNA
ggcgcgccagtccttcacgcttcgctgacacaactgtgttcactagcaacctcaaacagacaccatggtgtgcccttccgtcaattcctttaagtttcagctttgcaaccatactccccccggaacccaaagactttggtttcccggaagctgcccggcgctggtggtctacccttggacccagaggtcgactcggaccgatg

SEQ ID NO: 15253 - DNA, 203 bp, Homo sapiens
  source 1..203: mol_type = other DNA
ggcgcgccagtcctatcacgcttgctgacacaactgtgttcactagcaacctcaaacagacaccatggtgttcttggcaaatgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15254 - DNA, 203 bp, Homo sapiens
  source 1..203: mol_type = other DNA
ggcgcgccagtcctccgaggttcgctgacacaactgtgttcactagcaacctcaaacagacaccatggttcttggcaaacctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15255 - DNA, 203 bp, Homo sapiens
  source 1..203: mol_type = other DNA
ggcgcgccagtccttgtagaacacctgacacaactgtgttcactagcaacctcaaacagacaccatggttcttggcaaacctgaggagaagtctgccgttactgccctgtggggcaaggtgaacgtggatgaagttggtgttcttggcaaaggcaggcttcttggcaaatacccttggacccagaggtcgactcggaccgatg

SEQ ID NO: 15256 - DNA, 203 bp, Homo sapiens
  source 1..203: mol_type = other DNA
ggcgcgccagtcctcagagatcacctgacacaactgtgttcactagcaacctcaaacagacaccatggttcttggcaaacctgaggagaagtctgccgttactgccctgtggggcaaggtgattcttggcaaagttggtggtgaggccctgggcaggctgctggtggtctacccttggacccagaggtcgactcggaccgatg

SEQ ID NO: 15257 - DNA, 203 bp, Homo sapiens
  source 1..203: mol_type = other DNA
ggcgcgccagtcctgaaatgctcgctgacacaactgtgttcactagcaacctcaaacagacaccatggttcttggcaaacctgaggagaagtctgccgttactgccctgtggggcaaggtgattcttggcaaagttggtggtgaggccctgggcaggcttcttggcaaatacccttggacccagaggtcgactcggaccgatg

SEQ ID NO: 15258 - DNA, 203 bp, Homo sapiens
  source 1..203: mol_type = other DNA
ggcgcgccagtcctacgaaatgctctgacacaactgtgttcactagcaacctcaaacagacaccatggttcttggcaaacctgaggagaagtctgccgttactgccctgtggggcaaggtgattcttggcaaagttggtgttcttggcaaaggcaggctgctggtggtctacccttggacccagaggtcgactcggaccgatg

SEQ ID NO: 15259 - DNA, 203 bp, Homo sapiens
  source 1..203: mol_type = other DNA
ggcgcgccagtcctacagcccagcctgacacaactgtgttcactagcaacctcaaacagacaccatggttcttggcaaacctgaggagaagtctgccgttactgttcttggcaaaaaggtgattcttggcaaagttggtggtgaggccctgggcaggctgctggtggtctacccttggacccagaggtcgactcggaccgatg

SEQ ID NO: 15260 - DNA, 203 bp, Homo sapiens
  source 1..203: mol_type = other DNA
ggcgcgccagtcctcacctaccctctgacacaactgtgttcactagcaacctcaaacagacaccatggttcttggcaaacctgaggagaagtctgccgttactgttcttggcaaaaaggtgattcttggcaaagttggtgttcttggcaaaggcaggcttcttggcaaatacccttggacccagaggtcgactcggaccgatg

SEQ ID NO: 15261 - DNA, 203 bp, Homo sapiens
  source 1..203: mol_type = other DNA
ggcgcgccagtcctcaaccctgcactgacacaactgtgttcactagcaacctcaaacagacaccatggttcttggcaaacctgaggttcttggcaaagttactgccctgtggggcaaggtgattcttggcaaagttggtggtgaggccctgggcaggctgctggtggtctacccttggacccagaggtcgactcggaccgatg

SEQ ID NO: 15262 - DNA, 203 bp, Homo sapiens
  source 1..203: mol_type = other DNA
ggcgcgccagtcctagggtgctgcctgacacaactgtgttcactagcaacctcaaacagacaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15263 - DNA, 203 bp, Homo sapiens
  source 1..203: mol_type = other DNA
ggcgcgccagtcctaactttagggctgacacaactgtgttcactagcaacctcaaacagacaccatggttcttggcaaacctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15264 - DNA, 203 bp, Homo sapiens
  source 1..203: mol_type = other DNA
ggcgcgccagtcctccctaagttactgacacaactgtgttcactagcaacctcaaacagacaccatggttcttggcaaacctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15265 - DNA, 203 bp, Homo sapiens
  source 1..203: mol_type = other DNA
ggcgcgccagtccttgtctgagggctgacacaactgtgttcactagcaacctcaaacagacaccatgtactccccccggaacccaaagactttggtttcccggaagctgcccggcgggtcatgggaataacgccgccgcatcgccggtcggcatcgtttattggtggtctacccttggacccagaggtcgactcggaccgatg

SEQ ID NO: 15266 - DNA, 203 bp, Homo sapiens
  source 1..203: mol_type = other DNA
ggcgcgccagtcctttgcgtagggctgacacaactgtgttcactagcaacctcaaacagacaccatgtactccctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15267 - DNA, 203 bp, Homo sapiens
  source 1..203: mol_type = other DNA
ggcgcgccagtcctaagggtatctctgacacaactgtgttcactagcaacctcaaacagacaccatgtcaaattaagccgcaggctccactcctggtggtgcccttccgtcaattcctttaagtttcagctttgcaaccatactccccccggaacccaaagaggtggtctacccttggacccagaggtcgactcggaccgatg

SEQ ID NO: 15268 - DNA, 203 bp, Homo sapiens
  source 1..203: mol_type = other DNA
ggcgcgccagtcctagagggtcatctgacacaactgtgttcactagcaacctcaaacagacaccatgtcaaattaagccgcaggctccactcctggtggtgcccttccgtcaattcctttaagtttcagctttgcaaccatactccccccggaacccaaagtggtggtctacccttggacccagaggtcgactcggaccgatg

SEQ ID NO: 15269 - DNA, 203 bp, Homo sapiens
  source 1..203: mol_type = other DNA
ggcgcgccagtcctgcagagggttctgacacaactgtgttcactagcaacctcaaacagacaccatgtggtgcccttccgtcaattcctttaagtttcagctttgcaaccatactccccccggaacccaaagactttggtttcccggaagctgcccggcgggggtggtctacccttggacccagaggtcgactcggaccgatg

SEQ ID NO: 15270 - DNA, 203 bp, Homo sapiens
  source 1..203: mol_type = other DNA
ggcgcgccagtcctccgagggtgcctgacacaactgtgttcactagcaacctcaaacagacacgtcaattcctttaactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15271 - DNA, 203 bp, Homo sapiens
  source 1..203: mol_type = other DNA
ggcgcgccagtcctcagtcccttcctgacacaactgtgttcactagcaacctcaaacagacacgtcaattcctttaactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15272 - DNA, 203 bp, Homo sapiens
  source 1..203: mol_type = other DNA
ggcgcgccagtccttagggttgtactgacacaactgtgttcactagcaacctcaaacagacacttcttggcaaatgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15273 - DNA, 203 bp, Homo sapiens
  source 1..203: mol_type = other DNA
ggcgcgccagtcctggtcccttggctgacacaactgtgttcactagcaacctcaaacagacatactcccgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15274 - DNA, 203 bp, Homo sapiens
  source 1..203: mol_type = other DNA
ggcgcgccagtccttagggactgactgacacaactgtgttcactagcaacctcaaacagacatactcccgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15275 - DNA, 203 bp, Homo sapiens
  source 1..203: mol_type = other DNA
ggcgcgccagtcctggtctaccctctgacacaactgtgttcactagcaacctcaaacagaccaaccatactccccccggaacccaaagactttggtttcccggaagctgcccggcgggtcatgggaataacgccgccgcatcgccggtcggcatcgtttatggtcggtctacccttggacccagaggtcgactcggaccgatg

SEQ ID NO: 15276 - DNA, 203 bp, Homo sapiens
  source 1..203: mol_type = other DNA
ggcgcgccagtccttgctagagggctgacacaactgtgttcactagcaacctcaaacagaccggcgggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15277 - DNA, 203 bp, Homo sapiens
  source 1..203: mol_type = other DNA
ggcgcgccagtcctccctcgcacactgacacaactgtgttcactagcaacctcaaacagaccggcgggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15278 - DNA, 203 bp, Homo sapiens
  source 1..203: mol_type = other DNA
ggcgcgccagtcctctaccgagggctgacacaactgtgttcactagcaacctcaaacagaccggcgggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15279 - DNA, 203 bp, Homo sapiens
  source 1..203: mol_type = other DNA
ggcgcgccagtcctcccttaaagactgacacaactgtgttcactagcaacctcaaacagacgtcaattcctttatgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15280 - DNA, 203 bp, Homo sapiens
  source 1..203: mol_type = other DNA
ggcgcgccagtcctccctagtaagctgacacaactgtgttcactagcaacctcaaacagacgttgagtcaaattaagccgcaggctccactcctggtggtgcccttccgtcaattcctttaagtttcagctttgcaaccatactccccccggaacccaaagactttgtctacccttggacccagaggtcgactcggaccgatg

SEQ ID NO: 15281 - DNA, 203 bp, Homo sapiens
  source 1..203: mol_type = other DNA
ggcgcgccagtcctcagggtgcttctgacacaactgtgttcactagcaacctcaaacagagcaaccatactccccccggaacccaaagactttggtttcccggaagctgcccggcgggtcatgggaataacgccgccgcatcgccggtcggcatcgtttatggtcggactacccttggacccagaggtcgactcggaccgatg

SEQ ID NO: 15282 - DNA, 203 bp, Homo sapiens
  source 1..203: mol_type = other DNA
ggcgcgccagtcctacgtagggatctgacacaactgtgttcactagcaacctcaaacaggcgaccaaaggaaccataactgatttaatgagccattcgcagtttcactgtaccggccgtgcgtactcagacatgcatggcttaatctttgagacaagcatatgctactgtacccttggacccagaggtcgactcggaccgatg

SEQ ID NO: 15283 - DNA, 203 bp, Homo sapiens
  source 1..203: mol_type = other DNA
ggcgcgccagtcctgagaaaccctctgacacaactgtgttcactagcaacctcaaacattcttggcaaagcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15284 - DNA, 203 bp, Homo sapiens
  source 1..203: mol_type = other DNA
ggcgcgccagtcctccctgttaggctgacacaactgtgttcactagcaacctcaaacattcttggcaaagcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15285 - DNA, 203 bp, Homo sapiens
  source 1..203: mol_type = other DNA
ggcgcgccagtcctagggacagtcctgacacaactgtgttcactagcaacctcaaacattcttggcaaagcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15286 - DNA, 203 bp, Homo sapiens
  source 1..203: mol_type = other DNA
ggcgcgccagtccttccctactgactgacacaactgtgttcactagcaacctcaaacccgtgttgagtcaaattaagccgcaggctccactcctggtggtgcccttccgtcaattcctttaagtttcagctttgcaaccatactccccccggaacccaaagactttggtttcccttggacccagaggtcgactcggaccgatg

SEQ ID NO: 15287 - DNA, 203 bp, Homo sapiens
  source 1..203: mol_type = other DNA
ggcgcgccagtcctccctacgcatctgacacaactgtgttcactagcaacctcaaacgagcgaccaaaggaaccataactgatttaatgagccattcgcagtttcactgtaccggccgtgcgtactcagacatgcatggcttaatctttgagacaagcatatgctactggccccttggacccagaggtcgactcggaccgatg

SEQ ID NO: 15288 - DNA, 203 bp, Homo sapiens
  source 1..203: mol_type = other DNA
ggcgcgccagtcctccctactacactgacacaactgtgttcactagcaacctcaaacggtatctgatcgtcttcgaacctccgactttcgttcttgattaatgaaaacattcttggcaaatgctttcgctctggtccgtcttgcgccggtccaagaatttcacctctagcgcccttggacccagaggtcgactcggaccgatg

SEQ ID NO: 15289 - DNA, 203 bp, Homo sapiens
  source 1..203: mol_type = other DNA
ggcgcgccagtcctaagggtagagctgacacaactgtgttcactagcaacctcaacacggaatcgagaagcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15290 - DNA, 203 bp, Homo sapiens
  source 1..203: mol_type = other DNA
ggcgcgccagtcctccctcttgtactgacacaactgtgttcactagcaacctcaacgtcaattcctttagcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15291 - DNA, 203 bp, Homo sapiens
  source 1..203: mol_type = other DNA
ggcgcgccagtcctgtccctagtactgacacaactgtgttcactagcaacctcaagcgagcgaccaaaggaaccataactgatttaatgagccattcgcagtttcactgtaccggccgtgcgtactcagacatgcatggcttaatctttgagacaagcatatgctactggcagcttggacccagaggtcgactcggaccgatg

SEQ ID NO: 15292 - DNA, 203 bp, Homo sapiens
  source 1..203: mol_type = other DNA
ggcgcgccagtcctcccttgttctctgacacaactgtgttcactagcaacctcaagctttgcaaccatactccccccggaacccaaagactttggtttcccggaagctgcccggcgggtcatgggaataacgccgccgcatcgccggtcggcatcgtttatggtcggaactaccttggacccagaggtcgactcggaccgatg

SEQ ID NO: 15293 - DNA, 203 bp, Homo sapiens
  source 1..203: mol_type = other DNA
ggcgcgccagtcctatgtcccttgctgacacaactgtgttcactagcaacctcaatactcccccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15294 - DNA, 203 bp, Homo sapiens
  source 1..203: mol_type = other DNA
ggcgcgccagtcctgtggtaccctctgacacaactgtgttcactagcaacctcaatcccgtgttgagtcaaattaagccgcaggctccactcctggtggtgcccttccgtcaattcctttaagtttcagctttgcaaccatactccccccggaacccaaagactttggtttcccttggacccagaggtcgactcggaccgatg

SEQ ID NO: 15295 - DNA, 203 bp, Homo sapiens
  source 1..203: mol_type = other DNA
ggcgcgccagtcctaccgaagggtctgacacaactgtgttcactagcaacctcaccggccgtccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15296 - DNA, 203 bp, Homo sapiens
  source 1..203: mol_type = other DNA
ggcgcgccagtcctcaccctctctctgacacaactgtgttcactagcaacctcaccggccgtccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15297 - DNA, 203 bp, Homo sapiens
  source 1..203: mol_type = other DNA
ggcgcgccagtccttaaaccctgcctgacacaactgtgttcactagcaacctcagacggtatctgatcgtcttcgaacctccgactttcgttcttgattaatgaaaacattcttggcaaatgctttcgctctggtccgtcttgcgccggtccaagaatttcacctctagcggcgttggacccagaggtcgactcggaccgatg

SEQ ID NO: 15298 - DNA, 203 bp, Homo sapiens
  source 1..203: mol_type = other DNA
ggcgcgccagtcctcagggtttgactgacacaactgtgttcactagcaacctcattcttggcaaatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15299 - DNA, 203 bp, Homo sapiens
  source 1..203: mol_type = other DNA
ggcgcgccagtcctacgtgtcgccctgacacaactgtgttcactagcaacctcccggcgggtccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15300 - DNA, 203 bp, Homo sapiens
  source 1..203: mol_type = other DNA
ggcgcgccagtcctgcgtgtcccactgacacaactgtgttcactagcaacctcccggcgggtccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15301 - DNA, 203 bp, Homo sapiens
  source 1..203: mol_type = other DNA
ggcgcgccagtcctgacacggtttctgacacaactgtgttcactagcaacctcggaattaaccagacaaatcgctccaccaactaagaacggccatgcaccaccacccacggaatcgagaaagagctatcaatctgtcaatcctgtccgtgtccgggccgggtgaggtttcccgtgggacccagaggtcgactcggaccgatg

SEQ ID NO: 15302 - DNA, 203 bp, Homo sapiens
  source 1..203: mol_type = other DNA
ggcgcgccagtcctgcgctaccacctgacacaactgtgttcactagcaacctctttcccgtgttgagtcaaattaagccgcaggctccactcctggtggtgcccttccgtcaattcctttaagtttcagctttgcaaccatactccccccggaacccaaagactttggtttcccgtggacccagaggtcgactcggaccgatg

SEQ ID NO: 15303 - DNA, 203 bp, Homo sapiens
  source 1..203: mol_type = other DNA
ggcgcgccagtccttgcgtagcgcctgacacaactgtgttcactagcaacctggagcgagcgaccaaaggaaccataactgatttaatgagccattcgcagtttcactgtaccggccgtgcgtactcagacatgcatggcttaatctttgagacaagcatatgctactggcaggatggacccagaggtcgactcggaccgatg

SEQ ID NO: 15304 - DNA, 203 bp, Homo sapiens
  source 1..203: mol_type = other DNA
ggcgcgccagtccttgtagcgcttctgacacaactgtgttcactagcaacctgtttcccgtgttgagtcaaattaagccgcaggctccactcctggtggtgcccttccgtcaattcctttaagtttcagctttgcaaccatactccccccggaacccaaagactttggtttcccggggacccagaggtcgactcggaccgatg

SEQ ID NO: 15305 - DNA, 203 bp, Homo sapiens
  source 1..203: mol_type = other DNA
ggcgcgccagtccttctgcatgaactgacacaactgtgttcactagcaaccttcttggcaaaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15306 - DNA, 203 bp, Homo sapiens
  source 1..203: mol_type = other DNA
ggcgcgccagtcctattgtagttactgacacaactgtgttcactagcaaccttcttggcaaaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15307 - DNA, 203 bp, Homo sapiens
  source 1..203: mol_type = other DNA
ggcgcgccagtcctattgtcgtgcctgacacaactgtgttcactagcaacgaggagcgagcgaccaaaggaaccataactgatttaatgagccattcgcagtttcactgtaccggccgtgcgtactcagacatgcatggcttaatctttgagacaagcatatgctactggcaggatcaacccagaggtcgactcggaccgatg

SEQ ID NO: 15308 - DNA, 203 bp, Homo sapiens
  source 1..203: mol_type = other DNA
ggcgcgccagtcctggtcctaaccctgacacaactgtgttcactagcaactactcccagacaccatggtactcccgactcctgaggagaagtctgccgttactgccctgtggggcaaggtgaacgtggatgaagttggtgtactccccctgggcaggctactcccggtctaccctttactcccgaggtcgactcggaccgatg

SEQ ID NO: 15309 - DNA, 203 bp, Homo sapiens
  source 1..203: mol_type = other DNA
ggcgcgccagtcctcgagatcgaactgacacaactgtgttcactagcaactactcccagacaccatggtactcccgactcctgaggagaagtctgccgttactgccctgtggggcaaggtgatactccctgaagttggtggtgaggccctgggcaggctactcccggtctacccttggacccagaggtcgactcggaccgatg

SEQ ID NO: 15310 - DNA, 203 bp, Homo sapiens
  source 1..203: mol_type = other DNA
ggcgcgccagtcctgacgatctcgctgacacaactgtgttcactagcaactactcccagacaccatggtactcccgactcctgaggagaagtctgccgttactgccctgtggggcaaggtgatactccctgaagttggtggtgaggccctgggcaggctactcccggtctaccctttactcccgaggtcgactcggaccgatg

SEQ ID NO: 15311 - DNA, 203 bp, Homo sapiens
  source 1..203: mol_type = other DNA
ggcgcgccagtcctgcaacgcaatctgacacaactgtgttcactagcaactactcccagacaccatggtactcccgactcctgaggagaagtctgccgttactgccctgtggggcaaggtgatactccctgaagttggtggtgaggccctgggcaggctgctggtggtctacccttggacccagaggtcgactcggaccgatg

SEQ ID NO: 15312 - DNA, 203 bp, Homo sapiens
  source 1..203: mol_type = other DNA
ggcgcgccagtccttagattgcgtctgacacaactgtgttcactagcaactactcccagacaccatggtactcccgactcctgaggagaagtctgccgttactgtactcccgggcaaggtgaacgtggatgaagttggtggtgaggccctgggcaggctactcccggtctaccctttactcccgaggtcgactcggaccgatg

SEQ ID NO: 15313 - DNA, 203 bp, Homo sapiens
  source 1..203: mol_type = other DNA
ggcgcgccagtcctgatcgggtaactgacacaactgtgttcactagcaactactcccagacaccatggtactcccgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 15314 - DNA, 203 bp, Homo sapiens
  source 1..203: mol_type = other DNA
ggcgcgccagtcctgcgcattgtgctgacacaactgtgttcactagcaactactcccagacaccatggtactcccgactcctgaggagaagtctgccgttactgtactcccgggcaaggtgatactccctgaagttggtggtgaggccctgggcaggctgctggtggtctacccttggacccagaggtcgactcggaccgatg

SEQ ID NO: 15315 - DNA, 203 bp, Homo sapiens
  source 1..203: mol_type = other DNA
ggcgcgccagtcctctgaatgcgcctgacacaactgtgttcactagcaactactcccagacaccatggtactcccgactcctgaggagaagtctgccgttactgtactcccgggcaaggtgatactccctgaagttggtggtgaggccctgggcaggctgctggtggtctaccctttactcccgaggtcgactcggaccgatg

SEQ ID NO: 15316 - DNA, 203 bp, Homo sapiens
  source 1..203: mol_type = other DNA
ggcgcgccagtcctacgtcaatcactgacacaactgtgttcactagcaactactcccagacaccatggtactcccgactcctgaggagaagtctgccgttactgtactcccgggcaaggtgatactccctgaagttggtgtactccccctgggcaggctgctggtggtctacccttggacccagaggtcgactcggaccgatg

SEQ ID NO: 15317 - DNA, 203 bp, Homo sapiens
  source 1..203: mol_type = other DNA
ggcgcgccagtcctaatgattgacctgacacaactgtgttcactagcaactactcccagacaccatggtactcccgactcctgaggagaagtctgccgttactgtactcccgggcaaggtgatactccctgaagttggtgtactccccctgggcaggctgctggtggtctaccctttactcccgaggtcgactcggaccgatg

SEQ ID NO: 15318 - DNA, 203 bp, Homo sapiens
  source 1..203: mol_type = other DNA
ggcgcgccagtccttctagctggactgacacaactgtgttcactagcaactactcccagacaccatggtactcccgactcctgaggtactccctgccgttactgccctgtggggcaaggtgaacgtggatgaagttggtgtactccccctgggcaggctgctggtggtctacccttggacccagaggtcgactcggaccgatg

SEQ ID NO: 15319 - DNA, 203 bp, Homo sapiens
  source 1..203: mol_type = other DNA
ggcgcgccagtcctcagtagctggctgacacaactgtgttcactagcaactactcccagacaccatggtactcccgactcctgaggtactccctgccgttactgccctgtggggcaaggtgaacgtggatgaagttggtgtactccccctgggcaggctgctggtggtctaccctttactcccgaggtcgactcggaccgatg

SEQ ID NO: 15320 - DNA, 203 bp, Homo sapiens
  source 1..203: mol_type = other DNA
ggcgcgccagtcctgtaagctggactgacacaactgtgttcactagcaactactcccagacaccatggtactcccgactcctgaggtactccctgccgttactgccctgtggggcaaggtgatactccctgaagttggtggtgaggccctgggcaggctactcccggtctaccctttactcccgaggtcgactcggaccgatg

SEQ ID NO: 15321 - DNA, 203 bp, Homo sapiens
  source 1..203: mol_type = other DNA
ggcgcgccagtccttcagagctggctgacacaactgtgttcactagcaactactcccagacaccatggtactcccgactcctgaggtactccctgccgttactgccctgtggggcaaggtgatactccctgaagttggtggtgaggccctgggcaggctgctggtggtctaccctttactcccgaggtcgactcggaccgatg

SEQ ID NO: 15322 - DNA, 203 bp, Homo sapiens
  source 1..203: mol_type = other DNA
ggcgcgccagtcctctcgacgtcactgacacaactgtgttcactagcaactactcccagacaccatggtactcccgactcctgaggtactccctgccgttactgccctgtggggcaaggtgatactccctgaagttggtgtactccccctgggcaggctgctggtggtctacccttggacccagaggtcgactcggaccgatg

SEQ ID NO: 15323 - DNA, 203 bp, Homo sapiens
  source 1..203: mol_type = other DNA
ggcgcgccagtcctgcccggtaacctgacacaactgtgttcactagcaactactcccagacaccatggtactcccgactcctgaggtactccctgccgttactgccctgtggggcaaggtgatactccctgaagttggtgtactccccctgggcaggctgctggtggtctaccctttactcccgaggtcgactcggaccgatg

SEQ ID NO: 15324 - DNA, 203 bp, Homo sapiens
  source 1..203: mol_type = other DNA
ggcgcgccagtcctcgcccgagatctgacacaactgtgttcactagcaactactcccagacaccatggtactcccgactcctgaggtactccctgccgttactgtactcccgggcaaggtgaacgtggatgaagttggtggtgaggccctgggcaggctactcccggtctacccttggacccagaggtcgactcggaccgatg

SEQ ID NO: 15325 - DNA, 203 bp, Homo sapiens
  source 1..203: mol_type = other DNA
ggcgcgccagtccttgcccgttcactgacacaactgtgttcactagcaactactcccagacaccatggtactcccgactcctgaggtactccctgccgttactgtactcccgggcaaggtgaacgtggatgaagttggtggtgaggccctgggcaggctactcccggtctaccctttactcccgaggtcgactcggaccgatg

SEQ ID NO: 15326 - DNA, 203 bp, Homo sapiens
  source 1..203: mol_type = other DNA
ggcgcgccagtcctagcccgatccctgacacaactgtgttcactagcaactactcccagacaccatggtactcccgactcctgaggtactccctgccgttactgtactcccgggcaaggtgaacgtggatgaagttggtggtgaggccctgggcaggctgctggtggtctacccttggacccagaggtcgactcggaccgatg

SEQ ID NO: 15327 - DNA, 203 bp, Homo sapiens
  source 1..203: mol_type = other DNA
ggcgcgccagtcctcagcccgtgcctgacacaactgtgttcactagcaactactcccagacaccatggtactcccgactcctgaggtactccctgccgttactgtactcccgggcaaggtgaacgtggatgaagttggtggtgaggccctgggcaggctgctggtggtctaccctttactcccgaggtcgactcggaccgatg

SEQ ID NO: 15328 - DNA, 203 bp, Homo sapiens
  source 1..203: mol_type = other DNA
ggcgcgccagtcctgagcccgatcctgacacaactgtgttcactagcaactactcccagacaccatggtactcccgactcctgaggtactccctgccgttactgtactcccgggcaaggtgaacgtggatgaagttggtgtactccccctgggcaggctactcccggtctacccttggacccagaggtcgactcggaccgatg

SEQ ID NO: 15329 - DNA, 203 bp, Homo sapiens
  source 1..203: mol_type = other DNA
ggcgcgccagtcctttagcccgatctgacacaactgtgttcactagcaactactcccagacaccatggtactcccgactcctgaggtactccctgccgttactgtactcccgggcaaggtgatactccctgaagttggtggtgaggccctgggcaggctgctggtggtctaccctttactcccgaggtcgactcggaccgatg

SEQ ID NO: 15330 - DNA, 203 bp, Homo sapiens
  source 1..203: mol_type = other DNA
ggcgcgccagtccttaggcccgaactgacacaactgtgttcactagcaactactcccagacaccatggtactcccgactcctgaggtactccctgccgttactgtactcccgggcaaggtgatactccctgaagttggtgtactccccctgggcaggctactcccggtctacccttggacccagaggtcgactcggaccgatg

SEQ ID NO: 15331 - DNA, 203 bp, Homo sapiens
  source 1..203: mol_type = other DNA
ggcgcgccagtcctacgcccgtttctgacacaactgtgttcactagcaactactcccagacaccatggtactcccgactcctgaggtactccctgccgttactgtactcccgggcaaggtgatactccctgaagttggtgtactccccctgggcaggctactcccggtctaccctttactcccgaggtcgactcggaccgatg

SEQ ID NO: 15332 - DNA, 203 bp, Homo sapiens
  source 1..203: mol_type = other DNA
ggcgcgccagtcctgcccgtcgctctgacacaactgtgttcactagcaactactcccagacaccatggtgcatctgactcctgaggagaagtctgccgttactgccctgtggggcaaggtgaacgtggatgaagttggtggtgaggccctgggcaggctactcccggtctaccctttactcccgaggtcgactcggaccgatg

SEQ ID NO: 15333 - DNA, 203 bp, Homo sapiens
  source 1..203: mol_type = other DNA
ggcgcgccagtcctgcccgacctgctgacacaactgtgttcactagcaactactcccagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15334 - DNA, 203 bp, Homo sapiens
  source 1..203: mol_type = other DNA
ggcgcgccagtcctgcccgtacacctgacacaactgtgttcactagcaactactcccagacaccatggtgcatctgactcctgaggagaagtctgccgttactgccctgtggggcaaggtgaacgtggatgaagttggtggtgaggccctgggcaggctgctggtggtctaccctttactcccgaggtcgactcggaccgatg

SEQ ID NO: 15335 - DNA, 203 bp, Homo sapiens
  source 1..203: mol_type = other DNA
ggcgcgccagtccttactcgggcgctgacacaactgtgttcactagcaactactcccagacaccatggtgcatctgactcctgaggagaagtctgccgttactgccctgtggggcaaggtgaacgtggatgaagttggtgtactccccctgggcaggctactcccggtctaccctttactcccgaggtcgactcggaccgatg

SEQ ID NO: 15336 - DNA, 203 bp, Homo sapiens
  source 1..203: mol_type = other DNA
ggcgcgccagtccttggtcgggctctgacacaactgtgttcactagcaactactcccagacaccatggtgcatctgactcctgaggagaagtctgccgttactgccctgtggggcaaggtgatactccctgaagttggtggtgaggccctgggcaggctgctggtggtctacccttggacccagaggtcgactcggaccgatg

SEQ ID NO: 15337 - DNA, 203 bp, Homo sapiens
  source 1..203: mol_type = other DNA
ggcgcgccagtcctaggacgggccctgacacaactgtgttcactagcaactactcccagacaccatggtgcatctgactcctgaggagaagtctgccgttactgccctgtggggcaaggtgatactccctgaagttggtggtgaggccctgggcaggctgctggtggtctaccctttactcccgaggtcgactcggaccgatg

SEQ ID NO: 15338 - DNA, 203 bp, Homo sapiens
  source 1..203: mol_type = other DNA
ggcgcgccagtcctacgggcaaccctgacacaactgtgttcactagcaactactcccagacaccatggtgcatctgactcctgaggagaagtctgccgttactgccctgtggggcaaggtgatactccctgaagttggtgtactccccctgggcaggctactcccggtctaccctttactcccgaggtcgactcggaccgatg

SEQ ID NO: 15339 - DNA, 203 bp, Homo sapiens
  source 1..203: mol_type = other DNA
ggcgcgccagtcctggacacgggcctgacacaactgtgttcactagcaactactcccagacaccatggtgcatctgactcctgaggagaagtctgccgttactgccctgtggggcaaggtgatactccctgaagttggtgtactccccctgggcaggctgctggtggtctacccttggacccagaggtcgactcggaccgatg

SEQ ID NO: 15340 - DNA, 203 bp, Homo sapiens
  source 1..203: mol_type = other DNA
ggcgcgccagtcctacgggcgtatctgacacaactgtgttcactagcaactactcccagacaccatggtgcatctgactcctgaggagaagtctgccgttactgtactcccgggcaaggtgaacgtggatgaagttggtggtgaggccctgggcaggctgctggtggtctaccctttactcccgaggtcgactcggaccgatg

SEQ ID NO: 15341 - DNA, 203 bp, Homo sapiens
  source 1..203: mol_type = other DNA
ggcgcgccagtcctctcgggcggtctgacacaactgtgttcactagcaactactcccagacaccatggtgcatctgactcctgaggagaagtctgccgttactgtactcccgggcaaggtgaacgtggatgaagttggtgtactccccctgggcaggctactcccggtctacccttggacccagaggtcgactcggaccgatg

SEQ ID NO: 15342 - DNA, 203 bp, Homo sapiens
  source 1..203: mol_type = other DNA
ggcgcgccagtcctgcgggcggtactgacacaactgtgttcactagcaactactcccagacaccatggtgcatctgactcctgaggagaagtctgccgttactgtactcccgggcaaggtgaacgtggatgaagttggtgtactccccctgggcaggctactcccggtctaccctttactcccgaggtcgactcggaccgatg

SEQ ID NO: 15343 - DNA, 203 bp, Homo sapiens
  source 1..203: mol_type = other DNA
ggcgcgccagtcctttcgggccttctgacacaactgtgttcactagcaactactcccagacaccatggtgcatctgactcctgaggagaagtctgccgttactgtactcccgggcaaggtgaacgtggatgaagttggtgtactccccctgggcaggctgctggtggtctacccttggacccagaggtcgactcggaccgatg

SEQ ID NO: 15344 - DNA, 203 bp, Homo sapiens
  source 1..203: mol_type = other DNA
ggcgcgccagtccttacgctagagctgacacaactgtgttcactagcaactactcccagacaccatggtgcatctgactcctgaggagaagtctgccgttactgtactcccgggcaaggtgaacgtggatgaagttggtgtactccccctgggcaggctgctggtggtctaccctttactcccgaggtcgactcggaccgatg

SEQ ID NO: 15345 - DNA, 203 bp, Homo sapiens
  source 1..203: mol_type = other DNA
ggcgcgccagtcctctcgtagcatctgacacaactgtgttcactagcaactactcccagacaccatggtgcatctgactcctgaggagaagtctgccgttactgtactcccgggcaaggtgatactccctgaagttggtggtgaggccctgggcaggctgctggtggtctaccctttactcccgaggtcgactcggaccgatg

SEQ ID NO: 15346 - DNA, 203 bp, Homo sapiens
  source 1..203: mol_type = other DNA
ggcgcgccagtcctatgctactagctgacacaactgtgttcactagcaactactcccagacaccatggtgcatctgactcctgaggagaagtctgccgttactgtactcccgggcaaggtgatactccctgaagttggtgtactccccctgggcaggctactcccggtctaccctttactcccgaggtcgactcggaccgatg

SEQ ID NO: 15347 - DNA, 203 bp, Homo sapiens
  source 1..203: mol_type = other DNA
ggcgcgccagtcctttgaatgctactgacacaactgtgttcactagcaactactcccagacaccatggtgcatctgactcctgaggagaagtctgccgttactgtactcccgggcaaggtgatactccctgaagttggtgtactccccctgggcaggctgctggtggtctacccttggacccagaggtcgactcggaccgatg

SEQ ID NO: 15348 - DNA, 203 bp, Homo sapiens
  source 1..203: mol_type = other DNA
ggcgcgccagtcctactcatgctactgacacaactgtgttcactagcaactactcccagacaccatggtgcatctgactcctgaggtactccctgccgttactgccctgtggggcaaggtgaacgtggatgaagttggtggtgaggccctgggcaggctactcccggtctacccttggacccagaggtcgactcggaccgatg

SEQ ID NO: 15349 - DNA, 203 bp, Homo sapiens
  source 1..203: mol_type = other DNA
ggcgcgccagtcctatgctaggacctgacacaactgtgttcactagcaactactcccagacaccatggtgcatctgactcctgaggtactccctgccgttactgccctgtggggcaaggtgaacgtggatgaagttggtggtgaggccctgggcaggctactcccggtctaccctttactcccgaggtcgactcggaccgatg

SEQ ID NO: 15350 - DNA, 203 bp, Homo sapiens
  source 1..203: mol_type = other DNA
ggcgcgccagtccttagcatacgcctgacacaactgtgttcactagcaactactcccagacaccatggtgcatctgactcctgaggtactccctgccgttactgccctgtggggcaaggtgaacgtggatgaagttggtggtgaggccctgggcaggctgctggtggtctacccttggacccagaggtcgactcggaccgatg

SEQ ID NO: 15351 - DNA, 203 bp, Homo sapiens
  source 1..203: mol_type = other DNA
ggcgcgccagtcctagaaagaatgctgacacaactgtgttcactagcaactactcccagacaccatggtgcatctgactcctgaggtactccctgccgttactgccctgtggggcaaggtgaacgtggatgaagttggtgtactccccctgggcaggctactcccggtctaccctttactcccgaggtcgactcggaccgatg

SEQ ID NO: 15352 - DNA, 203 bp, Homo sapiens
  source 1..203: mol_type = other DNA
ggcgcgccagtcctacattcttcgctgacacaactgtgttcactagcaactactcccagacaccatggtgcatctgactcctgaggtactccctgccgttactgccctgtggggcaaggtgaacgtggatgaagttggtgtactccccctgggcaggctgctggtggtctacccttggacccagaggtcgactcggaccgatg

SEQ ID NO: 15353 - DNA, 203 bp, Homo sapiens
  source 1..203: mol_type = other DNA
ggcgcgccagtcctccattcttttctgacacaactgtgttcactagcaactactcccagacaccatggtgcatctgactcctgaggtactccctgccgttactgccctgtggggcaaggtgaacgtggatgaagttggtgtactccccctgggcaggctgctggtggtctaccctttactcccgaggtcgactcggaccgatg

SEQ ID NO: 15354 - DNA, 203 bp, Homo sapiens
  source 1..203: mol_type = other DNA
ggcgcgccagtcctcccatgtgtcctgacacaactgtgttcactagcaactactcccagacaccatggtgcatctgactcctgaggtactccctgccgttactgccctgtggggcaaggtgatactccctgaagttggtggtgaggccctgggcaggctactcccggtctaccctttactcccgaggtcgactcggaccgatg

SEQ ID NO: 15355 - DNA, 203 bp, Homo sapiens
  source 1..203: mol_type = other DNA
ggcgcgccagtcctgagcatgtgcctgacacaactgtgttcactagcaactactcccagacaccatggtgcatctgactcctgaggtactccctgccgttactgccctgtggggcaaggtgatactccctgaagttggtggtgaggccctgggcaggctgctggtggtctacccttggacccagaggtcgactcggaccgatg

SEQ ID NO: 15356 - DNA, 203 bp, Homo sapiens
  source 1..203: mol_type = other DNA
ggcgcgccagtcctgctcatgtgtctgacacaactgtgttcactagcaactactcccagacaccatggtgcatctgactcctgaggtactccctgccgttactgccctgtggggcaaggtgatactccctgaagttggtgtactccccctgggcaggctactcccggtctacccttggacccagaggtcgactcggaccgatg

SEQ ID NO: 15357 - DNA, 203 bp, Homo sapiens
  source 1..203: mol_type = other DNA
ggcgcgccagtccttacatgtggactgacacaactgtgttcactagcaactactcccagacaccatggtgcatctgactcctgaggtactccctgccgttactgccctgtggggcaaggtgatactccctgaagttggtgtactccccctgggcaggctactcccggtctaccctttactcccgaggtcgactcggaccgatg

SEQ ID NO: 15358 - DNA, 203 bp, Homo sapiens
  source 1..203: mol_type = other DNA
ggcgcgccagtcctcatgtgcatactgacacaactgtgttcactagcaactactcccagacaccatggtgcatctgactcctgaggtactccctgccgttactgccctgtggggcaaggtgatactccctgaagttggtgtactccccctgggcaggctgctggtggtctacccttggacccagaggtcgactcggaccgatg

SEQ ID NO: 15359 - DNA, 203 bp, Homo sapiens
  source 1..203: mol_type = other DNA
ggcgcgccagtcctcttcatgtgcctgacacaactgtgttcactagcaactactcccagacaccatggtgcatctgactcctgaggtactccctgccgttactgtactcccgggcaaggtgaacgtggatgaagttggtggtgaggccctgggcaggctactcccggtctacccttggacccagaggtcgactcggaccgatg

SEQ ID NO: 15360 - DNA, 203 bp, Homo sapiens
  source 1..203: mol_type = other DNA
ggcgcgccagtccttcacatgtgcctgacacaactgtgttcactagcaactactcccagacaccatggtgcatctgactcctgaggtactccctgccgttactgtactcccgggcaaggtgaacgtggatgaagttggtggtgaggccctgggcaggctactcccggtctaccctttactcccgaggtcgactcggaccgatg

SEQ ID NO: 15361 - DNA, 203 bp, Homo sapiens
  source 1..203: mol_type = other DNA
ggcgcgccagtcctcacatggtacctgacacaactgtgttcactagcaactactcccagacaccatggtgcatctgactcctgaggtactccctgccgttactgtactcccgggcaaggtgaacgtggatgaagttggtggtgaggccctgggcaggctgctggtggtctaccctttactcccgaggtcgactcggaccgatg

SEQ ID NO: 15362 - DNA, 203 bp, Homo sapiens
  source 1..203: mol_type = other DNA
ggcgcgccagtcctacacatggacctgacacaactgtgttcactagcaactactcccagacaccatggtgcatctgactcctgaggtactccctgccgttactgtactcccgggcaaggtgaacgtggatgaagttggtgtactccccctgggcaggctactcccggtctacccttggacccagaggtcgactcggaccgatg

SEQ ID NO: 15363 - DNA, 203 bp, Homo sapiens
  source 1..203: mol_type = other DNA
ggcgcgccagtccttctgcacatgctgacacaactgtgttcactagcaactactcccagacaccatggtgcatctgactcctgaggtactccctgccgttactgtactcccgggcaaggtgaacgtggatgaagttggtgtactccccctgggcaggctactcccggtctaccctttactcccgaggtcgactcggaccgatg

SEQ ID NO: 15364 - DNA, 203 bp, Homo sapiens
  source 1..203: mol_type = other DNA
ggcgcgccagtcctctacacatgtctgacacaactgtgttcactagcaactactcccagacaccatggtgcatctgactcctgaggtactccctgccgttactgtactcccgggcaaggtgaacgtggatgaagttggtgtactccccctgggcaggctgctggtggtctacccttggacccagaggtcgactcggaccgatg

SEQ ID NO: 15365 - DNA, 203 bp, Homo sapiens
  source 1..203: mol_type = other DNA
ggcgcgccagtcctataccacatgctgacacaactgtgttcactagcaactactcccagacaccatggtgcatctgactcctgaggtactccctgccgttactgtactcccgggcaaggtgatactccctgaagttggtggtgaggccctgggcaggctactcccggtctacccttggacccagaggtcgactcggaccgatg

SEQ ID NO: 15366 - DNA, 203 bp, Homo sapiens
  source 1..203: mol_type = other DNA
ggcgcgccagtccttccacatgtcctgacacaactgtgttcactagcaactactcccagacaccatggtgcatctgactcctgaggtactccctgccgttactgtactcccgggcaaggtgatactccctgaagttggtggtgaggccctgggcaggctactcccggtctaccctttactcccgaggtcgactcggaccgatg

SEQ ID NO: 15367 - DNA, 203 bp, Homo sapiens
  source 1..203: mol_type = other DNA
ggcgcgccagtcctgtcacatgggctgacacaactgtgttcactagcaactactcccagacaccatggtgcatctgactcctgaggtactccctgccgttactgtactcccgggcaaggtgatactccctgaagttggtggtgaggccctgggcaggctgctggtggtctacccttggacccagaggtcgactcggaccgatg

SEQ ID NO: 15368 - DNA, 203 bp, Homo sapiens
  source 1..203: mol_type = other DNA
ggcgcgccagtcctccacatgtaactgacacaactgtgttcactagcaactactcccagacaccatggtgcatctgactcctgaggtactccctgccgttactgtactcccgggcaaggtgatactccctgaagttggtggtgaggccctgggcaggctgctggtggtctaccctttactcccgaggtcgactcggaccgatg

SEQ ID NO: 15369 - DNA, 203 bp, Homo sapiens
  source 1..203: mol_type = other DNA
ggcgcgccagtccttttaaacctcctgacacaactgtgttcactagcaactactcccagacaccatggtgcatctgactcctgaggtactccctgccgttactgtactcccgggcaaggtgatactccctgaagttggtgtactccccctgggcaggctactcccggtctaccctttactcccgaggtcgactcggaccgatg

SEQ ID NO: 15370 - DNA, 203 bp, Homo sapiens
  source 1..203: mol_type = other DNA
ggcgcgccagtcctatgagcgtgcctgacacaactgtgttcactagcaacttcttggcaaaaccatggtgcatctgactcctgaggagaagtctgccgttactgccctgtggggcaaggtgaacgtggatgaagttggtgttcttggcaaaggcaggcttcttggcaaatacccttggacccagaggtcgactcggaccgatg

SEQ ID NO: 15371 - DNA, 203 bp, Homo sapiens
  source 1..203: mol_type = other DNA
ggcgcgccagtcctattgcgtgcactgacacaactgtgttcactagcaacttcttggcaaaaccatggtgcatctgactcctgaggagaagtctgccgttactgccctgtggggcaaggtgattcttggcaaagttggtgttcttggcaaaggcaggcttcttggcaaatacccttggacccagaggtcgactcggaccgatg

SEQ ID NO: 15372 - DNA, 203 bp, Homo sapiens
  source 1..203: mol_type = other DNA
ggcgcgccagtccttagcacgcacctgacacaactgtgttcactagcaacttcttggcaaaaccatggtgcatctgactcctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15373 - DNA, 203 bp, Homo sapiens
  source 1..203: mol_type = other DNA
ggcgcgccagtccttttagcacgcctgacacaactgtgttcactagcaacttcttggcaaaaccatggtgcatctgactcctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15374 - DNA, 203 bp, Homo sapiens
  source 1..203: mol_type = other DNA
ggcgcgccagtcctgagcacgctactgacacaactgtgttcactagcaacttcttggcaaaaccatggtgcatctgactcctgaggagaagtctgccgttactgttcttggcaaaaaggtgattcttggcaaagttggtggtgaggccctgggcaggcttcttggcaaatacccttggacccagaggtcgactcggaccgatg

SEQ ID NO: 15375 - DNA, 203 bp, Homo sapiens
  source 1..203: mol_type = other DNA
ggcgcgccagtcctatatgtggtgctgacacaactgtgttcactagcaacttcttggcaaaaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15376 - DNA, 203 bp, Homo sapiens
  source 1..203: mol_type = other DNA
ggcgcgccagtcctgttggatcccctgacacaactgtgttcactagcaacttcttggcaaaaccatggtgcatctgactcctgaggttcttggcaaagttactgccctgtggggcaaggtgaacgtggatgaagttggtgttcttggcaaaggcaggctgctggtggtctacccttggacccagaggtcgactcggaccgatg

SEQ ID NO: 15377 - DNA, 203 bp, Homo sapiens
  source 1..203: mol_type = other DNA
ggcgcgccagtcctaatttgaaacctgacacaactgtgttcactagcaacttcttggcaaaaccatggtgcatctgactcctgaggttcttggcaaagttactgccctgtggggcaaggtgaacgtggatgaagttggtgttcttggcaaaggcaggcttcttggcaaatacccttggacccagaggtcgactcggaccgatg

SEQ ID NO: 15378 - DNA, 203 bp, Homo sapiens
  source 1..203: mol_type = other DNA
ggcgcgccagtccttgctgattcgctgacacaactgtgttcactagcaacttcttggcaaaaccatggtgcatctgactcctgaggttcttggcaaagttactgccctgtggggcaaggtgattcttggcaaagttggtggtgaggccctgggcaggcttcttggcaaatacccttggacccagaggtcgactcggaccgatg

SEQ ID NO: 15379 - DNA, 203 bp, Homo sapiens
  source 1..203: mol_type = other DNA
ggcgcgccagtcctgctgcagtagctgacacaactgtgttcactagcaacttcttggcaaaaccatggtgcatctgactcctgaggttcttggcaaagttactgccctgtggggcaaggtgattcttggcaaagttggtgttcttggcaaaggcaggctgctggtggtctacccttggacccagaggtcgactcggaccgatg

SEQ ID NO: 15380 - DNA, 203 bp, Homo sapiens
  source 1..203: mol_type = other DNA
ggcgcgccagtcctgttttaagctctgacacaactgtgttcactagcaacttcttggcaaaaccatggtgcatctgactcctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15381 - DNA, 203 bp, Homo sapiens
  source 1..203: mol_type = other DNA
ggcgcgccagtcctaagattttagctgacacaactgtgttcactagcaacttcttggcaaaaccatggtgcatctgactcctgaggttcttggcaaagttactgttcttggcaaaaaggtgaacgtggatgaagttggtgttcttggcaaaggcaggcttcttggcaaatacccttggacccagaggtcgactcggaccgatg

SEQ ID NO: 15382 - DNA, 203 bp, Homo sapiens
  source 1..203: mol_type = other DNA
ggcgcgccagtcctattttactggctgacacaactgtgttcactagcaacttcttggcaaaaccatggttcttggcaaacctgaggagaagtctgccgttactgccctgtggggcaaggtgaacgtggatgaagttggtgttcttggcaaaggcaggctgctggtggtctacccttggacccagaggtcgactcggaccgatg

SEQ ID NO: 15383 - DNA, 203 bp, Homo sapiens
  source 1..203: mol_type = other DNA
ggcgcgccagtcctcgttttaaatctgacacaactgtgttcactagcaacttcttggcaaaaccatggttcttggcaaacctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15384 - DNA, 203 bp, Homo sapiens
  source 1..203: mol_type = other DNA
ggcgcgccagtccttaaaatcgttctgacacaactgtgttcactagcaacttcttggcaaaaccatggttcttggcaaacctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15385 - DNA, 203 bp, Homo sapiens
  source 1..203: mol_type = other DNA
ggcgcgccagtcctagttaaaatcctgacacaactgtgttcactagcaacttcttggcaaaaccatggttcttggcaaacctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15386 - DNA, 203 bp, Homo sapiens
  source 1..203: mol_type = other DNA
ggcgcgccagtcctgtgttaaaagctgacacaactgtgttcactagcaacttcttggcaaaaccatggttcttggcaaacctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15387 - DNA, 203 bp, Homo sapiens
  source 1..203: mol_type = other DNA
ggcgcgccagtccttaaaattgacctgacacaactgtgttcactagcaacttcttggcaaaaccatggttcttggcaaacctgaggagaagtctgccgttactgttcttggcaaaaaggtgattcttggcaaagttggtgttcttggcaaaggcaggcttcttggcaaatacccttggacccagaggtcgactcggaccgatg

SEQ ID NO: 15388 - DNA, 203 bp, Homo sapiens
  source 1..203: mol_type = other DNA
ggcgcgccagtcctcctaaaagtcctgacacaactgtgttcactagcaacttcttggcaaaaccatggttcttggcaaacctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15389 - DNA, 203 bp, Homo sapiens
  source 1..203: mol_type = other DNA
ggcgcgccagtcctgaatctaaaactgacacaactgtgttcactagcaacttcttggcaaaaccatggttcttggcaaacctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15390 - DNA, 203 bp, Homo sapiens
  source 1..203: mol_type = other DNA
ggcgcgccagtccttagtaaaagtctgacacaactgtgttcactagcaacttcttggcaaaaccatggttcttggcaaacctgaggttcttggcaaagttactgccctgtggggcaaggtgaacgtggatgaagttggtgttcttggcaaaggcaggctgctggtggtctacccttggacccagaggtcgactcggaccgatg

SEQ ID NO: 15391 - DNA, 203 bp, Homo sapiens
  source 1..203: mol_type = other DNA
ggcgcgccagtccttaggttaaaactgacacaactgtgttcactagcaacttcttggcaaaaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15392 - DNA, 203 bp, Homo sapiens
  source 1..203: mol_type = other DNA
ggcgcgccagtccttaaaagcagtctgacacaactgtgttcactagcaacttcttggcaaaaccatggttcttggcaaacctgaggttcttggcaaagttactgttcttggcaaaaaggtgaacgtggatgaagttggtggtgaggccctgggcaggcttcttggcaaatacccttggacccagaggtcgactcggaccgatg

SEQ ID NO: 15393 - DNA, 203 bp, Homo sapiens
  source 1..203: mol_type = other DNA
ggcgcgccagtccttaaaagattgctgacacaactgtgttcactagcaacttcttggcaaaaccatggttcttggcaaacctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15394 - DNA, 203 bp, Homo sapiens
  source 1..203: mol_type = other DNA
ggcgcgccagtcctttaacatggactgacacaactgtgttcactagcaacttcttggcaaaaccatggttcttggcaaacctgaggttcttggcaaagttactgttcttggcaaaaaggtgattcttggcaaagttggtgttcttggcaaaggcaggcttcttggcaaatacccttttcttggcaaatcgactcggaccgatg

SEQ ID NO: 15395 - DNA, 203 bp, Homo sapiens
  source 1..203: mol_type = other DNA
ggcgcgccagtccttatgttacgtctgacacaactgtgttcactagcaagtttcagctttgcaaccatactccccccggaacccaaagactttggtttcccggaagctgcccggcgggtcatgggaataacgccgccgcatcgccggtcggcatcgtttatggtcggaactacgacggtatcagaggtcgactcggaccgatg

SEQ ID NO: 15396 - DNA, 203 bp, Homo sapiens
  source 1..203: mol_type = other DNA
ggcgcgccagtcctatgttactctctgacacaactgtgttcactagcaattcttggcaaacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 15397 - DNA, 203 bp, Homo sapiens
  source 1..203: mol_type = other DNA
ggcgcgccagtcctaccatgttacctgacacaactgtgttcactagcacacggaatcgagaaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15398 - DNA, 203 bp, Homo sapiens
  source 1..203: mol_type = other DNA
ggcgcgccagtcctaaagcgctctctgacacaactgtgttcactagcaccgcaggctccactcctggtggtgcccttccgtcaattcctttaagtttcagctttgcaaccatactccccccggaacccaaagactttggtttcccggaagctgcccggcgggtcatgggaataacgccgcccagaggtcgactcggaccgatg

SEQ ID NO: 15399 - DNA, 203 bp, Homo sapiens
  source 1..203: mol_type = other DNA
ggcgcgccagtcctagcgctcaccctgacacaactgtgttcactagcacgtcaattcctttaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15400 - DNA, 203 bp, Homo sapiens
  source 1..203: mol_type = other DNA
ggcgcgccagtcctagggtcgttcctgacacaactgtgttcactagcacgtcaattcctttaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15401 - DNA, 203 bp, Homo sapiens
  source 1..203: mol_type = other DNA
ggcgcgccagtcctgtctcgttcgctgacacaactgtgttcactagcatactcccacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15402 - DNA, 203 bp, Homo sapiens
  source 1..203: mol_type = other DNA
ggcgcgccagtcctcgaacgagccctgacacaactgtgttcactagcatgaggtttcccgtgttgagtcaaattaagccgcaggctccactcctggtggtgcccttccgtcaattcctttaagtttcagctttgcaaccatactccccccggaacccaaagactttggtttcccggaagcccagaggtcgactcggaccgatg

SEQ ID NO: 15403 - DNA, 203 bp, Homo sapiens
  source 1..203: mol_type = other DNA
ggcgcgccagtcctatcgttcaagctgacacaactgtgttcactagccggcgggtacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15404 - DNA, 203 bp, Homo sapiens
  source 1..203: mol_type = other DNA
ggcgcgccagtccttagaacgatcctgacacaactgtgttcactagccggcgggtacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15405 - DNA, 203 bp, Homo sapiens
  source 1..203: mol_type = other DNA
ggcgcgccagtcctgcgaacgagtctgacacaactgtgttcactagcgaactacgacggtatctgatcgtcttcgaacctccgactttcgttcttgattaatgaaaacattcttggcaaatgctttcgctctggtccgtcttgcgccggtccaagaatttcacctctagcggcgcaatacgcagaggtcgactcggaccgatg

SEQ ID NO: 15406 - DNA, 203 bp, Homo sapiens
  source 1..203: mol_type = other DNA
ggcgcgccagtccttcctgaccggctgacacaactgtgttcactagggtgaggtttcccgtgttgagtcaaattaagccgcaggctccactcctggtggtgcccttccgtcaattcctttaagtttcagctttgcaaccatactccccccggaacccaaagactttggtttcccggaagctgagaggtcgactcggaccgatg

SEQ ID NO: 15407 - DNA, 203 bp, Homo sapiens
  source 1..203: mol_type = other DNA
ggcgcgccagtcctgaaacaccggctgacacaactgtgttcactataggagaggagcgagcgaccaaaggaaccataactgatttaatgagccattcgcagtttcactgtaccggccgtgcgtactcagacatgcatggcttaatctttgagacaagcatatgctactggcaggatcaaccaggaggtcgactcggaccgatg

SEQ ID NO: 15408 - DNA, 203 bp, Homo sapiens
  source 1..203: mol_type = other DNA
ggcgcgccagtcctcaacgcccttctgacacaactgtgttcactccggcgggtaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 15409 - DNA, 203 bp, Homo sapiens
  source 1..203: mol_type = other DNA
ggcgcgccagtcctagccctctgcctgacacaactgtgttcactcgggtgaggtttcccgtgttgagtcaaattaagccgcaggctccactcctggtggtgcccttccgtcaattcctttaagtttcagctttgcaaccatactccccccggaacccaaagactttggtttcccggaagctgccaggtcgactcggaccgatg

SEQ ID NO: 15410 - DNA, 203 bp, Homo sapiens
  source 1..203: mol_type = other DNA
ggcgcgccagtcctcgcccttacgctgacacaactgtgttcacttactccctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15411 - DNA, 203 bp, Homo sapiens
  source 1..203: mol_type = other DNA
ggcgcgccagtcctggccctcacactgacacaactgtgttcactttcttggcaaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15412 - DNA, 203 bp, Homo sapiens
  source 1..203: mol_type = other DNA
ggcgcgccagtcctaggccctcaactgacacaactgtgttcacttttaagtttcagctttgcaaccatactccccccggaacccaaagactttggtttcccggaagctgcccggcgggtcatgggaataacgccgccgcatcgccggtcggcatcgtttatggtcggaactacgacggtatctgaggtcgactcggaccgatg

SEQ ID NO: 15413 - DNA, 203 bp, Homo sapiens
  source 1..203: mol_type = other DNA
ggcgcgccagtcctgtagccctctctgacacaactgtgttcattcttggcaaaaaacagacaccatggtgcatctgactcctgaggagaagtctgccgttactgccctgtggggcaaggtgaacgtggatgaagttggtggtgaggccctgggcaggctgctggtggtctacccttggaccggcgggtcgactcggaccgatg

SEQ ID NO: 15414 - DNA, 203 bp, Homo sapiens
  source 1..203: mol_type = other DNA
ggcgcgccagtcctaggccctttcctgacacaactgtgttccacggaatcgagaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15415 - DNA, 203 bp, Homo sapiens
  source 1..203: mol_type = other DNA
ggcgcgccagtcctagagagggcgctgacacaactgtgttccacggaatcgagaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15416 - DNA, 203 bp, Homo sapiens
  source 1..203: mol_type = other DNA
ggcgcgccagtcctaagggcaggcctgacacaactgtgttccacggaatcgagaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15417 - DNA, 203 bp, Homo sapiens
  source 1..203: mol_type = other DNA
ggcgcgccagtcctgcagggcccactgacacaactgtgttccgtcaattcctttaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15418 - DNA, 203 bp, Homo sapiens
  source 1..203: mol_type = other DNA
ggcgcgccagtccttctaagggcgctgacacaactgtgttctactcccacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15419 - DNA, 203 bp, Homo sapiens
  source 1..203: mol_type = other DNA
ggcgcgccagtcctttgcagggcgctgacacaactgtttcttggcaaaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15420 - DNA, 203 bp, Homo sapiens
  source 1..203: mol_type = other DNA
ggcgcgccagtcctcgaagggccgctgacacacacggaatcgagaacaaccacggaatcgagaaatggcacggaatcgagaagaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 15421 - DNA, 203 bp, Homo sapiens
  source 1..203: mol_type = other DNA
ggcgcgccagtcctcaaagggcgtctgacacacacggaatcgagaacaaccacggaatcgagaaatggcacggaatcgagaagaggagaagtctgccgttactgcacggaatcgagaagtgaacgtggatgaagttggtggtgaggccctgggcaggctgctggtggtctacccttggacccagaggtcgactcggaccgatg

SEQ ID NO: 15422 - DNA, 203 bp, Homo sapiens
  source 1..203: mol_type = other DNA
ggcgcgccagtcctttgtcaagatctgacacacacggaatcgagaacaaccacggaatcgagaaatggcacggaatcgagaagaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 15423 - DNA, 203 bp, Homo sapiens
  source 1..203: mol_type = other DNA
ggcgcgccagtcctgatcttgacactgacacacacggaatcgagaacaaccacggaatcgagaaatggcacggaatcgagaagaggagaagtctgccgttactgccctgtggggcaaggtgacacggaatcgagaaggtgcacggaatcgagaaaggctgctggtggtctacccttggacccagaggtcgactcggaccgatg

SEQ ID NO: 15424 - DNA, 203 bp, Homo sapiens
  source 1..203: mol_type = other DNA
ggcgcgccagtcctactgtcaacgctgacacacacggaatcgagaacaaccacggaatcgagaaatggcacggaatcgagaagaggagaagtctgccgttactgccctgtggggcaaggtgacacggaatcgagaaggtggtgaggccctgggcaggctgctggtggtctacccttggacccagaggtcgactcggaccgatg

SEQ ID NO: 15425 - DNA, 203 bp, Homo sapiens
  source 1..203: mol_type = other DNA
ggcgcgccagtccttatgtcaactctgacacacacggaatcgagaacaaccacggaatcgagaaatggcacggaatcgagaagaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 15426 - DNA, 203 bp, Homo sapiens
  source 1..203: mol_type = other DNA
ggcgcgccagtcctctgtcaaggactgacacacacggaatcgagaacaaccacggaatcgagaaatggcacggaatcgagaagaggcacggaatcgagaaactgcacggaatcgagaagtgaacgtggatgaagttggtggtgaggccctgggcaggccacggaatcgagaaccttggacccagaggtcgactcggaccgatg

SEQ ID NO: 15427 - DNA, 203 bp, Homo sapiens
  source 1..203: mol_type = other DNA
ggcgcgccagtcctgcgtcgtgttctgacacacacggaatcgagaacaaccacggaatcgagaaatggcacggaatcgagaagaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 15428 - DNA, 203 bp, Homo sapiens
  source 1..203: mol_type = other DNA
ggcgcgccagtccttcgacgcaccctgacacacacggaatcgagaacaaccacggaatcgagaaatggcacggaatcgagaagaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 15429 - DNA, 203 bp, Homo sapiens
  source 1..203: mol_type = other DNA
ggcgcgccagtcctttagcgacgcctgacacacacggaatcgagaacaaccacggaatcgagaaatggcacggaatcgagaagaggcacggaatcgagaaactgccctgtggggcaaggtgacacggaatcgagaaggtgcacggaatcgagaaaggccacggaatcgagaaccttggacccagaggtcgactcggaccgatg

SEQ ID NO: 15430 - DNA, 203 bp, Homo sapiens
  source 1..203: mol_type = other DNA
ggcgcgccagtcctgcaacgacgcctgacacacacggaatcgagaacaaccacggaatcgagaaatggcacggaatcgagaagaggcacggaatcgagaaactgccctgtggggcaaggtgacacggaatcgagaaggtgcacggaatcgagaaaggctgctggtggtctacccttggacccagaggtcgactcggaccgatg

SEQ ID NO: 15431 - DNA, 203 bp, Homo sapiens
  source 1..203: mol_type = other DNA
ggcgcgccagtcctgattcaggttctgacacacacggaatcgagaacaaccacggaatcgagaaatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 15432 - DNA, 203 bp, Homo sapiens
  source 1..203: mol_type = other DNA
ggcgcgccagtcctgtgttctctactgacacacacggaatcgagaacaaccacggaatcgagaaatggtgcatctgactcctgaggagaagtctgccgttactgcacggaatcgagaagtgacacggaatcgagaaggtggtgaggccctgggcaggctgctggtggtctacccttggacccagaggtcgactcggaccgatg

SEQ ID NO: 15433 - DNA, 203 bp, Homo sapiens
  source 1..203: mol_type = other DNA
ggcgcgccagtcctagactaaattctgacacacacggaatcgagaacaaccacggaatcgagaaatggtgcatctgactcctgaggagaagtctgccgttactgccctgtggggcaaggtgaacgtggatgaagttggtgcacggaatcgagaaaggctgctggtggtctacccttggacccagaggtcgactcggaccgatg

SEQ ID NO: 15434 - DNA, 203 bp, Homo sapiens
  source 1..203: mol_type = other DNA
ggcgcgccagtcctggatactaaactgacacacacggaatcgagaacaaccacggaatcgagaaatggtgcatctgactcctgaggagaagtctgccgttactgccctgtggggcaaggtgaacgtggatgaagttggtggtgaggccctgggcaggccacggaatcgagaaccttggacccagaggtcgactcggaccgatg

SEQ ID NO: 15435 - DNA, 203 bp, Homo sapiens
  source 1..203: mol_type = other DNA
ggcgcgccagtcctgtttagtcgcctgacacacacggaatcgagaacaaccacggaatcgagaaatggtgcatctgactcctgaggagaagtctgccgttactgccctgtggggcaaggtgacacggaatcgagaaggtggtgaggccctgggcaggccacggaatcgagaaccttggacccagaggtcgactcggaccgatg

SEQ ID NO: 15436 - DNA, 203 bp, Homo sapiens
  source 1..203: mol_type = other DNA
ggcgcgccagtcctaattttagtcctgacacacacggaatcgagaacaaccacggaatcgagaaatggtgcatctgactcctgaggcacggaatcgagaaactgcacggaatcgagaagtgaacgtggatgaagttggtggtgaggccctgggcaggctgctggtggtctacccttggacccagaggtcgactcggaccgatg

SEQ ID NO: 15437 - DNA, 203 bp, Homo sapiens
  source 1..203: mol_type = other DNA
ggcgcgccagtcctcacttcacacctgacacacacggaatcgagaacaaccacggaatcgagaaatggtgcatctgactcctgaggcacggaatcgagaaactgcacggaatcgagaagtgacacggaatcgagaaggtggtgaggccctgggcaggctgctggtggtctacccttggacccagaggtcgactcggaccgatg

SEQ ID NO: 15438 - DNA, 203 bp, Homo sapiens
  source 1..203: mol_type = other DNA
ggcgcgccagtcctgatcccgtccctgacacacacggaatcgagaacaaccacggaatcgagaaatggtgcatctgactcctgaggcacggaatcgagaaactgccctgtggggcaaggtgaacgtggatgaagttggtgcacggaatcgagaaaggctgctggtggtctacccttggacccagaggtcgactcggaccgatg

SEQ ID NO: 15439 - DNA, 203 bp, Homo sapiens
  source 1..203: mol_type = other DNA
ggcgcgccagtcctagtcccgtgactgacacacacggaatcgagaacaaccacggaatcgagaaatggtgcatctgactcctgaggcacggaatcgagaaactgccctgtggggcaaggtgacacggaatcgagaaggtgcacggaatcgagaaaggccacggaatcgagaaccttggacccagaggtcgactcggaccgatg

SEQ ID NO: 15440 - DNA, 203 bp, Homo sapiens
  source 1..203: mol_type = other DNA
ggcgcgccagtcctgtcccgatctctgacacacacggaatcgagaacaaccacggaatcgagaaatggtgcatctgactcctgaggcacggaatcgagaaactgccctgtggggcaaggtgacacggaatcgagaaggtgcacggaatcgagaaaggctgctggtggtctacccttggacccagaggtcgactcggaccgatg

SEQ ID NO: 15441 - DNA, 203 bp, Homo sapiens
  source 1..203: mol_type = other DNA
ggcgcgccagtccttcaatcccgtctgacacacacggaatcgagaacaaccacggaatcgagaaatggtgcatctgactcctgaggcacggaatcgagaaactgccctgtggggcaaggtgacacggaatcgagaaggtggtgaggccctgggcaggctgctggtggtctacccttggacccagaggtcgactcggaccgatg

SEQ ID NO: 15442 - DNA, 203 bp, Homo sapiens
  source 1..203: mol_type = other DNA
ggcgcgccagtcctttgtcccgagctgacacacacggaatcgagaacaacctcaaacagacaccatggcacggaatcgagaagaggagaagtctgccgttactgcacggaatcgagaagtgaacgtggatgaagttggtgcacggaatcgagaaaggctgctggtggtctacccttggacccagaggtcgactcggaccgatg

SEQ ID NO: 15443 - DNA, 203 bp, Homo sapiens
  source 1..203: mol_type = other DNA
ggcgcgccagtccttatcgggattctgacacacacggaatcgagaacaacctcaaacagacaccatggcacggaatcgagaagaggagaagtctgccgttactgcacggaatcgagaagtgacacggaatcgagaaggtgcacggaatcgagaaaggccacggaatcgagaaccttggacccagaggtcgactcggaccgatg

SEQ ID NO: 15444 - DNA, 203 bp, Homo sapiens
  source 1..203: mol_type = other DNA
ggcgcgccagtcctttgcacgggactgacacacacggaatcgagaacaacctcaaacagacaccatggcacggaatcgagaagaggagaagtctgccgttactgcacggaatcgagaagtgacacggaatcgagaaggtggtgaggccctgggcaggccacggaatcgagaaccttggacccagaggtcgactcggaccgatg

SEQ ID NO: 15445 - DNA, 203 bp, Homo sapiens
  source 1..203: mol_type = other DNA
ggcgcgccagtcctatcgggatatctgacacacacggaatcgagaacaacctcaaacagacaccatggcacggaatcgagaagaggagaagtctgccgttactgcacggaatcgagaagtgacacggaatcgagaaggtggtgaggccctgggcaggctgctggtggtctacccttggacccagaggtcgactcggaccgatg

SEQ ID NO: 15446 - DNA, 203 bp, Homo sapiens
  source 1..203: mol_type = other DNA
ggcgcgccagtccttcaccgggacctgacacacacggaatcgagaacaacctcaaacagacaccatggcacggaatcgagaagaggagaagtctgccgttactgccctgtggggcaaggtgaacgtggatgaagttggtggtgaggccctgggcaggccacggaatcgagaaccttggacccagaggtcgactcggaccgatg

SEQ ID NO: 15447 - DNA, 203 bp, Homo sapiens
  source 1..203: mol_type = other DNA
ggcgcgccagtcctgtcgggacctctgacacacacggaatcgagaacaacctcaaacagacaccatggcacggaatcgagaagaggagaagtctgccgttactgccctgtggggcaaggtgaacgtggatgaagttggtggtgaggccctgggcaggctgctggtggtctacccttggacccagaggtcgactcggaccgatg

SEQ ID NO: 15448 - DNA, 203 bp, Homo sapiens
  source 1..203: mol_type = other DNA
ggcgcgccagtcctggtcgggatcctgacacacacggaatcgagaacaacctcaaacagacaccatggcacggaatcgagaagaggagaagtctgccgttactgccctgtggggcaaggtgacacggaatcgagaaggtgcacggaatcgagaaaggccacggaatcgagaaccttggacccagaggtcgactcggaccgatg

SEQ ID NO: 15449 - DNA, 203 bp, Homo sapiens
  source 1..203: mol_type = other DNA
ggcgcgccagtcctctcttacggtctgacacacacggaatcgagaacaacctcaaacagacaccatggcacggaatcgagaagaggcacggaatcgagaaactgcacggaatcgagaagtgaacgtggatgaagttggtgcacggaatcgagaaaggctgctggtggtctacccttggacccagaggtcgactcggaccgatg

SEQ ID NO: 15450 - DNA, 203 bp, Homo sapiens
  source 1..203: mol_type = other DNA
ggcgcgccagtcctaggcatgtaactgacacacacggaatcgagaacaacctcaaacagacaccatggcacggaatcgagaagaggcacggaatcgagaaactgcacggaatcgagaagtgacacggaatcgagaaggtgcacggaatcgagaaaggccacggaatcgagaaccttggacccagaggtcgactcggaccgatg

SEQ ID NO: 15451 - DNA, 203 bp, Homo sapiens
  source 1..203: mol_type = other DNA
ggcgcgccagtcctatgaggcattctgacacacacggaatcgagaacaacctcaaacagacaccatggcacggaatcgagaagaggcacggaatcgagaaactgccctgtggggcaaggtgaacgtggatgaagttggtgcacggaatcgagaaaggctgctggtggtctacccttggacccagaggtcgactcggaccgatg

SEQ ID NO: 15452 - DNA, 203 bp, Homo sapiens
  source 1..203: mol_type = other DNA
ggcgcgccagtccttgaggcatttctgacacacacggaatcgagaacaacctcaaacagacaccatggcacggaatcgagaagaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 15453 - DNA, 203 bp, Homo sapiens
  source 1..203: mol_type = other DNA
ggcgcgccagtccttctgggttcactgacacacacggaatcgagaacaacctcaaacagacaccatggtgcatctgactcctgaggagaagtctgccgttactgcacggaatcgagaagtgaacgtggatgaagttggtgcacggaatcgagaaaggccacggaatcgagaaccttggacccagaggtcgactcggaccgatg

SEQ ID NO: 15454 - DNA, 203 bp, Homo sapiens
  source 1..203: mol_type = other DNA
ggcgcgccagtccttttgaaccctctgacacacacggaatcgagaacaacctcaaacagacaccatggtgcatctgactcctgaggagaagtctgccgttactgcacggaatcgagaagtgaacgtggatgaagttggtgcacggaatcgagaaaggctgctggtggtctacccttggacccagaggtcgactcggaccgatg

SEQ ID NO: 15455 - DNA, 203 bp, Homo sapiens
  source 1..203: mol_type = other DNA
ggcgcgccagtcctacacgttacactgacacacacggaatcgagaacaacctcaaacagacaccatggtgcatctgactcctgaggagaagtctgccgttactgcacggaatcgagaagtgaacgtggatgaagttggtggtgaggccctgggcaggccacggaatcgagaaccttggacccagaggtcgactcggaccgatg

SEQ ID NO: 15456 - DNA, 203 bp, Homo sapiens
  source 1..203: mol_type = other DNA
ggcgcgccagtcctacacgttctgctgacacacacggaatcgagaacaacctcaaacagacaccatggtgcatctgactcctgaggagaagtctgccgttactgcacggaatcgagaagtgaacgtggatgaagttggtggtgaggccctgggcaggctgctggtggtctacccttggacccagaggtcgactcggaccgatg

SEQ ID NO: 15457 - DNA, 203 bp, Homo sapiens
  source 1..203: mol_type = other DNA
ggcgcgccagtcctctgaacgtgtctgacacacacggaatcgagaacaacctcaaacagacaccatggtgcatctgactcctgaggagaagtctgccgttactgcacggaatcgagaagtgacacggaatcgagaaggtgcacggaatcgagaaaggctgctggtggtctacccttggacccagaggtcgactcggaccgatg

SEQ ID NO: 15458 - DNA, 203 bp, Homo sapiens
  source 1..203: mol_type = other DNA
ggcgcgccagtccttcgcactttgctgacacacacggaatcgagaacaacctcaaacagacaccatggtgcatctgactcctgaggagaagtctgccgttactgccctgtggggcaaggtgaacgtggatgaagttggtgcacggaatcgagaaaggctgctggtggtctacccttggacccagaggtcgactcggaccgatg

SEQ ID NO: 15459 - DNA, 203 bp, Homo sapiens
  source 1..203: mol_type = other DNA
ggcgcgccagtcctcccgggacgactgacacacacggaatcgagaacaacctcaaacagacaccatggtgcatctgactcctgaggagaagtctgccgttactgccctgtggggcaaggtgaacgtggatgaagttggtggtgaggccctgggcaggccacggaatcgagaaccttggacccagaggtcgactcggaccgatg

SEQ ID NO: 15460 - DNA, 203 bp, Homo sapiens
  source 1..203: mol_type = other DNA
ggcgcgccagtcctcaggacgagcctgacacacacggaatcgagaacaacctcaaacagacaccatggtgcatctgactcctgaggagaagtctgccgttactgccctgtggggcaaggtgacacggaatcgagaaggtggtgaggccctgggcaggctgctggtggtctacccttggacccagaggtcgactcggaccgatg

SEQ ID NO: 15461 - DNA, 203 bp, Homo sapiens
  source 1..203: mol_type = other DNA
ggcgcgccagtccttgtaagaactctgacacacacggaatcgagaacaacctcaaacagacaccatggtgcatctgactcctgaggcacggaatcgagaaactgcacggaatcgagaagtgaacgtggatgaagttggtgcacggaatcgagaaaggccacggaatcgagaaccttggacccagaggtcgactcggaccgatg

SEQ ID NO: 15462 - DNA, 203 bp, Homo sapiens
  source 1..203: mol_type = other DNA
ggcgcgccagtcctcttgaaacggctgacacacacggaatcgagaacaacctcaaacagacaccatggtgcatctgactcctgaggcacggaatcgagaaactgcacggaatcgagaagtgaacgtggatgaagttggtgcacggaatcgagaaaggctgctggtggtctacccttggacccagaggtcgactcggaccgatg

SEQ ID NO: 15463 - DNA, 203 bp, Homo sapiens
  source 1..203: mol_type = other DNA
ggcgcgccagtcctttgaccacggctgacacacacggaatcgagaacaacctcaaacagacaccatggtgcatctgactcctgaggcacggaatcgagaaactgcacggaatcgagaagtgaacgtggatgaagttggtggtgaggccctgggcaggccacggaatcgagaaccttggacccagaggtcgactcggaccgatg

SEQ ID NO: 15464 - DNA, 203 bp, Homo sapiens
  source 1..203: mol_type = other DNA
ggcgcgccagtcctgcggtcacggctgacacacacggaatcgagaacaacctcaaacagacaccatggtgcatctgactcctgaggcacggaatcgagaaactgcacggaatcgagaagtgacacggaatcgagaaggtggtgaggccctgggcaggccacggaatcgagaaccttggacccagaggtcgactcggaccgatg

SEQ ID NO: 15465 - DNA, 203 bp, Homo sapiens
  source 1..203: mol_type = other DNA
ggcgcgccagtcctagctgcacggctgacacacacggaatcgagaacaacctcaaacagacaccatggtgcatctgactcctgaggcacggaatcgagaaactgcacggaatcgagaagtgacacggaatcgagaaggtggtgaggccctgggcaggctgctggtggtctacccttggacccagaggtcgactcggaccgatg

SEQ ID NO: 15466 - DNA, 203 bp, Homo sapiens
  source 1..203: mol_type = other DNA
ggcgcgccagtcctacagctacggctgacacacacggaatcgagaacaacctcaaacagacaccatggtgcatctgactcctgaggcacggaatcgagaaactgccctgtggggcaaggtgaacgtggatgaagttggtggtgaggccctgggcaggccacggaatcgagaaccttggacccagaggtcgactcggaccgatg

SEQ ID NO: 15467 - DNA, 203 bp, Homo sapiens
  source 1..203: mol_type = other DNA
ggcgcgccagtcctaaattcacggctgacacacacggaatcgagaacaacctcaaacagacaccatggtgcatctgactcctgaggcacggaatcgagaaactgccctgtggggcaaggtgacacggaatcgagaaggtggtgaggccctgggcaggctgctggtggtctacccttggacccagaggtcgactcggaccgatg

SEQ ID NO: 15468 - DNA, 203 bp, Homo sapiens
  source 1..203: mol_type = other DNA
ggcgcgccagtcctttggatacggctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15469 - DNA, 203 bp, Homo sapiens
  source 1..203: mol_type = other DNA
ggcgcgccagtcctccgtggttaactgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15470 - DNA, 203 bp, Homo sapiens
  source 1..203: mol_type = other DNA
ggcgcgccagtcctccgttagtatctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15471 - DNA, 203 bp, Homo sapiens
  source 1..203: mol_type = other DNA
ggcgcgccagtcctccgtgaacttctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15472 - DNA, 203 bp, Homo sapiens
  source 1..203: mol_type = other DNA
ggcgcgccagtcctccgtcgatcgctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15473 - DNA, 203 bp, Homo sapiens
  source 1..203: mol_type = other DNA
ggcgcgccagtcctccgtctaggcctgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15474 - DNA, 203 bp, Homo sapiens
  source 1..203: mol_type = other DNA
ggcgcgccagtcctccgtgcaccactgacacaccggcgggtactagcaacccggcgggtacaccatggccggcgggtctcctgaggccggcgggtccgttactgccggcgggtgcaaggtgaccggcgggtaagttggtgccggcgggttgggcaggcccggcgggttctacccttccggcgggtggtcgactcggaccgatg

SEQ ID NO: 15475 - DNA, 203 bp, Homo sapiens
  source 1..203: mol_type = other DNA
ggcgcgccagtcctccgttgtcttctgacacaccggcgggtactagcaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15476 - DNA, 203 bp, Homo sapiens
  source 1..203: mol_type = other DNA
ggcgcgccagtccttgtcttgcggctgacacacgtcaattcctttacaaccgtcaattcctttaatggcgtcaattcctttagaggagaagtctgccgttactgcgtcaattcctttagtgaacgtggatgaagttggtggtgaggccctgggcaggccgtcaattcctttaccttggacccagaggtcgactcggaccgatg

SEQ ID NO: 15477 - DNA, 203 bp, Homo sapiens
  source 1..203: mol_type = other DNA
ggcgcgccagtcctcgtgaggcggctgacacacgtcaattcctttacaaccgtcaattcctttaatggcgtcaattcctttagaggagaagtctgccgttactgcgtcaattcctttagtgacgtcaattcctttaggtggtgaggccctgggcaggccgtcaattcctttaccttggacccagaggtcgactcggaccgatg

SEQ ID NO: 15478 - DNA, 203 bp, Homo sapiens
  source 1..203: mol_type = other DNA
ggcgcgccagtcctccgcagacctctgacacacgtcaattcctttacaaccgtcaattcctttaatggcgtcaattcctttagaggagaagtctgccgttactgcgtcaattcctttagtgacgtcaattcctttaggtggtgaggccctgggcaggctgctggtggtctacccttggacccagaggtcgactcggaccgatg

SEQ ID NO: 15479 - DNA, 203 bp, Homo sapiens
  source 1..203: mol_type = other DNA
ggcgcgccagtcctccgctgctgtctgacacacgtcaattcctttacaaccgtcaattcctttaatggcgtcaattcctttagaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15480 - DNA, 203 bp, Homo sapiens
  source 1..203: mol_type = other DNA
ggcgcgccagtcctccgcaagcaactgacacacgtcaattcctttacaaccgtcaattcctttaatggcgtcaattcctttagaggcgtcaattcctttaactgccctgtggggcaaggtgaacgtggatgaagttggtggtgaggccctgggcaggctgctggtggtctacccttggacccagaggtcgactcggaccgatg

SEQ ID NO: 15481 - DNA, 203 bp, Homo sapiens
  source 1..203: mol_type = other DNA
ggcgcgccagtcctccgccttttactgacacacgtcaattcctttacaaccgtcaattcctttaatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 15482 - DNA, 203 bp, Homo sapiens
  source 1..203: mol_type = other DNA
ggcgcgccagtcctgggatccaccctgacacacgtcaattcctttacaaccgtcaattcctttaatggcgtcaattcctttagaggcgtcaattcctttaactgcgtcaattcctttagtgacgtcaattcctttaggtgcgtcaattcctttaaggctgctggtggtctacccttggacccagaggtcgactcggaccgatg

SEQ ID NO: 15483 - DNA, 203 bp, Homo sapiens
  source 1..203: mol_type = other DNA
ggcgcgccagtcctacaagacattctgacacacgtcaattcctttacaaccgtcaattcctttaatggtgcatctgactcctgaggagaagtctgccgttactgccctgtggggcaaggtgaacgtggatgaagttggtgcgtcaattcctttaaggctgctggtggtctacccttggacccagaggtcgactcggaccgatg

SEQ ID NO: 15484 - DNA, 203 bp, Homo sapiens
  source 1..203: mol_type = other DNA
ggcgcgccagtcctatgtctggacctgacacacgtcaattcctttacaaccgtcaattcctttaatggtgcatctgactcctgaggagaagtctgccgttactgccctgtggggcaaggtgaacgtggatgaagttggtggtgaggccctgggcaggccgtcaattcctttaccttggacccagaggtcgactcggaccgatg

SEQ ID NO: 15485 - DNA, 203 bp, Homo sapiens
  source 1..203: mol_type = other DNA
ggcgcgccagtcctcatgtcttgcctgacacacgtcaattcctttacaaccgtcaattcctttaatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15486 - DNA, 203 bp, Homo sapiens
  source 1..203: mol_type = other DNA
ggcgcgccagtccttatgtctgtactgacacacgtcaattcctttacaaccgtcaattcctttaatggtgcatctgactcctgaggagaagtctgccgttactgccctgtggggcaaggtgacgtcaattcctttaggtggtgaggccctgggcaggccgtcaattcctttaccttggacccagaggtcgactcggaccgatg

SEQ ID NO: 15487 - DNA, 203 bp, Homo sapiens
  source 1..203: mol_type = other DNA
ggcgcgccagtcctagacatgtctctgacacacgtcaattcctttacaaccgtcaattcctttaatggtgcatctgactcctgaggagaagtctgccgttactgccctgtggggcaaggtgacgtcaattcctttaggtggtgaggccctgggcaggctgctggtggtctacccttggacccagaggtcgactcggaccgatg

SEQ ID NO: 15488 - DNA, 203 bp, Homo sapiens
  source 1..203: mol_type = other DNA
ggcgcgccagtccttatgtctaacctgacacacgtcaattcctttacaaccgtcaattcctttaatggtgcatctgactcctgaggagaagtctgccgttactgcgtcaattcctttagtgaacgtggatgaagttggtgcgtcaattcctttaaggctgctggtggtctacccttggacccagaggtcgactcggaccgatg

SEQ ID NO: 15489 - DNA, 203 bp, Homo sapiens
  source 1..203: mol_type = other DNA
ggcgcgccagtcctgtctgtcatactgacacacgtcaattcctttacaaccgtcaattcctttaatggtgcatctgactcctgaggagaagtctgccgttactgcgtcaattcctttagtgaacgtggatgaagttggtggtgaggccctgggcaggccgtcaattcctttaccttggacccagaggtcgactcggaccgatg

SEQ ID NO: 15490 - DNA, 203 bp, Homo sapiens
  source 1..203: mol_type = other DNA
ggcgcgccagtcctcgtaatgtcactgacacacgtcaattcctttacaaccgtcaattcctttaatggtgcatctgactcctgaggagaagtctgccgttactgcgtcaattcctttagtgacgtcaattcctttaggtgcgtcaattcctttaaggctgctggtggtctacccttggacccagaggtcgactcggaccgatg

SEQ ID NO: 15491 - DNA, 203 bp, Homo sapiens
  source 1..203: mol_type = other DNA
ggcgcgccagtcctgcgattagcactgacacacgtcaattcctttacaaccgtcaattcctttaatggtgcatctgactcctgaggagaagtctgccgttactgcgtcaattcctttagtgacgtcaattcctttaggtggtgaggccctgggcaggccgtcaattcctttaccttggacccagaggtcgactcggaccgatg

SEQ ID NO: 15492 - DNA, 203 bp, Homo sapiens
  source 1..203: mol_type = other DNA
ggcgcgccagtcctgtatccattactgacacacgtcaattcctttacaaccgtcaattcctttaatggtgcatctgactcctgaggcgtcaattcctttaactgccctgtggggcaaggtgaacgtggatgaagttggtgcgtcaattcctttaaggccgtcaattcctttaccttggacccagaggtcgactcggaccgatg

SEQ ID NO: 15493 - DNA, 203 bp, Homo sapiens
  source 1..203: mol_type = other DNA
ggcgcgccagtcctatcctaatccctgacacacgtcaattcctttacaaccgtcaattcctttaatggtgcatctgactcctgaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15494 - DNA, 203 bp, Homo sapiens
  source 1..203: mol_type = other DNA
ggcgcgccagtcctttcattagggctgacacacgtcaattcctttacaaccgtcaattcctttaatggtgcatctgactcctgaggcgtcaattcctttaactgccctgtggggcaaggtgaacgtggatgaagttggtggtgaggccctgggcaggctgctggtggtctacccttggacccagaggtcgactcggaccgatg

SEQ ID NO: 15495 - DNA, 203 bp, Homo sapiens
  source 1..203: mol_type = other DNA
ggcgcgccagtcctaaagcgtaatctgacacacgtcaattcctttacaaccgtcaattcctttaatggtgcatctgactcctgaggcgtcaattcctttaactgcgtcaattcctttagtgaacgtggatgaagttggtgcgtcaattcctttaaggccgtcaattcctttaccttggacccagaggtcgactcggaccgatg

SEQ ID NO: 15496 - DNA, 203 bp, Homo sapiens
  source 1..203: mol_type = other DNA
ggcgcgccagtccttagattagagctgacacacgtcaattcctttacaaccgtcaattcctttaatggtgcatctgactcctgaggcgtcaattcctttaactgcgtcaattcctttagtgaacgtggatgaagttggtgcgtcaattcctttaaggctgctggtggtctacccttggacccagaggtcgactcggaccgatg

SEQ ID NO: 15497 - DNA, 203 bp, Homo sapiens
  source 1..203: mol_type = other DNA
ggcgcgccagtcctcctggattacctgacacacgtcaattcctttacaaccgtcaattcctttaatggtgcatctgactcctgaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 15498 - DNA, 203 bp, Homo sapiens
  source 1..203: mol_type = other DNA
ggcgcgccagtcctctggtctaatctgacacacgtcaattcctttacaaccgtcaattcctttaatggtgcatctgactcctgaggcgtcaattcctttaactgcgtcaattcctttagtgaacgtggatgaagttggtggtgaggccctgggcaggctgctggtggtctacccttggacccagaggtcgactcggaccgatg

SEQ ID NO: 15499 - DNA, 203 bp, Homo sapiens
  source 1..203: mol_type = other DNA
ggcgcgccagtcctaagctctaatctgacacacgtcaattcctttacaaccgtcaattcctttaatggtgcatctgactcctgaggcgtcaattcctttaactgcgtcaattcctttagtgacgtcaattcctttaggtggtgaggccctgggcaggccgtcaattcctttaccttggacccagaggtcgactcggaccgatg

SEQ ID NO: 15500 - DNA, 203 bp, Homo sapiens
  source 1..203: mol_type = other DNA
ggcgcgccagtcctaactaatggtctgacacacgtcaattcctttacaaccgtcaattcctttaatggtgcatctgactcctgaggcgtcaattcctttaactgcgtcaattcctttagtgacgtcaattcctttaggtggtgaggccctgggcaggctgctggtggtctacccttggacccagaggtcgactcggaccgatg

SEQ ID NO: 15501 - DNA, 203 bp, Homo sapiens
  source 1..203: mol_type = other DNA
ggcgcgccagtcctaccagtaatgctgacacacgtcaattcctttacaacctcaaacagacaccatggcgtcaattcctttagaggagaagtctgccgttactgccctgtggggcaaggtgaacgtggatgaagttggtgcgtcaattcctttaaggccgtcaattcctttaccttggacccagaggtcgactcggaccgatg

SEQ ID NO: 15502 - DNA, 203 bp, Homo sapiens
  source 1..203: mol_type = other DNA
ggcgcgccagtccttcattactacctgacacacgtcaattcctttacaacctcaaacagacaccatggcgtcaattcctttagaggagaagtctgccgttactgccctgtggggcaaggtgaacgtggatgaagttggtgcgtcaattcctttaaggctgctggtggtctacccttggacccagaggtcgactcggaccgatg

SEQ ID NO: 15503 - DNA, 203 bp, Homo sapiens
  source 1..203: mol_type = other DNA
ggcgcgccagtcctagtttgtaatctgacacacgtcaattcctttacaacctcaaacagacaccatggcgtcaattcctttagaggagaagtctgccgttactgccctgtggggcaaggtgaacgtggatgaagttggtggtgaggccctgggcaggctgctggtggtctacccttggacccagaggtcgactcggaccgatg

SEQ ID NO: 15504 - DNA, 203 bp, Homo sapiens
  source 1..203: mol_type = other DNA
ggcgcgccagtcctaccctcattactgacacacgtcaattcctttacaacctcaaacagacaccatggcgtcaattcctttagaggagaagtctgccgttactgcgtcaattcctttagtgaacgtggatgaagttggtgcgtcaattcctttaaggctgctggtggtctacccttggacccagaggtcgactcggaccgatg

SEQ ID NO: 15505 - DNA, 203 bp, Homo sapiens
  source 1..203: mol_type = other DNA
ggcgcgccagtcctagagtaatgtctgacacacgtcaattcctttacaacctcaaacagacaccatggcgtcaattcctttagaggagaagtctgccgttactgcgtcaattcctttagtgaacgtggatgaagttggtggtgaggccctgggcaggccgtcaattcctttaccttggacccagaggtcgactcggaccgatg

SEQ ID NO: 15506 - DNA, 203 bp, Homo sapiens
  source 1..203: mol_type = other DNA
ggcgcgccagtcctctactaatgactgacacacgtcaattcctttacaacctcaaacagacaccatggcgtcaattcctttagaggagaagtctgccgttactgcgtcaattcctttagtgaacgtggatgaagttggtggtgaggccctgggcaggctgctggtggtctacccttggacccagaggtcgactcggaccgatg

SEQ ID NO: 15507 - DNA, 203 bp, Homo sapiens
  source 1..203: mol_type = other DNA
ggcgcgccagtcctgggcattagtctgacacacgtcaattcctttacaacctcaaacagacaccatggcgtcaattcctttagaggagaagtctgccgttactgcgtcaattcctttagtgacgtcaattcctttaggtgcgtcaattcctttaaggctgctggtggtctacccttggacccagaggtcgactcggaccgatg

SEQ ID NO: 15508 - DNA, 203 bp, Homo sapiens
  source 1..203: mol_type = other DNA
ggcgcgccagtcctctctcattagctgacacacgtcaattcctttacaacctcaaacagacaccatggcgtcaattcctttagaggcgtcaattcctttaactgccctgtggggcaaggtgaacgtggatgaagttggtgcgtcaattcctttaaggctgctggtggtctacccttggacccagaggtcgactcggaccgatg

SEQ ID NO: 15509 - DNA, 203 bp, Homo sapiens
  source 1..203: mol_type = other DNA
ggcgcgccagtcctgttaatcgtgctgacacacgtcaattcctttacaacctcaaacagacaccatggcgtcaattcctttagaggcgtcaattcctttaactgccctgtggggcaaggtgacgtcaattcctttaggtgcgtcaattcctttaaggccgtcaattcctttaccttggacccagaggtcgactcggaccgatg

SEQ ID NO: 15510 - DNA, 203 bp, Homo sapiens
  source 1..203: mol_type = other DNA
ggcgcgccagtcctattactcagcctgacacacgtcaattcctttacaacctcaaacagacaccatggcgtcaattcctttagaggcgtcaattcctttaactgccctgtggggcaaggtgacgtcaattcctttaggtgcgtcaattcctttaaggctgctggtggtctacccttggacccagaggtcgactcggaccgatg

SEQ ID NO: 15511 - DNA, 203 bp, Homo sapiens
  source 1..203: mol_type = other DNA
ggcgcgccagtcctgtaatcactcctgacacacgtcaattcctttacaacctcaaacagacaccatggcgtcaattcctttagaggcgtcaattcctttaactgccctgtggggcaaggtgacgtcaattcctttaggtggtgaggccctgggcaggccgtcaattcctttaccttggacccagaggtcgactcggaccgatg

SEQ ID NO: 15512 - DNA, 203 bp, Homo sapiens
  source 1..203: mol_type = other DNA
ggcgcgccagtccttccacattaactgacacacgtcaattcctttacaacctcaaacagacaccatggcgtcaattcctttagaggcgtcaattcctttaactgcgtcaattcctttagtgaacgtggatgaagttggtggtgaggccctgggcaggccgtcaattcctttaccttggacccagaggtcgactcggaccgatg

SEQ ID NO: 15513 - DNA, 203 bp, Homo sapiens
  source 1..203: mol_type = other DNA
ggcgcgccagtcctgactaatctgctgacacacgtcaattcctttacaacctcaaacagacaccatggcgtcaattcctttagaggcgtcaattcctttaactgcgtcaattcctttagtgacgtcaattcctttaggtgcgtcaattcctttaaggctgctggtggtctacccttggacccagaggtcgactcggaccgatg

SEQ ID NO: 15514 - DNA, 203 bp, Homo sapiens
  source 1..203: mol_type = other DNA
ggcgcgccagtcctttaatcgcaactgacacacgtcaattcctttacaacctcaaacagacaccatggcgtcaattcctttagaggcgtcaattcctttaactgcgtcaattcctttagtgacgtcaattcctttaggtggtgaggccctgggcaggccgtcaattcctttaccttggacccagaggtcgactcggaccgatg

SEQ ID NO: 15515 - DNA, 203 bp, Homo sapiens
  source 1..203: mol_type = other DNA
ggcgcgccagtcctagtaatcgtcctgacacacgtcaattcctttacaacctcaaacagacaccatggcgtcaattcctttagaggcgtcaattcctttaactgcgtcaattcctttagtgacgtcaattcctttaggtggtgaggccctgggcaggctgctggtggtctacccttggacccagaggtcgactcggaccgatg

SEQ ID NO: 15516 - DNA, 203 bp, Homo sapiens
  source 1..203: mol_type = other DNA
ggcgcgccagtcctatcgactaatctgacacacgtcaattcctttacaacctcaaacagacaccatggtgcatctgactcctgaggagaagtctgccgttactgccctgtggggcaaggtgaacgtggatgaagttggtgcgtcaattcctttaaggccgtcaattcctttaccttggacccagaggtcgactcggaccgatg

SEQ ID NO: 15517 - DNA, 203 bp, Homo sapiens
  source 1..203: mol_type = other DNA
ggcgcgccagtcctccaaggattactgacacacgtcaattcctttacaacctcaaacagacaccatggtgcatctgactcctgaggagaagtctgccgttactgcgtcaattcctttagtgaacgtggatgaagttggtgcgtcaattcctttaaggccgtcaattcctttaccttggacccagaggtcgactcggaccgatg

SEQ ID NO: 15518 - DNA, 203 bp, Homo sapiens
  source 1..203: mol_type = other DNA
ggcgcgccagtcctgattagggacctgacacacgtcaattcctttacaacctcaaacagacaccatggtgcatctgactcctgaggcgtcaattcctttaactgccctgtggggcaaggtgaacgtggatgaagttggtggtgaggccctgggcaggccgtcaattcctttaccttggacccagaggtcgactcggaccgatg

SEQ ID NO: 15519 - DNA, 203 bp, Homo sapiens
  source 1..203: mol_type = other DNA
ggcgcgccagtccttccttgtaatctgacacacgtcaattcctttacaacctcaaacagacaccatggtgcatctgactcctgaggcgtcaattcctttaactgccctgtggggcaaggtgacgtcaattcctttaggtgcgtcaattcctttaaggctgctggtggtctacccttggacccagaggtcgactcggaccgatg

SEQ ID NO: 15520 - DNA, 203 bp, Homo sapiens
  source 1..203: mol_type = other DNA
ggcgcgccagtcctcgtaacattactgacacacgtcaattcctttacaacctcaaacagacaccatggtgcatctgactcctgaggcgtcaattcctttaactgcgtcaattcctttagtgacgtcaattcctttaggtgcgtcaattcctttaaggccgtcaattcctttaccttggacccagaggtcgactcggaccgatg

SEQ ID NO: 15521 - DNA, 203 bp, Homo sapiens
  source 1..203: mol_type = other DNA
ggcgcgccagtccttgattacctcctgacacacgtcaattcctttacaacctcaaacagacaccatggtgcatctgactcctgaggcgtcaattcctttaactgcgtcaattcctttagtgacgtcaattcctttaggtggtgaggccctgggcaggctgctggtggtctacccttggacccagaggtcgactcggaccgatg

SEQ ID NO: 15522 - DNA, 203 bp, Homo sapiens
  source 1..203: mol_type = other DNA
ggcgcgccagtcctccctaatgaactgacacatactccctcactagcaactactcccagacaccatggtactcccgactcctgaggtactccctgccgttactgtactcccgggcaaggtgatactccctgaagttggtgtactccccctgggcaggctactcccggtctaccctttactcccgaggtcgactcggaccgatg

SEQ ID NO: 15523 - DNA, 203 bp, Homo sapiens
  source 1..203: mol_type = other DNA
ggcgcgccagtcctctaactaatgctgacacattcttggcaaatagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15524 - DNA, 203 bp, Homo sapiens
  source 1..203: mol_type = other DNA
ggcgcgccagtcctcagcgtaatgctgacacattcttggcaaatagcaacctcaaacagacaccatggtgcatctgactcctgaggagaagtctgccgttactgccctgtggggcaaggtgaacgtggatgaagttggtggtgaggccctgggcaggcttcttggcaaatacccttggacccagaggtcgactcggaccgatg

SEQ ID NO: 15525 - DNA, 203 bp, Homo sapiens
  source 1..203: mol_type = other DNA
ggcgcgccagtcctgcattagtgtctgacacattcttggcaaatagcaacctcaaacagacaccatggtgcatctgactcctgaggagaagtctgccgttactgccctgtggggcaaggtgaacgtggatgaagttggtgttcttggcaaaggcaggctgctggtggtctacccttggacccagaggtcgactcggaccgatg

SEQ ID NO: 15526 - DNA, 203 bp, Homo sapiens
  source 1..203: mol_type = other DNA
ggcgcgccagtcctgagcgttaatctgacacattcttggcaaatagcaacctcaaacagacaccatggtgcatctgactcctgaggagaagtctgccgttactgccctgtggggcaaggtgattcttggcaaagttggtggtgaggccctgggcaggctgctggtggtctacccttggacccagaggtcgactcggaccgatg

SEQ ID NO: 15527 - DNA, 203 bp, Homo sapiens
  source 1..203: mol_type = other DNA
ggcgcgccagtcctgcgacgattactgacacattcttggcaaatagcaacctcaaacagacaccatggtgcatctgactcctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15528 - DNA, 203 bp, Homo sapiens
  source 1..203: mol_type = other DNA
ggcgcgccagtccttaatcttcacctgacacattcttggcaaatagcaacctcaaacagacaccatggtgcatctgactcctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15529 - DNA, 203 bp, Homo sapiens
  source 1..203: mol_type = other DNA
ggcgcgccagtcctcagattactcctgacacattcttggcaaatagcaacctcaaacagacaccatggtgcatctgactcctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15530 - DNA, 203 bp, Homo sapiens
  source 1..203: mol_type = other DNA
ggcgcgccagtccttgtagattaactgacacattcttggcaaatagcaacctcaaacagacaccatggtgcatctgactcctgaggagaagtctgccgttactgttcttggcaaaaaggtgattcttggcaaagttggtggtgaggccctgggcaggctgctggtggtctacccttggacccagaggtcgactcggaccgatg

SEQ ID NO: 15531 - DNA, 203 bp, Homo sapiens
  source 1..203: mol_type = other DNA
ggcgcgccagtccttctaatgaacctgacacattcttggcaaatagcaacctcaaacagacaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15532 - DNA, 203 bp, Homo sapiens
  source 1..203: mol_type = other DNA
ggcgcgccagtcctattagttagtctgacacattcttggcaaatagcaacctcaaacagacaccatggtgcatctgactcctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15533 - DNA, 203 bp, Homo sapiens
  source 1..203: mol_type = other DNA
ggcgcgccagtccttggtaatcggctgacacattcttggcaaatagcaacctcaaacagacaccatggtgcatctgactcctgaggttcttggcaaagttactgttcttggcaaaaaggtgaacgtggatgaagttggtgttcttggcaaaggcaggctgctggtggtctacccttggacccagaggtcgactcggaccgatg

SEQ ID NO: 15534 - DNA, 203 bp, Homo sapiens
  source 1..203: mol_type = other DNA
ggcgcgccagtcctatccattacactgacacattcttggcaaatagcaacctcaaacagacaccatggtgcatctgactcctgaggttcttggcaaagttactgttcttggcaaaaaggtgattcttggcaaagttggtggtgaggccctgggcaggctgctggtggtctacccttggacccagaggtcgactcggaccgatg

SEQ ID NO: 15535 - DNA, 203 bp, Homo sapiens
  source 1..203: mol_type = other DNA
ggcgcgccagtccttgattagcgactgacacattcttggcaaatagcaacctcaaacagacaccatggttcttggcaaacctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15536 - DNA, 203 bp, Homo sapiens
  source 1..203: mol_type = other DNA
ggcgcgccagtcctgtggtaatggctgacacattcttggcaaatagcaacctcaaacagacaccatggttcttggcaaacctgaggagaagtctgccgttactgttcttggcaaaaaggtgattcttggcaaagttggtggtgaggccctgggcaggctgctggtggtctacccttggacccagaggtcgactcggaccgatg

SEQ ID NO: 15537 - DNA, 203 bp, Homo sapiens
  source 1..203: mol_type = other DNA
ggcgcgccagtcctcgtcattaccctgacacattcttggcaaatagcaacctcaaacagacaccatggttcttggcaaacctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15538 - DNA, 203 bp, Homo sapiens
  source 1..203: mol_type = other DNA
ggcgcgccagtcctcaggattaacctgacacattcttggcaaatagcaacctcaaacagacaccatggttcttggcaaacctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15539 - DNA, 203 bp, Homo sapiens
  source 1..203: mol_type = other DNA
ggcgcgccagtcctcgtggtaatcctgacacattcttggcaaatagcaacctcaaacagacaccatggttcttggcaaacctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15540 - DNA, 203 bp, Homo sapiens
  source 1..203: mol_type = other DNA
ggcgcgccagtcctattaggcccactgacacattcttggcaaatagcaacctcaaacagacaccatggttcttggcaaacctgaggttcttggcaaagttactgccctgtggggcaaggtgattcttggcaaagttggtggtgaggccctgggcaggctgctggtggtctacccttggacccagaggtcgactcggaccgatg

SEQ ID NO: 15541 - DNA, 203 bp, Homo sapiens
  source 1..203: mol_type = other DNA
ggcgcgccagtccttacattaacgctgacacattcttggcaaatagcaacctcaaacagacaccatggttcttggcaaacctgaggttcttggcaaagttactgccctgtggggcaaggtgattcttggcaaagttggtgttcttggcaaaggcaggcttcttggcaaatacccttggacccagaggtcgactcggaccgatg

SEQ ID NO: 15542 - DNA, 203 bp, Homo sapiens
  source 1..203: mol_type = other DNA
ggcgcgccagtcctattactagtcctgacacattcttggcaaatagcaacctcaaacagacaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15543 - DNA, 203 bp, Homo sapiens
  source 1..203: mol_type = other DNA
ggcgcgccagtccttgttaatgccctgacacattcttggcaaatagcaacctcaaacagacaccatggttcttggcaaacctgaggttcttggcaaagttactgttcttggcaaaaaggtgaacgtggatgaagttggtgttcttggcaaaggcaggctgctggtggtctacccttggacccagaggtcgactcggaccgatg

SEQ ID NO: 15544 - DNA, 203 bp, Homo sapiens
  source 1..203: mol_type = other DNA
ggcgcgccagtccttttgcgctcactgacacattcttggcaaatagcaacttcttggcaaaaccatggtgcatctgactcctgaggagaagtctgccgttactgccctgtggggcaaggtgaacgtggatgaagttggtgttcttggcaaaggcaggcttcttggcaaatacccttggacccagaggtcgactcggaccgatg

SEQ ID NO: 15545 - DNA, 203 bp, Homo sapiens
  source 1..203: mol_type = other DNA
ggcgcgccagtcctagttgcgctactgacacattcttggcaaatagcaacttcttggcaaaaccatggtgcatctgactcctgaggagaagtctgccgttactgccctgtggggcaaggtgattcttggcaaagttggtggtgaggccctgggcaggcttcttggcaaatacccttggacccagaggtcgactcggaccgatg

SEQ ID NO: 15546 - DNA, 203 bp, Homo sapiens
  source 1..203: mol_type = other DNA
ggcgcgccagtcctgttgcgcattctgacacattcttggcaaatagcaacttcttggcaaaaccatggtgcatctgactcctgaggagaagtctgccgttactgccctgtggggcaaggtgattcttggcaaagttggtgttcttggcaaaggcaggctgctggtggtctacccttggacccagaggtcgactcggaccgatg

SEQ ID NO: 15547 - DNA, 203 bp, Homo sapiens
  source 1..203: mol_type = other DNA
ggcgcgccagtcctatgcgcaacactgacacattcttggcaaatagcaacttcttggcaaaaccatggtgcatctgactcctgaggagaagtctgccgttactgttcttggcaaaaaggtgaacgtggatgaagttggtgttcttggcaaaggcaggctgctggtggtctacccttggacccagaggtcgactcggaccgatg

SEQ ID NO: 15548 - DNA, 203 bp, Homo sapiens
  source 1..203: mol_type = other DNA
ggcgcgccagtcctccagcgaacactgacacattcttggcaaatagcaacttcttggcaaaaccatggtgcatctgactcctgaggagaagtctgccgttactgttcttggcaaaaaggtgattcttggcaaagttggtggtgaggccctgggcaggcttcttggcaaatacccttggacccagaggtcgactcggaccgatg

SEQ ID NO: 15549 - DNA, 203 bp, Homo sapiens
  source 1..203: mol_type = other DNA
ggcgcgccagtcctcccagcgtacctgacacattcttggcaaatagcaacttcttggcaaaaccatggtgcatctgactcctgaggttcttggcaaagttactgccctgtggggcaaggtgaacgtggatgaagttggtggtgaggccctgggcaggctgctggtggtctacccttggacccagaggtcgactcggaccgatg

SEQ ID NO: 15550 - DNA, 203 bp, Homo sapiens
  source 1..203: mol_type = other DNA
ggcgcgccagtcctagtcgctggtctgacacattcttggcaaatagcaacttcttggcaaaaccatggtgcatctgactcctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15551 - DNA, 203 bp, Homo sapiens
  source 1..203: mol_type = other DNA
ggcgcgccagtcctccagcggtagctgacacattcttggcaaatagcaacttcttggcaaaaccatggtgcatctgactcctgaggttcttggcaaagttactgccctgtggggcaaggtgattcttggcaaagttggtggtgaggccctgggcaggctgctggtggtctacccttggacccagaggtcgactcggaccgatg

SEQ ID NO: 15552 - DNA, 203 bp, Homo sapiens
  source 1..203: mol_type = other DNA
ggcgcgccagtcctccagcgtagcctgacacattcttggcaaatagcaacttcttggcaaaaccatggtgcatctgactcctgaggttcttggcaaagttactgccctgtggggcaaggtgattcttggcaaagttggtgttcttggcaaaggcaggctgctggtggtctacccttggacccagaggtcgactcggaccgatg

SEQ ID NO: 15553 - DNA, 203 bp, Homo sapiens
  source 1..203: mol_type = other DNA
ggcgcgccagtcctagaattgaatctgacacattcttggcaaatagcaacttcttggcaaaaccatggtgcatctgactcctgaggttcttggcaaagttactgccctgtggggcaaggtgattcttggcaaagttggtgttcttggcaaaggcaggcttcttggcaaatacccttggacccagaggtcgactcggaccgatg

SEQ ID NO: 15554 - DNA, 203 bp, Homo sapiens
  source 1..203: mol_type = other DNA
ggcgcgccagtcctgacgcagactctgacacattcttggcaaatagcaacttcttggcaaaaccatggtgcatctgactcctgaggttcttggcaaagttactgttcttggcaaaaaggtgattcttggcaaagttggtggtgaggccctgggcaggcttcttggcaaatacccttggacccagaggtcgactcggaccgatg

SEQ ID NO: 15555 - DNA, 203 bp, Homo sapiens
  source 1..203: mol_type = other DNA
ggcgcgccagtccttttggatcaactgacacattcttggcaaatagcaacttcttggcaaaaccatggttcttggcaaacctgaggagaagtctgccgttactgccctgtggggcaaggtgaacgtggatgaagttggtgttcttggcaaaggcaggctgctggtggtctacccttggacccagaggtcgactcggaccgatg

SEQ ID NO: 15556 - DNA, 203 bp, Homo sapiens
  source 1..203: mol_type = other DNA
ggcgcgccagtccttgagcgtggactgacacattcttggcaaatagcaacttcttggcaaaaccatggttcttggcaaacctgaggagaagtctgccgttactgccctgtggggcaaggtgattcttggcaaagttggtgttcttggcaaaggcaggctgctggtggtctacccttggacccagaggtcgactcggaccgatg

SEQ ID NO: 15557 - DNA, 203 bp, Homo sapiens
  source 1..203: mol_type = other DNA
ggcgcgccagtcctttgcgtggacctgacacattcttggcaaatagcaacttcttggcaaaaccatggttcttggcaaacctgaggagaagtctgccgttactgttcttggcaaaaaggtgaacgtggatgaagttggtggtgaggccctgggcaggcttcttggcaaatacccttggacccagaggtcgactcggaccgatg

SEQ ID NO: 15558 - DNA, 203 bp, Homo sapiens
  source 1..203: mol_type = other DNA
ggcgcgccagtccttatgagatcgctgacacattcttggcaaatagcaacttcttggcaaaaccatggttcttggcaaacctgaggagaagtctgccgttactgttcttggcaaaaaggtgaacgtggatgaagttggtgttcttggcaaaggcaggcttcttggcaaatacccttggacccagaggtcgactcggaccgatg

SEQ ID NO: 15559 - DNA, 203 bp, Homo sapiens
  source 1..203: mol_type = other DNA
ggcgcgccagtccttggatctcaactgacacattcttggcaaatagcaacttcttggcaaaaccatggttcttggcaaacctgaggagaagtctgccgttactgttcttggcaaaaaggtgattcttggcaaagttggtggtgaggccctgggcaggcttcttggcaaatacccttggacccagaggtcgactcggaccgatg

SEQ ID NO: 15560 - DNA, 203 bp, Homo sapiens
  source 1..203: mol_type = other DNA
ggcgcgccagtccttgcgatctcactgacacattcttggcaaatagcaacttcttggcaaaaccatggttcttggcaaacctgaggagaagtctgccgttactgttcttggcaaaaaggtgattcttggcaaagttggtgttcttggcaaaggcaggctgctggtggtctacccttggacccagaggtcgactcggaccgatg

SEQ ID NO: 15561 - DNA, 203 bp, Homo sapiens
  source 1..203: mol_type = other DNA
ggcgcgccagtcctcgtagaccctctgacacattcttggcaaatagcaacttcttggcaaaaccatggttcttggcaaacctgaggttcttggcaaagttactgccctgtggggcaaggtgaacgtggatgaagttggtggtgaggccctgggcaggcttcttggcaaatacccttggacccagaggtcgactcggaccgatg

SEQ ID NO: 15562 - DNA, 203 bp, Homo sapiens
  source 1..203: mol_type = other DNA
ggcgcgccagtcctctgcctgaacctgacacattcttggcaaatagcaacttcttggcaaaaccatggttcttggcaaacctgaggttcttggcaaagttactgccctgtggggcaaggtgattcttggcaaagttggtgttcttggcaaaggcaggcttcttggcaaatacccttggacccagaggtcgactcggaccgatg

SEQ ID NO: 15563 - DNA, 203 bp, Homo sapiens
  source 1..203: mol_type = other DNA
ggcgcgccagtccttgcctgggcgctgacacattcttggcaaatagcaacttcttggcaaaaccatggttcttggcaaacctgaggttcttggcaaagttactgttcttggcaaaaaggtgaacgtggatgaagttggtggtgaggccctgggcaggctgctggtggtctacccttggacccagaggtcgactcggaccgatg

SEQ ID NO: 15564 - DNA, 203 bp, Homo sapiens
  source 1..203: mol_type = other DNA
ggcgcgccagtccttgcctgaatgctgacacattcttggcaaatagcaacttcttggcaaaaccatggttcttggcaaacctgaggttcttggcaaagttactgttcttggcaaaaaggtgaacgtggatgaagttggtgttcttggcaaaggcaggcttcttggcaaatacccttggacccagaggtcgactcggaccgatg

SEQ ID NO: 15565 - DNA, 203 bp, Homo sapiens
  source 1..203: mol_type = other DNA
ggcgcgccagtcctcatgcctgatctgacacattcttggcaaatagcaacttcttggcaaaaccatggttcttggcaaacctgaggttcttggcaaagttactgttcttggcaaaaaggtgattcttggcaaagttggtggtgaggccctgggcaggctgctggtggtctacccttggacccagaggtcgactcggaccgatg

SEQ ID NO: 15566 - DNA, 203 bp, Homo sapiens
  source 1..203: mol_type = other DNA
ggcgcgccagtcctgcctgcctgtctgacacattcttggcaaatagcaacttcttggcaaaaccatggttcttggcaaacctgaggttcttggcaaagttactgttcttggcaaaaaggtgattcttggcaaagttggtgttcttggcaaaggcaggcttcttggcaaatacccttggacccagaggtcgactcggaccgatg

SEQ ID NO: 15567 - DNA, 203 bp, Homo sapiens
  source 1..203: mol_type = other DNA
ggcgcgccagtcctcaggcagtggctgacaccggcgggttcactagcaacctcaaacagacaccatggtgcatctgactcctgaggagaagtctgccgttactgccctgtggggcaaggtgaacgtggatgaagttggtggtgaggccctgggcaggctgctggtggtctacccttggaaccggccgtcgactcggaccgatg

SEQ ID NO: 15568 - DNA, 203 bp, Homo sapiens
  source 1..203: mol_type = other DNA
ggcgcgccagtcctgactttaccgctgacatactcccgttcactagcaacctcaaacagacaccatggtgcatctgactcctgaggagaagtctgccgttactgccctgtggggcaaggtgaacgtggatgaagttggtggtgaggccctgggcaggctgctggtggtctacccttgttcttggcaaacgactcggaccgatg

SEQ ID NO: 15569 - DNA, 203 bp, Homo sapiens
  source 1..203: mol_type = other DNA
ggcgcgccagtcctcggtacatgactgacattcttggcaaaactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15570 - DNA, 203 bp, Homo sapiens
  source 1..203: mol_type = other DNA
ggcgcgccagtcctcggtgtgaatctgacattcttggcaaaactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15571 - DNA, 203 bp, Homo sapiens
  source 1..203: mol_type = other DNA
ggcgcgccagtcctcggtatctcactgcacggaatcgagaaactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15572 - DNA, 203 bp, Homo sapiens
  source 1..203: mol_type = other DNA
ggcgcgccagtcctcggctcaaatctgcctttagggcggagccggctcccaccggccgtagtctggggaccggccgtggacggtccaccggccgtcggccgtttaccggccgtgctggctgtaccggccgttcgcggccgaccggccgtcgctcctggaccggccgtagcgcgacaaccggccgtagccgactcggaccgatg

SEQ ID NO: 15573 - DNA, 203 bp, Homo sapiens
  source 1..203: mol_type = other DNA
ggcgcgccagtcctcatgcgatttctgcctttagggcggagccggctcccgctctcctcagtctgcggcacggaatcgagaagtcccacggaatcgagaagtttcacggaatcgagaactgtcacggaatcgagaagccgcacggaatcgagaactggcacggaatcgagaagacaccatgtcggagccgactcggaccgatg

SEQ ID NO: 15574 - DNA, 203 bp, Homo sapiens
  source 1..203: mol_type = other DNA
ggcgcgccagtcctcgcatggttactgcctttagggcggagccggctcccgctctcctcagtctgcggcgtcaattcctttagtcccgtcaattcctttagtttcgtcaattcctttactgtcgtcaattcctttagccgcgtcaattcctttactggcgtcaattcctttagacaccatgtcggagccgactcggaccgatg

SEQ ID NO: 15575 - DNA, 203 bp, Homo sapiens
  source 1..203: mol_type = other DNA
ggcgcgccagtcctcgcatgatccctgcctttagggcggagccggctcccgctctcctcagtctgcggtactcccgcggacggtcctactcccggcggccgttttactcccttgctggctgttactcccagtcgcggccgtactcccatcgctcctggtactccccgagcgcgacatactcccggagccgactcggaccgatg

SEQ ID NO: 15576 - DNA, 203 bp, Homo sapiens
  source 1..203: mol_type = other DNA
ggcgcgccagtccttcgcatgaatctgcctttagggcggagccggctcccgctctcctcagtctgcggtgggctagcggagggtccggcttccggcggccgtttaccggccgtgctggctgtaccggccgttcgcggccgaccggccgtcgctcctggaccggccgtagcgcgacaaccggccgtagccgactcggaccgatg

SEQ ID NO: 15577 - DNA, 203 bp, Homo sapiens
  source 1..203: mol_type = other DNA
ggcgcgccagtccttcacgcatgtctgcctttagggcggagccggctcccgctctcctcagtctgcggtgggctagcggagggtccggcttccggcggccgtttctgtctcttgctggctgtcgtcaattcctttagccgcgtcaattcctttactggcgtcaattcctttagacaccatgtcggagccgactcggaccgatg

SEQ ID NO: 15578 - DNA, 203 bp, Homo sapiens
  source 1..203: mol_type = other DNA
ggcgcgccagtcctcttgtcaattctgcctttagggcggagccggctcccgctctcctcagtctgcggtgggctagcggagggtccggcttccggcggccgtttctgtctcttgctggctgtctcgctgagtcgcggccgaccggccgtcgctcctggaccggccgtagcgcgacaaccggccgtagccgactcggaccgatg

SEQ ID NO: 15579 - DNA, 203 bp, Homo sapiens
  source 1..203: mol_type = other DNA
ggcgcgccagtcctaattgacaacctgcctttagggcggagccggctcccgctctcctcagtctgcggtgggctagcggagggtccggcttccggcggccgtttctgtctcttgctggctgtctcgctgagtcgcggccgcacggaatcgagaactggcacggaatcgagaagacaccatgtcggagccgactcggaccgatg

SEQ ID NO: 15580 - DNA, 203 bp, Homo sapiens
  source 1..203: mol_type = other DNA
ggcgcgccagtcctcattacgtttctgcctttagggcggagccggctcccgctctcctcagtctgcggtgggctagcggagggtccggcttccggcggccgtttctgtctcttgctggctgtctcgctgagtcgcggccgccttctcatcgctcctggaaggtcccgagcgcgacaaccggccgtagccgactcggaccgatg

SEQ ID NO: 15581 - DNA, 203 bp, Homo sapiens
  source 1..203: mol_type = other DNA
ggcgcgccagtcctcctttacgttctgcctttagggcggagccggctcccgctctcctcagtctgcggtgggctagcggagggtccggcttccggcggccgtttctgtctcttgctggctgtctcgctgagtcgcggccgccttctcatcgctcctggaaggtcccgagcgcgacatactcccggagccgactcggaccgatg

SEQ ID NO: 15582 - DNA, 203 bp, Homo sapiens
  source 1..203: mol_type = other DNA
ggcgcgccagtcctcacgtaagtactgcctttagggcggagccggctcccgctctcctcagtctgcggtgggctagcggagggtccggcttccggcggccgtttctgtctcttgctggctgtctcgctgagtcgcggccgccttctcatcgctcctggaccggccgtagcgcgacaaccggccgtagccgactcggaccgatg

SEQ ID NO: 15583 - DNA, 203 bp, Homo sapiens
  source 1..203: mol_type = other DNA
ggcgcgccagtcctacgcacgtagctgcctttagggcggagccggctcccgctctcctcagtctgcggtgggctagcggagggtccggcttccggcggccgtttctgtctcttgctggctgtctcgctgagtcgcggccgccttctcatcgctcctggcgtcaattcctttagacaccatgtcggagccgactcggaccgatg

SEQ ID NO: 15584 - DNA, 203 bp, Homo sapiens
  source 1..203: mol_type = other DNA
ggcgcgccagtcctcctcgcacgactgcctttagggcggagccggctcccgctctcctcagtctgcggtgggctagcggagggtccggcttccggcggccgtttctgtctcttgctggctgtctcgctgagtcgcggccgccttctcatcgctcctggtactccccgagcgcgacatactcccggagccgactcggaccgatg

SEQ ID NO: 15585 - DNA, 203 bp, Homo sapiens
  source 1..203: mol_type = other DNA
ggcgcgccagtcctccgcacgatcctgcctttagggcggagccggctcccgctctcctcagtctgcggtgggctagcggagggtccggcttccggcggccgtttctgtctcttgctggctgtctcgctgagtcgcggccgcgtcaattcctttactggcgtcaattcctttagacaccatgtcggagccgactcggaccgatg

SEQ ID NO: 15586 - DNA, 203 bp, Homo sapiens
  source 1..203: mol_type = other DNA
ggcgcgccagtcctcgcacgacggctgcctttagggcggagccggctcccgctctcctcagtctgcggtgggctagcggagggtccggcttccggcggccgtttctgtctcttgctggctgtctcgctgagtcgcggccgttcttggcaaactcctggttcttggcaaacgcgacattcttggcaaaccgactcggaccgatg

SEQ ID NO: 15587 - DNA, 203 bp, Homo sapiens
  source 1..203: mol_type = other DNA
ggcgcgccagtcctcgtgcgttggctgcctttagggcggagccggctcccgctctcctcagtctgcggtgggctagcggagggtccggcttccggcggccgtttctgtctcttgctggctgtttcttggcaaagcggccgttcttggcaaactcctggttcttggcaaacgcgacattcttggcaaaccgactcggaccgatg

SEQ ID NO: 15588 - DNA, 203 bp, Homo sapiens
  source 1..203: mol_type = other DNA
ggcgcgccagtccttaccgtgcgtctgcctttagggcggagccggctcccgctctcctcagtctgcggtgggctagcggagggtccggcttccggcggccgtttttcttggcaaatggctgtttcttggcaaagcggccgttcttggcaaactcctggttcttggcaaacgcgacattcttggcaaaccgactcggaccgatg

SEQ ID NO: 15589 - DNA, 203 bp, Homo sapiens
  source 1..203: mol_type = other DNA
ggcgcgccagtcctgagacgtgcgctgcctttagggcggagccggctcccgctctcctcagtctgcggttcttggcaaaacggtccttcttggcaaagccgtttttcttggcaaatggctgtttcttggcaaagcggccgttcttggcaaactcctggttcttggcaaacgcgacattcttggcaaaccgactcggaccgatg

SEQ ID NO: 15590 - DNA, 203 bp, Homo sapiens
  source 1..203: mol_type = other DNA
ggcgcgccagtcctcgtgcgtaacctgcctttagggcggagccggctccctactccctcagtctgcggtactcccgcggacggtcctactcccggcggccgttttactcccttgctggctgttactcccagtcgcggccgtactcccatcgctcctggtactccccgagcgcgacatactcccggagccgactcggaccgatg

SEQ ID NO: 15591 - DNA, 203 bp, Homo sapiens
  source 1..203: mol_type = other DNA
ggcgcgccagtcctgattgtgaccctgccttttactcccagccggctccctactccctcagtctgcggtactcccgcggacggtcctactcccggcggccgttttactcccttgctggctgttactcccagtcgcggccgtactcccatcgctcctggtactccccgagcgcgacatactcccggagccgactcggaccgatg

SEQ ID NO: 15592 - DNA, 203 bp, Homo sapiens
  source 1..203: mol_type = other DNA
ggcgcgccagtcctttcacaatgcctgcctttttcttggcaaaggctcccttcttggcaaatctgcggttcttggcaaaacggtccttcttggcaaagccgtttttcttggcaaatggctgtttcttggcaaagcggccgttcttggcaaactcctggttcttggcaaacgcgacattcttggcaaaccgactcggaccgatg

SEQ ID NO: 15593 - DNA, 203 bp, Homo sapiens
  source 1..203: mol_type = other DNA
ggcgcgccagtcctgcgctgatcgctgcgtcaattcctttaactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggtcgactcggaccgatg

SEQ ID NO: 15594 - DNA, 203 bp, Homo sapiens
  source 1..203: mol_type = other DNA
ggcgcgccagtcctttcagcgctactgcgtcaattcctttaactagcaacctcaaacagacaccatggtgcatctgactcctgaggagaagtctgccgttactgccctgtggggcaaggtgaacgtggatgaagttggtggtgaggccctgggcaggctgctggtggtctacccttggacctactccccgactcggaccgatg

SEQ ID NO: 15595 - DNA, 203 bp, Homo sapiens
  source 1..203: mol_type = other DNA
ggcgcgccagtcctggcgctgagtctgtactccctgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccacggaatcgagaacgactcggaccgatg

SEQ ID NO: 15596 - DNA, 203 bp, Homo sapiens
  source 1..203: mol_type = other DNA
ggcgcgccagtcctcgcgctgtccctgtactccctgtgttcactagcaacctcaaacagacaccatggtgcatctgactcctgaggagaagtctgccgttactgccctgtggggcaaggtgaacgtggatgaagttggtggtgaggccctgggcaggctgctggtggtctaccccgtcaattcctttacgactcggaccgatg

SEQ ID NO: 15597 - DNA, 203 bp, Homo sapiens
  source 1..203: mol_type = other DNA
ggcgcgccagtcctcgtcgaatccgaacaaaaccggcgggtaaaacaagaccggcgggtggaagaaaaccggcgggttacacaaaaccggcgggtgaaaaaaggccggcgggtaaaacggagccggcgggtaaaatttaaccggcgggtgaatttaaaccggcgggtaacaccaagccggcgggtaaacgactcggaccgatg

SEQ ID NO: 15598 - DNA, 203 bp, Homo sapiens
  source 1..203: mol_type = other DNA
ggcgcgccagtccttcaaattcgagaacaaaagcaaaaacaaaaacaagaacaaaaaagggaagaaaaacaaaagtatacacaaaaaccaaaaaagaaaaaaggccagagacaaaaacggagccggcgggtaaaatttaaccggcgggtgaatttaaaccggcgggtaacaccaagccggcgggtaaacgactcggaccgatg

SEQ ID NO: 15599 - DNA, 203 bp, Homo sapiens
  source 1..203: mol_type = other DNA
ggcgcgccagtcctgtgctaccgagaacaaaagcaaaaacaaaaacaagaacaaaaaagggaagaaaaacaaaagtatacacaaaaaccaaaaaagaaaaaaggtactccccaaaaacggagtactccccaaaaatttaatactccccagaatttaaatactccctaaacaccaagtactccccaaaacgactcggaccgatg

SEQ ID NO: 15600 - DNA, 203 bp, Homo sapiens
  source 1..203: mol_type = other DNA
ggcgcgccagtcctgctggaccgagaacaaaagcaaaaacaaaaacaagaacaaaaaagggaagaaaaacaaaagtatacacaaaacacggaatcgagaaaaggcacggaatcgagaaggagcacggaatcgagaattaacacggaatcgagaataaacacggaatcgagaacaagatagagacaaaacgactcggaccgatg

SEQ ID NO: 15601 - DNA, 203 bp, Homo sapiens
  source 1..203: mol_type = other DNA
ggcgcgccagtcctgggcactcgggaacaaaagcaaaaacaaaaacaagaacaaaaaagggaagaaaatactccctatacacaaaatactcccaagaaaaaaggtactccccaaaaacggagtactccccaaaaatttaatactccccagaatttaaatactccctaaacaccaagtactccccaaaacgactcggaccgatg

SEQ ID NO: 15602 - DNA, 203 bp, Homo sapiens
  source 1..203: mol_type = other DNA
ggcgcgccagtcctccctgtgcccgaacaaaagcaaaaacaaaaacaagaacaaaaaagggaagaaaattcttggcaaacacaaaattcttggcaaaaaaaaggttcttggcaaaaacggagttcttggcaaaaatttaattcttggcaaaatttaaattcttggcaaacaccaagttcttggcaaaacgactcggaccgatg

SEQ ID NO: 15603 - DNA, 203 bp, Homo sapiens
  source 1..203: mol_type = other DNA
ggcgcgccagtcctagtgccctgcgaacaaaagcaaaaacaaaaacaagacacggaatcgagaaaaaacacggaatcgagaaaaaacacggaatcgagaaaaggcacggaatcgagaaggagcacggaatcgagaattaacacggaatcgagaataaacacggaatcgagaacaagatagagacaaaacgactcggaccgatg

SEQ ID NO: 15604 - DNA, 203 bp, Homo sapiens
  source 1..203: mol_type = other DNA
ggcgcgccagtcctactaagtcccgaacaaaagcaaaaacaaaaacaagattcttggcaaaaagaaaattcttggcaaacacaaaattcttggcaaaaaaaaggttcttggcaaaaacggagttcttggcaaaaatttaattcttggcaaaatttaaattcttggcaaacaccaagttcttggcaaaacgactcggaccgatg

SEQ ID NO: 15605 - DNA, 203 bp, Homo sapiens
  source 1..203: mol_type = other DNA
ggcgcgccagtccttggacttaaagaacaaaattcttggcaaaaacaagattcttggcaaaaagaaaattcttggcaaacacaaaattcttggcaaaaaaaaggttcttggcaaaaacggagttcttggcaaaaatttaattcttggcaaaatttaaattcttggcaaacaccaagttcttggcaaaacgactcggaccgatg

SEQ ID NO: 15606 - DNA, 203 bp, Homo sapiens
  source 1..203: mol_type = other DNA
ggcgcgccagtcctagggacttacgagatacacacggaatcgagaaactccacggaatcgagaaaactcacggaatcgagaacggacacggaatcgagaaaattcacggaatcgagaataggcacggaatcgagaaaatccacggaatcgagaagatccacggaatcgagaaccagaatcatacaatccgactcggaccgatg

SEQ ID NO: 15607 - DNA, 203 bp, Homo sapiens
  source 1..203: mol_type = other DNA
ggcgcgccagtccttaatcccagtgagatacaccggcgggtcacacactcccggcgggtaatcaaactccggcgggttcattgggaccggcgggtctcataattccggcgggtaatcataggccggcgggtttagaaatcccggcgggtttcgtgatcccggcgggtccacaccagccggcgggtatccgactcggaccgatg

SEQ ID NO: 15608 - DNA, 203 bp, Homo sapiens
  source 1..203: mol_type = other DNA
ggcgcgccagtcctgttaatcccagagatacacgtcaattcctttaactccgtcaattcctttaaactcgtcaattcctttacggacgtcaattcctttaaattcgtcaattcctttataggcgtcaattcctttaaatccgtcaattcctttagatccgtcaattcctttaccagaatcatacaatccgactcggaccgatg

SEQ ID NO: 15609 - DNA, 203 bp, Homo sapiens
  source 1..203: mol_type = other DNA
ggcgcgccagtcctagggattagggagatacagctgccactcacacactcaccggccgtaatcaaactaccggccgttcattcggaaccggccgtctcataattaccggccgtaatcataggaccggccgtttagaaatcaccggccgtttcgtgatcaccggccgtccacaccagaccggccgtatccgactcggaccgatg

SEQ ID NO: 15610 - DNA, 203 bp, Homo sapiens
  source 1..203: mol_type = other DNA
ggcgcgccagtccttaccagggacgagatacagctgccactcacacactcatccagacaaatcaaactagactcacatcattcggaaacaattctctcataatttaaagaaaaaatcataggccggacgggttagaaatcccggcgggtttcgtgatcccggcgggtccacaccagccggcgggtatccgactcggaccgatg

SEQ ID NO: 15611 - DNA, 203 bp, Homo sapiens
  source 1..203: mol_type = other DNA
ggcgcgccagtccttccagggtcggagatacagctgccactcacacactcatccagacaaatcaaactagactcacatcattcggaaacaattctctcataatttaaagaaaaaatcataggccggacgggttagaaatccggtgcttgttcgtgatcaccggccgtccacaccagaccggccgtatccgactcggaccgatg

SEQ ID NO: 15612 - DNA, 203 bp, Homo sapiens
  source 1..203: mol_type = other DNA
ggcgcgccagtccttccctggtaagagatacagctgccactcacacactcatccagacaaatcaaactagactcacatcattcggaaacaattctctcataatttaaagaaaaaatcataggccggacgggttagaaatccggtgcttgttcgtgatccacggaatcgagaaccagaatcatacaatccgactcggaccgatg

SEQ ID NO: 15613 - DNA, 203 bp, Homo sapiens
  source 1..203: mol_type = other DNA
ggcgcgccagtccttctaggctgggagatacagctgccactcacacactcatccagacaaatcaaactagactcacatcattcggaaacaattctctcataatttaaagaaaaaatcataggccggacgggttagaaatccgtcaattcctttagatccgtcaattcctttaccagaatcatacaatccgactcggaccgatg

SEQ ID NO: 15614 - DNA, 203 bp, Homo sapiens
  source 1..203: mol_type = other DNA
ggcgcgccagtcctggtgacgttagagatacagctgccactcacacactcatccagacaaatcaaactagactcacatcattcggaaacaattctctcataatttaaagaaaaaatcataggccggacgggttagaaatcttcttggcaaacgtgatcttcttggcaaaacaccagttcttggcaaaccgactcggaccgatg

SEQ ID NO: 15615 - DNA, 203 bp, Homo sapiens
  source 1..203: mol_type = other DNA
ggcgcgccagtcctggctgggtaagagatacagctgccactcacacactcatccagacaaatcaaactagactcacatcattcggaaacaattctctcataatttaaagaaaaaatcataggccggcgggtttagaaatcccggcgggtttcgtgatcccggcgggtccacaccagccggcgggtatccgactcggaccgatg

SEQ ID NO: 15616 - DNA, 203 bp, Homo sapiens
  source 1..203: mol_type = other DNA
ggcgcgccagtcctttacccagctgagatacagctgccactcacacactcatccagacaaatcaaactagactcacatcattcggaaacaattctctcataatttaaagaaaaaatcataggcgtcaattcctttaaatccgtcaattcctttagatccgtcaattcctttaccagaatcatacaatccgactcggaccgatg

SEQ ID NO: 15617 - DNA, 203 bp, Homo sapiens
  source 1..203: mol_type = other DNA
ggcgcgccagtccttgcctgcagcgagatacagctgccactcacacactcatccagacaaatcaaactagactcacatcattcggaaacaattctctcataatttactcccaaaatcataggtactcccggttagaaatctactccctgttcgtgatctactcccctccacaccagtactccccaatccgactcggaccgatg

SEQ ID NO: 15618 - DNA, 203 bp, Homo sapiens
  source 1..203: mol_type = other DNA
ggcgcgccagtccttcacacgaccgagatacagctgccactcacacactcatccagacaaatcaaactagactcacatcattcggacacggaatcgagaaaattcacggaatcgagaataggcacggaatcgagaaaatccacggaatcgagaagatccacggaatcgagaaccagaatcatacaatccgactcggaccgatg

SEQ ID NO: 15619 - DNA, 203 bp, Homo sapiens
  source 1..203: mol_type = other DNA
ggcgcgccagtcctactcacacgtgagatacagctgccactcacacactcatccagacaaatcaaactagactcacatcattcggacgtcaattcctttaaattcgtcaattcctttataggcgtcaattcctttaaatccgtcaattcctttagatccgtcaattcctttaccagaatcatacaatccgactcggaccgatg

SEQ ID NO: 15620 - DNA, 203 bp, Homo sapiens
  source 1..203: mol_type = other DNA
ggcgcgccagtcctgcgcacacgcgagatacagctgccactcacacactcatccagacaaatcaaactccggcgggttcattgggaccggcgggtctcataattccggcgggtaatcataggccggcgggtttagaaatcccggcgggtttcgtgatcccggcgggtccacaccagccggcgggtatccgactcggaccgatg

SEQ ID NO: 15621 - DNA, 203 bp, Homo sapiens
  source 1..203: mol_type = other DNA
ggcgcgccagtcctatacacacgcgagatacagctgccactcacacactcatccagacaaatcaaactcgtcaattcctttacggacgtcaattcctttaaattcgtcaattcctttataggcgtcaattcctttaaatccgtcaattcctttagatccgtcaattcctttaccagaatcatacaatccgactcggaccgatg

SEQ ID NO: 15622 - DNA, 203 bp, Homo sapiens
  source 1..203: mol_type = other DNA
ggcgcgccagtcctcgtgtgtgctgagatacagctgccactcacacactcatccagacaaatcaaacttactccccatcattcggatactcccctctcataatttactcccaaaatcataggtactcccggttagaaatctactccctgttcgtgatctactcccctccacaccagtactccccaatccgactcggaccgatg

SEQ ID NO: 15623 - DNA, 203 bp, Homo sapiens
  source 1..203: mol_type = other DNA
ggcgcgccagtcctcgtgtgacgagagatacattcttggcaaacacactcttcttggcaaatcaaactttcttggcaaaattcggattcttggcaaacataattttcttggcaaatcataggttcttggcaaaagaaatcttcttggcaaacgtgatcttcttggcaaaacaccagttcttggcaaaccgactcggaccgatg

SEQ ID NO: 15624 - DNA, 203 bp, Homo sapiens
  source 1..203: mol_type = other DNA
ggcgcgccagtcctagcgtgtgcagatgccggcacggaatcgagaacgtccacggaatcgagaaccctcacggaatcgagaaattacacggaatcgagaacggacacggaatcgagaaccgacacggaatcgagaactggcacggaatcgagaattcgcacggaatcgagaacaagtaagacccaatccgactcggaccgatg

SEQ ID NO: 15625 - DNA, 203 bp, Homo sapiens
  source 1..203: mol_type = other DNA
ggcgcgccagtcctatcgtgtggtgatgccggccggcgggtaccgccgtcccggcgggtcggttccctccggcgggttcccgattaccggcgggtccgcagggaccggcgggtaccacccgaccggcgggtgactcctggccggcgggtctcatttcgccggcgggtttactcaagccggcgggtatccgactcggaccgatg

SEQ ID NO: 15626 - DNA, 203 bp, Homo sapiens
  source 1..203: mol_type = other DNA
ggcgcgccagtcctgacatattgcgatgccggcctccgtggaccgccgtcccctgtaaccggttccctcacggaatcgagaaattacacggaatcgagaacggacacggaatcgagaaccgacacggaatcgagaactggcacggaatcgagaattcgcacggaatcgagaacaagtaagacccaatccgactcggaccgatg

SEQ ID NO: 15627 - DNA, 203 bp, Homo sapiens
  source 1..203: mol_type = other DNA
ggcgcgccagtcctagaagccgctgatgccggcctccgtggaccgccgtcccctgtaaccggttccctgcacggccgtcccgattaaccgattccccgcacggaaccggccgtaccacccgaaccggccgtgactcctggaccggccgtctcatttcgaccggccgtttactcaagaccggccgtatccgactcggaccgatg

SEQ ID NO: 15628 - DNA, 203 bp, Homo sapiens
  source 1..203: mol_type = other DNA
ggcgcgccagtcctctcaagccgcgatgccggcctccgtggaccgccgtcccctgtaaccggttccctgcacggccgtcccgattaaccgattccccgcacggacgtcaattcctttaccgacgtcaattcctttactggcgtcaattcctttattcgcgtcaattcctttacaagtaagacccaatccgactcggaccgatg

SEQ ID NO: 15629 - DNA, 203 bp, Homo sapiens
  source 1..203: mol_type = other DNA
ggcgcgccagtcctgccgcaatgcgatgccggcctccgtggaccgccgtcccctgtaaccggttccctgcacggccgtcccgattaaccgattccccgcacggagcaccgcggaccacccgaaccggccgtgactcctggaccggccgtctcatttcgaccggccgtttactcaagaccggccgtatccgactcggaccgatg

SEQ ID NO: 15630 - DNA, 203 bp, Homo sapiens
  source 1..203: mol_type = other DNA
ggcgcgccagtcctccctgccgctgatgccggcctccgtggaccgccgtcccctgtaaccggttccctgcacggccgtcccgattaaccgattccccgcacggagcaccgcggaccacccgaccgcgagccgactcctggaccggccgtctcatttcgaccggccgtttactcaagaccggccgtatccgactcggaccgatg

SEQ ID NO: 15631 - DNA, 203 bp, Homo sapiens
  source 1..203: mol_type = other DNA
ggcgcgccagtcctcgtgccgccagatgccggcctccgtggaccgccgtcccctgtaaccggttccctgcacggccgtcccgattaaccgattccccgcacggagcaccgcggaccacccgaccgcgagccgactcctggagttcgttcctcatttcgacggcggcattactcaagtaagacccaatccgactcggaccgatg

SEQ ID NO: 15632 - DNA, 203 bp, Homo sapiens
  source 1..203: mol_type = other DNA
ggcgcgccagtcctatgccgctaagatgccggcctccgtggaccgccgtcccctgtaaccggttccctgcacggccgtcccgattaaccgattccccgcacggagcaccgcggaccacccgaccgcgagccgactcctggagttcgttcctcatttcgacggcggcattactcaagttcttggcaaaccgactcggaccgatg

SEQ ID NO: 15633 - DNA, 203 bp, Homo sapiens
  source 1..203: mol_type = other DNA
ggcgcgccagtcctcgccgcatatgatgccggcctccgtggaccgccgtcccctgtaaccggttccctgcacggccgtcccgattaaccgattccccgcacggagcaccgcggaccacccgaccgcgagccgactcctggagttcgttcctcatttcgcacggaatcgagaacaagtaagacccaatccgactcggaccgatg

SEQ ID NO: 15634 - DNA, 203 bp, Homo sapiens
  source 1..203: mol_type = other DNA
ggcgcgccagtcctctaagccgccgatgccggcctccgtggaccgccgtcccctgtaaccggttccctgcacggccgtcccgattaaccgattccccgcacggagcaccgcggaccacccgaccgcgagccgactcctggcacggaatcgagaattcgcacggaatcgagaacaagtaagacccaatccgactcggaccgatg

SEQ ID NO: 15635 - DNA, 203 bp, Homo sapiens
  source 1..203: mol_type = other DNA
ggcgcgccagtcctgccgcggtcagatgccggcctccgtggaccgccgtcccctgtaaccggttccctgcacggccgtcccgattaaccgattccccgcacggagcaccgcggaccacccgaccgcgagccgactcctggcgtcaattcctttattcgcgtcaattcctttacaagtaagacccaatccgactcggaccgatg

SEQ ID NO: 15636 - DNA, 203 bp, Homo sapiens
  source 1..203: mol_type = other DNA
ggcgcgccagtcctagctgccgccgatgccggcctccgtggaccgccgtcccctgtaaccggttccctgcacggccgtcccgattaaccgattccccgcacggagcaccgcggaccacccgaccgcgagccgactcctggttcttggcaaacatttcgttcttggcaaaactcaagttcttggcaaaccgactcggaccgatg

SEQ ID NO: 15637 - DNA, 203 bp, Homo sapiens
  source 1..203: mol_type = other DNA
ggcgcgccagtcctgccgcatgaggatgccggcctccgtggaccgccgtcccctgtaaccggttccctgcacggccgtcccgattaaccgattccccgcacggagcaccgcggaccacccgaccggcgggtgactcctggccggcgggtctcatttcgccggcgggtttactcaagccggcgggtatccgactcggaccgatg

SEQ ID NO: 15638 - DNA, 203 bp, Homo sapiens
  source 1..203: mol_type = other DNA
ggcgcgccagtcctgccgcaaacggatgccggcctccgtggaccgccgtcccctgtaaccggttccctgcacggccgtcccgattaaccgattccccgcacggagcaccgcggaccacccgacgtcaattcctttactggcgtcaattcctttattcgcgtcaattcctttacaagtaagacccaatccgactcggaccgatg

SEQ ID NO: 15639 - DNA, 203 bp, Homo sapiens
  source 1..203: mol_type = other DNA
ggcgcgccagtccttttgccgctagatgccggcctccgtggaccgccgtcccctgtaaccggttccctgcacggccgtcccgattaaccgattccccgcacggagcaccgcggaccacccgatactcccccgactcctggtactccctcctcatttcgtactccccattactcaagtactccccaatccgactcggaccgatg

SEQ ID NO: 15640 - DNA, 203 bp, Homo sapiens
  source 1..203: mol_type = other DNA
ggcgcgccagtcctgtgcggcaacgatgccggcctccgtggaccgccgtcccctgtaaccggttccctgcacggccgtcccgattaaccgattccccgcacggatactcccggaccacccgatactcccccgactcctggtactccctcctcatttcgtactccccattactcaagtactccccaatccgactcggaccgatg

SEQ ID NO: 15641 - DNA, 203 bp, Homo sapiens
  source 1..203: mol_type = other DNA
ggcgcgccagtccttggcggctcagatgccggcctccgtggaccgccgtcccctgtaaccggttccctgcacggccgtcccgattaccggcgggtccgcagggaccggcgggtaccacccgaccggcgggtgactcctggccggcgggtctcatttcgccggcgggtttactcaagccggcgggtatccgactcggaccgatg

SEQ ID NO: 15642 - DNA, 203 bp, Homo sapiens
  source 1..203: mol_type = other DNA
ggcgcgccagtccttgcggcgaacgatgccggcctccgtggaccgccgtcccctgtaaccggttccctgcacggccgtcccgattacgtcaattcctttacggacgtcaattcctttaccgacgtcaattcctttactggcgtcaattcctttattcgcgtcaattcctttacaagtaagacccaatccgactcggaccgatg

SEQ ID NO: 15643 - DNA, 203 bp, Homo sapiens
  source 1..203: mol_type = other DNA
ggcgcgccagtcctcgctgcggcagatgccggcctccgtggaccgccgtcccctgtaaccggttccctgcacggccgtcccgattattcttggcaaagcacggattcttggcaaacacccgattcttggcaaactcctggttcttggcaaacatttcgttcttggcaaaactcaagttcttggcaaaccgactcggaccgatg

SEQ ID NO: 15644 - DNA, 203 bp, Homo sapiens
  source 1..203: mol_type = other DNA
ggcgcgccagtcctagagcggcacgatgccggcctccgtggaccgccgtctactcccaccggttcccttactccccgtcccgattatactcccccccgcacggatactcccggaccacccgatactcccccgactcctggtactccctcctcatttcgtactccccattactcaagtactccccaatccgactcggaccgatg

SEQ ID NO: 15645 - DNA, 203 bp, Homo sapiens
  source 1..203: mol_type = other DNA
ggcgcgccagtcctgctaagcggcgatgcgggaccggccgtaccgccgtcaccggccgtcggttccctaccggccgttcccgattaaccggccgtccgcacggaaccggccgtaccacccgaaccggccgtgactcctggaccggccgtctcatttcgaccggccgtttactcaagaccggccgtatccgactcggaccgatg

SEQ ID NO: 15646 - DNA, 203 bp, Homo sapiens
  source 1..203: mol_type = other DNA
ggcgcgccagtccttgcggcactcgcagtcctcacggaatcgagaagcagcacggaatcgagaattcccacggaatcgagaatccgcacggaatcgagaagctgcacggaatcgagaaagtgcacggaatcgagaaccttcacggaatcgagaacgtgcacggaatcgagaacgacggcgaggtccgacgactcggaccgatg

SEQ ID NO: 15647 - DNA, 203 bp, Homo sapiens
  source 1..203: mol_type = other DNA
ggcgcgccagtcctaaaggcggcagcagtcctgggctgtacccggcgcagaccggccgtgctgcttccaccggccgtgtatctccgaccggccgtgggctgctgaccggccgtgaggaagtgaccggccgtgccgaccttaccggccgtctgggcgtgaccggccgtgcctccgacaccggccgtcgacgactcggaccgatg

SEQ ID NO: 15648 - DNA, 203 bp, Homo sapiens
  source 1..203: mol_type = other DNA
ggcgcgccagtcctcgaggcggctgcagtcctgggctgtacccggcgcagcacggaatcgagaattcccacggaatcgagaatccgcacggaatcgagaagctgcacggaatcgagaaagtgcacggaatcgagaaccttcacggaatcgagaacgtgcacggaatcgagaacgacggcgaggtccgacgactcggaccgatg

SEQ ID NO: 15649 - DNA, 203 bp, Homo sapiens
  source 1..203: mol_type = other DNA
ggcgcgccagtcctggatctagtagcagtcctgggctgtacccggcgcagctgggagcggctgcttcccgtcaattcctttatccgcgtcaattcctttagctgcgtcaattcctttaagtgcgtcaattcctttaccttcgtcaattcctttacgtgcgtcaattcctttacgacggcgaggtccgacgactcggaccgatg

SEQ ID NO: 15650 - DNA, 203 bp, Homo sapiens
  source 1..203: mol_type = other DNA
ggcgcgccagtcctactagatcctgcagtcctgggctgtacccggcgcagctgggagcggctgcttcctactccctcgtatctccgtactccctggggctgctgtactcccgcgaggaagtgtactcccccgccgacctttactccctgctgggcgtgtactcccaggcctccgactactccctccgacgactcggaccgatg

SEQ ID NO: 15651 - DNA, 203 bp, Homo sapiens
  source 1..203: mol_type = other DNA
ggcgcgccagtcctgacccgctgagcagtcctgggctgtacccggcgcagctgggagcggctgcttcctccggggtcgtatctccgcccggcatggggctgctgcacggaatcgagaaagtgcacggaatcgagaaccttcacggaatcgagaacgtgcacggaatcgagaacgacggcgaggtccgacgactcggaccgatg

SEQ ID NO: 15652 - DNA, 203 bp, Homo sapiens
  source 1..203: mol_type = other DNA
ggcgcgccagtccttgcgtcgattgcagtcctgggctgtacccggcgcagctgggagcggctgcttcctccggggtcgtatctccgcccggcatggggctgctggacctttgcgaggaagtgtactcccccgccgacctttactccctgctgggcgtgtactcccaggcctccgactactccctccgacgactcggaccgatg

SEQ ID NO: 15653 - DNA, 203 bp, Homo sapiens
  source 1..203: mol_type = other DNA
ggcgcgccagtcctctacgtcaccgcagtcctgggctgtacccggcgcagctgggagcggctgcttcctccggggtcgtatctccgcccggcatggggctgctggacctttgcgaggaagtgttcggcaccgccgaccttaccggccgtctgggcgtgaccggccgtgcctccgacaccggccgtcgacgactcggaccgatg

SEQ ID NO: 15654 - DNA, 203 bp, Homo sapiens
  source 1..203: mol_type = other DNA
ggcgcgccagtccttgacgtagtggcagtcctgggctgtacccggcgcagctgggagcggctgcttcctccggggtcgtatctccgcccggcatggggctgctggacctttgcgaggaagtgttcggcaccgccgaccttcacggaatcgagaacgtgcacggaatcgagaacgacggcgaggtccgacgactcggaccgatg

SEQ ID NO: 15655 - DNA, 203 bp, Homo sapiens
  source 1..203: mol_type = other DNA
ggcgcgccagtcctccaagcgcctgcagtcctgggctgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacttcttggcaaaacgactcggaccgatg

SEQ ID NO: 15656 - DNA, 203 bp, Homo sapiens
  source 1..203: mol_type = other DNA
ggcgcgccagtccttctcaggcgcgcagtcctgggctgtacccggcgcagctgggagcggctgcttcctccggggtcgtatctccgcccggcatggggctgctggacctttgcgaggaagtgttcggcaccgccgacctttaccgggtgctgggcgtgtactcccaggcctccgactactccctccgacgactcggaccgatg

SEQ ID NO: 15657 - DNA, 203 bp, Homo sapiens
  source 1..203: mol_type = other DNA
ggcgcgccagtcctacaggcgctggcagtcctgggctgtacccggcgcagctgggagcggctgcttcctccggggtcgtatctccgcccggcatggggctgctggacctttgcgaggaagtgttcggcaccgccgaccttttcttggcaaagggcgtgttcttggcaaactccgacttcttggcaaaacgactcggaccgatg

SEQ ID NO: 15658 - DNA, 203 bp, Homo sapiens
  source 1..203: mol_type = other DNA
ggcgcgccagtcctttagcgctaggcagtcctgggctgtacccggcgcagctgggagcggctgcttcctccggggtcgtatctccgcccggcatggggctgctggacctttgcgaggaagtgttcttggcaaacgaccttttcttggcaaagggcgtgttcttggcaaactccgacttcttggcaaaacgactcggaccgatg

SEQ ID NO: 15659 - DNA, 203 bp, Homo sapiens
  source 1..203: mol_type = other DNA
ggcgcgccagtcctagtcctatcggcagtcctgggctgtacccggcgcagctgggagcggctgcttcctccggggtcgtatctccgtactccctggggctgctgtactcccgcgaggaagtgtactcccccgccgacctttactccctgctgggcgtgtactcccaggcctccgactactccctccgacgactcggaccgatg

SEQ ID NO: 15660 - DNA, 203 bp, Homo sapiens
  source 1..203: mol_type = other DNA
ggcgcgccagtcctacctatcttagcagtcctgggctgtacccggcgcagctgggagcggctgcttcctccggggtcgtatctccgttcttggcaaagctgctgttcttggcaaaggaagtgttcttggcaaacgaccttttcttggcaaagggcgtgttcttggcaaactccgacttcttggcaaaacgactcggaccgatg

SEQ ID NO: 15661 - DNA, 203 bp, Homo sapiens
  source 1..203: mol_type = other DNA
ggcgcgccagtcctctatggtcaggcagtccttactcccacccggcgcagtactccccggctgcttcctactccctcgtatctccgtactccctggggctgctgtactcccgcgaggaagtgtactcccccgccgacctttactccctgctgggcgtgtactcccaggcctccgactactccctccgacgactcggaccgatg

SEQ ID NO: 15662 - DNA, 203 bp, Homo sapiens
  source 1..203: mol_type = other DNA
ggcgcgccagtcctaggctatgtagcagtcctttcttggcaaaggcgcagttcttggcaaatgcttccttcttggcaaaatctccgttcttggcaaagctgctgttcttggcaaaggaagtgttcttggcaaacgaccttttcttggcaaagggcgtgttcttggcaaactccgacttcttggcaaaacgactcggaccgatg

SEQ ID NO: 15663 - DNA, 203 bp, Homo sapiens
  source 1..203: mol_type = other DNA
ggcgcgccagtcctaacctctatcgcccgttaaccggccgtgcaaacgacaccggccgtcggtccacgaccggccgtaatgtctctaccggccgttaggcgtagaccggccgttgacaaggaaccggccgtgccgggggcaccggccgtgactccaagaccggccgttcccggtggaccggccgttgccgactcggaccgatg

SEQ ID NO: 15664 - DNA, 203 bp, Homo sapiens
  source 1..203: mol_type = other DNA
ggcgcgccagtcctctatccaaatgcccgttacccacctgggcaaacgacgcccacgtacggtccacgtactccctcaatgtctcttactcccaataggcgtagtactcccgttgacaaggatactcccgggccgggggctactcccgggactccaagtactccccttcccggtggtactcccaatgccgactcggaccgatg

SEQ ID NO: 15665 - DNA, 203 bp, Homo sapiens
  source 1..203: mol_type = other DNA
ggcgcgccagtcctactatctggtgcccgttacccacctgggcaaacgacgcccacgtacggtccacgtcgcccttcaatgtctctaccggccgttaggcgtagaccggccgttgacaaggaaccggccgtgccgggggcaccggccgtgactccaagaccggccgttcccggtggaccggccgttgccgactcggaccgatg

SEQ ID NO: 15666 - DNA, 203 bp, Homo sapiens
  source 1..203: mol_type = other DNA
ggcgcgccagtccttgctatgtaagcccgttacccacctgggcaaacgacgcccacgtacggtccacgtcgcccttcaatgtctctcgtcaattcctttagtagcgtcaattcctttaaggacgtcaattcctttagggccgtcaattcctttacaagcgtcaattcctttagtgggccgggaaatgccgactcggaccgatg

SEQ ID NO: 15667 - DNA, 203 bp, Homo sapiens
  source 1..203: mol_type = other DNA
ggcgcgccagtcctgtcattctatgcccgttacccacctgggcaaacgacgcccacgtacggtccacgtcgcccttcaatgtctctcttgaccaataggcgtagaccggccgttgacaaggaaccggccgtgccgggggcaccggccgtgactccaagaccggccgttcccggtggaccggccgttgccgactcggaccgatg

SEQ ID NO: 15668 - DNA, 203 bp, Homo sapiens
  source 1..203: mol_type = other DNA
ggcgcgccagtcctactatgtatcgcccgttacccacctgggcaaacgacgcccacgtacggtccacgtcgcccttcaatgtctctcttgaccaataggcgtagcacggaatcgagaaaggacacggaatcgagaagggccacggaatcgagaacaagcacggaatcgagaagtgggccgggaaatgccgactcggaccgatg

SEQ ID NO: 15669 - DNA, 203 bp, Homo sapiens
  source 1..203: mol_type = other DNA
ggcgcgccagtccttagtagctatgcccgttacccacctgggcaaacgacgcccacgtacggtccacgtcgcccttcaatgtctctcttgaccaataggcgtagccggcgagttgacaaggaaccggccgtgccgggggcaccggccgtgactccaagaccggccgttcccggtggaccggccgttgccgactcggaccgatg

SEQ ID NO: 15670 - DNA, 203 bp, Homo sapiens
  source 1..203: mol_type = other DNA
ggcgcgccagtcctcggccctattgcccgttacccacctgggcaaacgacgcccacgtacggtccacgtcgcccttcaatgtctctcttgaccaataggcgtagccggcgagttgacaaggaccagtgggggccgggggcccggcgggtgactccaagccggcgggttcccggtggccggcgggttgccgactcggaccgatg

SEQ ID NO: 15671 - DNA, 203 bp, Homo sapiens
  source 1..203: mol_type = other DNA
ggcgcgccagtccttgctattgacgcccgttacccacctgggcaaacgacgcccacgtacggtccacgtcgcccttcaatgtctctcttgaccaataggcgtagccggcgagttgacaaggaccagtgggggccgggggcttggagagggactccaagcgtcaattcctttagtgggccgggaaatgccgactcggaccgatg

SEQ ID NO: 15672 - DNA, 203 bp, Homo sapiens
  source 1..203: mol_type = other DNA
ggcgcgccagtcctcctgggctatgcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtggaccggccgttgccgactcggaccgatg

SEQ ID NO: 15673 - DNA, 203 bp, Homo sapiens
  source 1..203: mol_type = other DNA
ggcgcgccagtcctgaccctattggcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtggccggcgggttgccgactcggaccgatg

SEQ ID NO: 15674 - DNA, 203 bp, Homo sapiens
  source 1..203: mol_type = other DNA
ggcgcgccagtccttctatgtgcagcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgccgactcggaccgatg

SEQ ID NO: 15675 - DNA, 203 bp, Homo sapiens
  source 1..203: mol_type = other DNA
ggcgcgccagtcctgtaggctatcgcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtggtactcccaatgccgactcggaccgatg

SEQ ID NO: 15676 - DNA, 203 bp, Homo sapiens
  source 1..203: mol_type = other DNA
ggcgcgccagtcctttctatgacagcccgttacccacctgggcaaacgacgcccacgtacggtccacgtcgcccttcaatgtctctcttgaccaataggcgtagccggcgagttgacaaggacgtcaattcctttagggccgtcaattcctttacaagcgtcaattcctttagtgggccgggaaatgccgactcggaccgatg

SEQ ID NO: 15677 - DNA, 203 bp, Homo sapiens
  source 1..203: mol_type = other DNA
ggcgcgccagtcctcactctattcgcccgttacccacctgggcaaacgacgcccacgtacggtccacgtcgcccttcaatgtctctcttgaccaataggcgtagccggcgagttgacaaggatactcccgggccgggggctactcccgggactccaagtactccccttcccggtggtactcccaatgccgactcggaccgatg

SEQ ID NO: 15678 - DNA, 203 bp, Homo sapiens
  source 1..203: mol_type = other DNA
ggcgcgccagtcctatgctatcgggcccgttacccacctgggcaaacgacgcccacgtacggtccacgtcgcccttcaatgtctctcttgaccaataggcgtagttcttggcaaaacaaggattcttggcaaacgggggcttcttggcaaactccaagttcttggcaaaccggtggttcttggcaaaccgactcggaccgatg

SEQ ID NO: 15679 - DNA, 203 bp, Homo sapiens
  source 1..203: mol_type = other DNA
ggcgcgccagtcctatgactatccgcccgttacccacctgggcaaacgacgcccacgtacggtccacgtcgcccttcaatgtctcttactcccaataggcgtagtactcccgttgacaaggatactcccgggccgggggctactcccgggactccaagtactccccttcccggtggtactcccaatgccgactcggaccgatg

SEQ ID NO: 15680 - DNA, 203 bp, Homo sapiens
  source 1..203: mol_type = other DNA
ggcgcgccagtcctcctatcctttgcccgttacccacctgggcaaacgactactccctacggtccacgtactccctcaatgtctcttactcccaataggcgtagtactcccgttgacaaggatactcccgggccgggggctactcccgggactccaagtactccccttcccggtggtactcccaatgccgactcggaccgatg

SEQ ID NO: 15681 - DNA, 203 bp, Homo sapiens
  source 1..203: mol_type = other DNA
ggcgcgccagtccttcgactatgtgcccgttatactcccgggcaaacgactactccctacggtccacgtactccctcaatgtctcttactcccaataggcgtagtactcccgttgacaaggatactcccgggccgggggctactcccgggactccaagtactccccttcccggtggtactcccaatgccgactcggaccgatg

SEQ ID NO: 15682 - DNA, 203 bp, Homo sapiens
  source 1..203: mol_type = other DNA
ggcgcgccagtcctgtaacctattgcccgttattcttggcaaaaaacgacttcttggcaaagtccacgttcttggcaaatgtctctttcttggcaaaggcgtagttcttggcaaaacaaggattcttggcaaacgggggcttcttggcaaactccaagttcttggcaaaccggtggttcttggcaaaccgactcggaccgatg

SEQ ID NO: 15683 - DNA, 203 bp, Homo sapiens
  source 1..203: mol_type = other DNA
ggcgcgccagtcctagcactatgtggacccgccaccccagagtcaagctgagggcatcggcatgccgcaccggccgtgatcaggacaccggccgttcgggcagtaccggccgtggccttttcaccggccgttccttccgcaccggccgtactctcagcaccggccgtctgattgtcaccggccgtatacgactcggaccgatg

SEQ ID NO: 15684 - DNA, 203 bp, Homo sapiens
  source 1..203: mol_type = other DNA
ggcgcgccagtcctctgctatggtggacccgccaccccagagtcaagctgagggcatcggcatgccgcagggaagacgatcaggactgtttttaatcgggcagtcacggaatcgagaatttccacggaatcgagaaccgccacggaatcgagaacagccacggaatcgagaatgtcctgggtcacatacgactcggaccgatg

SEQ ID NO: 15685 - DNA, 203 bp, Homo sapiens
  source 1..203: mol_type = other DNA
ggcgcgccagtcctgctatcgcatggacccgccaccccagagtcaagctgagggcatcggcatgccgcagggaagacgatcaggactgtttttaatcgggcagtcgcgcggatggccttttcaccggccgttccttccgcaccggccgtactctcagcaccggccgtctgattgtcaccggccgtatacgactcggaccgatg

SEQ ID NO: 15686 - DNA, 203 bp, Homo sapiens
  source 1..203: mol_type = other DNA
ggcgcgccagtcctctattcgttcggacccgccaccccagagtcaagctgagggcatcggcatgccgcagggaagacgatcaggactgtttttaatcgggcagtcgcgcggatggccttttcccggcgggttccttccgcccggcgggtactctcagcccggcgggtctgattgtcccggcgggtatacgactcggaccgatg

SEQ ID NO: 15687 - DNA, 203 bp, Homo sapiens
  source 1..203: mol_type = other DNA
ggcgcgccagtccttctcgctatgggacccgccaccccagagtcaagctgagggcatcggcatgccgcagggaagacgatcaggactgtttttaatcgggcagtcgcgcggatggccttttccctctcgcctccttccgcaccggccgtactctcagcaccggccgtctgattgtcaccggccgtatacgactcggaccgatg

SEQ ID NO: 15688 - DNA, 203 bp, Homo sapiens
  source 1..203: mol_type = other DNA
ggcgcgccagtcctaactatggatggacccgccaccccagagtcaagctgagggcatcggcatgccgcagggaagacgatcaggactgtttttaatcgggcagtcgcgcggatggccttttccctctcgcctccttccgccacggaatcgagaacagccacggaatcgagaatgtcctgggtcacatacgactcggaccgatg

SEQ ID NO: 15689 - DNA, 203 bp, Homo sapiens
  source 1..203: mol_type = other DNA
ggcgcgccagtcctcctatgaaggggacccgccaccccagagtcaagctgagggcatcggcatgccgcagggaagacgatcaggactgtttttaatcgggcagtcgcgcggatggccttttccctctcgcctccttccgccccgcccccactctcagcaccggccgtctgattgtcaccggccgtatacgactcggaccgatg

SEQ ID NO: 15690 - DNA, 203 bp, Homo sapiens
  source 1..203: mol_type = other DNA
ggcgcgccagtcctccctatgtgtggacccgccaccccagagtcaagctgagggcatcggcatgccgcagggaagacgatcaggactgtttttaatcgggcagtcgcgcggatggccttttccctctcgcctccttccgccccgcccccactctcagccacggaatcgagaatgtcctgggtcacatacgactcggaccgatg

SEQ ID NO: 15691 - DNA, 203 bp, Homo sapiens
  source 1..203: mol_type = other DNA
ggcgcgccagtcctactatgttggggacccgccaccccagagtcaagctgagggcatcggcatgccgcagggaagacgatcaggactgtttttaatcgggcagtcgcgcggatggccttttccctctcgcctccttccgccccgcccccactctcagcccggcgggtctgattgtcccggcgggtatacgactcggaccgatg

SEQ ID NO: 15692 - DNA, 203 bp, Homo sapiens
  source 1..203: mol_type = other DNA
ggcgcgccagtcctcactatgattggacccgccaccccagagtcaagctgagggcatcggcatgccgcagggaagacgatcaggactgtttttaatcgggcagtcgcgcggatggccttttccctctcgcctccttccgccgtcaattcctttacagccgtcaattcctttatgtcctgggtcacatacgactcggaccgatg

SEQ ID NO: 15693 - DNA, 203 bp, Homo sapiens
  source 1..203: mol_type = other DNA
ggcgcgccagtcctctatctgattggacccgccaccccagagtcaagctgagggcatcggcatgccgctactcccacgatcaggactactcccaatcgggcagttactcccatggccttttctactccccctccttccgctactcccccactctcagctactccccgctgattgtctactcccacatacgactcggaccgatg

SEQ ID NO: 15694 - DNA, 203 bp, Homo sapiens
  source 1..203: mol_type = other DNA
ggcgcgccagtcctgaacgctattggacccgccaccccagagtcaagctgccggcgggtgcatgccgcccggcgggtgatcaggacccggcgggttcgggcagtccggcgggtggccttttcccggcgggttccttccgcccggcgggtactctcagcccggcgggtctgattgtcccggcgggtatacgactcggaccgatg

SEQ ID NO: 15695 - DNA, 203 bp, Homo sapiens
  source 1..203: mol_type = other DNA
ggcgcgccagtcctgctctatccaggacccgccaccccagagtcaagctgcgtcaattcctttaccgccgtcaattcctttaggaccgtcaattcctttacagtcgtcaattcctttatttccgtcaattcctttaccgccgtcaattcctttacagccgtcaattcctttatgtcctgggtcacatacgactcggaccgatg

SEQ ID NO: 15696 - DNA, 203 bp, Homo sapiens
  source 1..203: mol_type = other DNA
ggcgcgccagtcctctattctcaaggacccgccgtcaattcctttagctgcgtcaattcctttaccgccgtcaattcctttaggaccgtcaattcctttacagtcgtcaattcctttatttccgtcaattcctttaccgccgtcaattcctttacagccgtcaattcctttatgtcctgggtcacatacgactcggaccgatg

SEQ ID NO: 15697 - DNA, 203 bp, Homo sapiens
  source 1..203: mol_type = other DNA
ggcgcgccagtcctctattgagcgggacccgctactcccgagtcaagctgtactccccggcatgccgctactcccacgatcaggactactcccaatcgggcagttactcccatggccttttctactccccctccttccgctactcccccactctcagctactccccgctgattgtctactcccacatacgactcggaccgatg

SEQ ID NO: 15698 - DNA, 203 bp, Homo sapiens
  source 1..203: mol_type = other DNA
ggcgcgccagtcctgcttctatgagggccgcgaccggccgtcgcttccgcaccggccgtggcgggggaaccggccgtcggtctcagaccggccgtccagctctcaccggccgttcttccgccaccggccgttcgcgtttcaccggccgtcgcaatggaaccggccgtcgccgcgctaccggccgtcaacgactcggaccgatg

SEQ ID NO: 15699 - DNA, 203 bp, Homo sapiens
  source 1..203: mol_type = other DNA
ggcgcgccagtcctgacctattcggggccgcgcgcgcgcgccgcgtaggagaggagcgagcgaccaaaggaaccataactgatttaatgagccattcgcagtttcactgtaccggccgtgcgtactcagacatgcatggcttaatctttgagacaagcatatgctactggcaggatcaaccaggacaacgactcggaccgatg

SEQ ID NO: 15700 - DNA, 203 bp, Homo sapiens
  source 1..203: mol_type = other DNA
ggcgcgccagtcctctttctatgtgggccgcgcgcgcgcgccgctaagccgcaggctccactcctggtggtgcccttccgtcaattcctttaagtttcagctttgcaaccatactccccccggaacccaaagactttggtttcccggaagctgcccggcgggtcatgggaataacgccgccgcgacaacgactcggaccgatg

SEQ ID NO: 15701 - DNA, 203 bp, Homo sapiens
  source 1..203: mol_type = other DNA
ggcgcgccagtcctcgctattcgggggccgcgcgcgcgcgccgctcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatacaacgactcggaccgatg

SEQ ID NO: 15702 - DNA, 203 bp, Homo sapiens
  source 1..203: mol_type = other DNA
ggcgcgccagtcctgatcatagtcgggccgcgcgcgcgcgccgcttcaagtttcagctttgcaaccatactccccccggaacccaaagactttggtttcccggaagctgcccggcgggtcatgggaataacgccgccgcatcgccggtcggcatcgtttatggtcggaactacgacggtatttgacaacgactcggaccgatg

SEQ ID NO: 15703 - DNA, 203 bp, Homo sapiens
  source 1..203: mol_type = other DNA
ggcgcgccagtcctttgggatagagggccgcgcgcgcgcgccgcttccaactacgacggtatctgatcgtcttcgaacctccgactttcgttcttgattaatgaaaacattcttggcaaatgctttcgctctggtccgtcttgcgccggtccaagaatttcacctctagcggcgcaatacattgacaacgactcggaccgatg

SEQ ID NO: 15704 - DNA, 203 bp, Homo sapiens
  source 1..203: mol_type = other DNA
ggcgcgccagtcctatagtagctcgggccgcgcgcgcgcgccgcttccagtttcagctttgcaaccatactccccccggaacccaaagactttggtttcccggaagctgcccggcgggtcatgggaataacgccgccgcatcgccggtcggcatcgtttatggtcggaactacgacggtaattgacaacgactcggaccgatg

SEQ ID NO: 15705 - DNA, 203 bp, Homo sapiens
  source 1..203: mol_type = other DNA
ggcgcgccagtccttaatcatagggggccgcgcgcgcgcgccgcttccgagaggagcgagcgaccaaaggaaccataactgatttaatgagccattcgcagtttcactgtaccggccgtgcgtactcagacatgcatggcttaatctttgagacaagcatatgctactggcaggatcaacattgacaacgactcggaccgatg

SEQ ID NO: 15706 - DNA, 203 bp, Homo sapiens
  source 1..203: mol_type = other DNA
ggcgcgccagtcctcatagagtgtgggccgcgcgcgcgcgccgcttccgcaggtttcccgtgttgagtcaaattaagccgcaggctccactcctggtggtgcccttccgtcaattcctttaagtttcagctttgcaaccatactccccccggaacccaaagactttggtttcccggaatcattgacaacgactcggaccgatg

SEQ ID NO: 15707 - DNA, 203 bp, Homo sapiens
  source 1..203: mol_type = other DNA
ggcgcgccagtccttgagatagacgggccgcgcgcgcgcgccgcttccgccacggaatcgagaagggacacggaatcgagaatcagcacggaatcgagaatctccacggaatcgagaacgcccacggaatcgagaatttccacggaatcgagaatggacacggaatcgagaacgctggtcattgacaacgactcggaccgatg

SEQ ID NO: 15708 - DNA, 203 bp, Homo sapiens
  source 1..203: mol_type = other DNA
ggcgcgccagtcctacgggatagcgggccgcgcgcgcgcgccgcttccgcgcaggctccactcctggtggtgcccttccgtcaattcctttaagtttcagctttgcaaccatactccccccggaacccaaagactttggtttcccggaagctgcccggcgggtcatgggaataacgccgcattgacaacgactcggaccgatg

SEQ ID NO: 15709 - DNA, 203 bp, Homo sapiens
  source 1..203: mol_type = other DNA
ggcgcgccagtccttcataggatcgggccgcgcgcgcgcgccgcttccgctactcccacggcgggggatactcccgtcggtctcagtactccctgccagctctctactcccgttcttccgcctactccccgtcgcgtttctactcccgtcgcaatggatactcccatcgccgcgcttactcccgacaacgactcggaccgatg

SEQ ID NO: 15710 - DNA, 203 bp, Homo sapiens
  source 1..203: mol_type = other DNA
ggcgcgccagtcctgttgagataggggccgcgcgcgcgcgccgcttccgcttaaaaattaaccagacaaatcgctccaccaactaagaacggccatgcaccaccacccacggaatcgagaaagagctatcaatctgtcaatcctgtccgtgtccgggccgggtgaggtttcccgctggtcattgacaacgactcggaccgatg

SEQ ID NO: 15711 - DNA, 203 bp, Homo sapiens
  source 1..203: mol_type = other DNA
ggcgcgccagtcctaatagctacggggccgcgcgcgcgcgccgcttccgcttaaaacggtatctgatcgtcttcgaacctccgactttcgttcttgattaatgaaaacattcttggcaaatgctttcgctctggtccgtcttgcgccggtccaagaatttcacctctagcggcgctggtcattgacaacgactcggaccgatg

SEQ ID NO: 15712 - DNA, 203 bp, Homo sapiens
  source 1..203: mol_type = other DNA
ggcgcgccagtcctccaggatagagggccgcgcgcgcgcgccgcttccgcttaaactccactcctggtggtgcccttccgtcaattcctttaagtttcagctttgcaaccatactccccccggaacccaaagactttggtttcccggaagctgcccggcgggtcatgggaatagctggtcattgacaacgactcggaccgatg

SEQ ID NO: 15713 - DNA, 203 bp, Homo sapiens
  source 1..203: mol_type = other DNA
ggcgcgccagtccttaacgcataggggccgcgcgcgcgcgccgcttccgcttaaataacggcaaccatactccccccggaacccaaagactttggtttcccggaagctgcccggcgggtcatgggaataacgccgccgcatcgccggtcggcatcgtttatggtcggcgccgcgctggtcattgacaacgactcggaccgatg

SEQ ID NO: 15714 - DNA, 203 bp, Homo sapiens
  source 1..203: mol_type = other DNA
ggcgcgccagtcctatagctcttagggccgcgcgcgcgcgccgcttccgcttaaataacggcaccaaaggaaccataactgatttaatgagccattcgcagtttcactgtaccggccgtgcgtactcagacatgcatggcttaatctttgagacaagcatatgctatcgccgcgctggtcattgacaacgactcggaccgatg

SEQ ID NO: 15715 - DNA, 203 bp, Homo sapiens
  source 1..203: mol_type = other DNA
ggcgcgccagtcctggatagtctagggccgcgcgcgcgcgccgcttccgcttaaataacggcgaccatactccccccggaacccaaagactttggtttcccggaagctgcccggcgggtcatgggaataacgccgccgcatcgccggtcggcatcgtttatggtcatcgccgcgctggtcattgacaacgactcggaccgatg

SEQ ID NO: 15716 - DNA, 203 bp, Homo sapiens
  source 1..203: mol_type = other DNA
ggcgcgccagtcctatagtgcgaggggccgcgcgcgcgcgccgcttccgcttaaataacggcgggaaaggaaccataactgatttaatgagccattcgcagtttcactgtaccggccgtgcgtactcagacatgcatggcttaatctttgagacaagcatatgagatcgccgcgctggtcattgacaacgactcggaccgatg

SEQ ID NO: 15717 - DNA, 203 bp, Homo sapiens
  source 1..203: mol_type = other DNA
ggcgcgccagtcctaataggactagggccgcgcgcgcgcgccgcttccgcttaaataacggcgggacaaatcgctccaccaactaagaacggccatgcaccaccacccacggaatcgagaaagagctatcaatctgtcaatcctgtccgtgtccgggccgggtggatcgccgcgctggtcattgacaacgactcggaccgatg

SEQ ID NO: 15718 - DNA, 203 bp, Homo sapiens
  source 1..203: mol_type = other DNA
ggcgcgccagtcctacatagtcgcgggccgcgcgcgcgcgccgcttccgcttaaataacggcgggcatactccccccggaacccaaagactttggtttcccggaagctgcccggcgggtcatgggaataacgccgccgcatcgccggtcggcatcgtttatggagatcgccgcgctggtcattgacaacgactcggaccgatg

SEQ ID NO: 15719 - DNA, 203 bp, Homo sapiens
  source 1..203: mol_type = other DNA
ggcgcgccagtcctcaataggtctgggccgcgcgcgcgcgccgcttccgcttaaataacggcggggaaggaaccataactgatttaatgagccattcgcagtttcactgtaccggccgtgcgtactcagacatgcatggcttaatctttgagacaagcatatgagatcgccgcgctggtcattgacaacgactcggaccgatg

SEQ ID NO: 15720 - DNA, 203 bp, Homo sapiens
  source 1..203: mol_type = other DNA
ggcgcgccagtcctgtgagatagcgggccgcgcgcgcgcgccgcttccgcttaaataacggcggggcaaatcgctccaccaactaagaacggccatgcaccaccacccacggaatcgagaaagagctatcaatctgtcaatcctgtccgtgtccgggccggggagatcgccgcgctggtcattgacaacgactcggaccgatg

SEQ ID NO: 15721 - DNA, 203 bp, Homo sapiens
  source 1..203: mol_type = other DNA
ggcgcgccagtcctatagcatagtgggccgcgcgcgcgcgccgcttccgcttaaataacggcgggggaactccccccggaacccaaagactttggtttcccggaagctgcccggcgggtcatgggaataacgccgccgcatcgccggtcggcatcgtttaaagagatcgccgcgctggtcattgacaacgactcggaccgatg

SEQ ID NO: 15722 - DNA, 203 bp, Homo sapiens
  source 1..203: mol_type = other DNA
ggcgcgccagtccttcatagcactgggccgcgcgcgcgcgccgcttccgcttaaataacggcgggggacaaattaagccgcaggctccactcctggtggtgcccttccgtcaattcctttaagtttcagctttgcaaccatactccccccggaacccaaaaagagatcgccgcgctggtcattgacaacgactcggaccgatg

SEQ ID NO: 15723 - DNA, 203 bp, Homo sapiens
  source 1..203: mol_type = other DNA
ggcgcgccagtcctatagatacccgggccgcgcgcgcgcgccgcttccgcttaaataacggcgggggaccggcgggtcggtctcagccggcgggtccagctctcccggcgggttcttccgccccggcgggttcgcgtttcccggcgggtcgcaatggaccggcgggtcgccgcgctccggcgggtcaacgactcggaccgatg

SEQ ID NO: 15724 - DNA, 203 bp, Homo sapiens
  source 1..203: mol_type = other DNA
ggcgcgccagtcctctcaatagttgggccgcgcgcgcgcgccgcttccgcttaaataacggcgggggagatcgctccaccaactaagaacggccatgcaccaccacccacggaatcgagaaagagctatcaatctgtcaatcctgtccgtgtccgggccgaagagatcgccgcgctggtcattgacaacgactcggaccgatg

SEQ ID NO: 15725 - DNA, 203 bp, Homo sapiens
  source 1..203: mol_type = other DNA
ggcgcgccagtcctcatagcctaggggccgcgcgcgcgcgccgcttccgcttaaataacggcgggggaggccgcataactgatttaatgagccattcgcagtttcactgtaccggccgtgcgtactcagacatgcatggcttaatctttgagacaggaagaagagatcgccgcgctggtcattgacaacgactcggaccgatg

SEQ ID NO: 15726 - DNA, 203 bp, Homo sapiens
  source 1..203: mol_type = other DNA
ggcgcgccagtcctaagaagataggggccgcgcgcgcgcgccgcttccgcttaaataacggcgggggaggccgccccggaacccaaagactttggtttcccggaagctgcccggcgggtcatgggaataacgccgccgcatcgccggtcggcatcggaagaagagatcgccgcgctggtcattgacaacgactcggaccgatg

SEQ ID NO: 15727 - DNA, 203 bp, Homo sapiens
  source 1..203: mol_type = other DNA
ggcgcgccagtcctatagagcatggggccgcgcgcgcgcgccgcttccgcttaaataacggcgggggaggccgcgaacctccgactttcgttcttgattaatgaaaacattcttggcaaatgctttcgctctggtccgtcttgcgccggtccaatggaagaagagatcgccgcgctggtcattgacaacgactcggaccgatg

SEQ ID NO: 15728 - DNA, 203 bp, Homo sapiens
  source 1..203: mol_type = other DNA
ggcgcgccagtccttgcttcataggggccgcgcgcgcgcgccgcttccgcttaaataacggcgggggaggccgcgccggaacccaaagactttggtttcccggaagctgcccggcgggtcatgggaataacgccgccgcatcgccggtcggcaatggaagaagagatcgccgcgctggtcattgacaacgactcggaccgatg

SEQ ID NO: 15729 - DNA, 203 bp, Homo sapiens
  source 1..203: mol_type = other DNA
ggcgcgccagtcctcagttcataggggccgcgcgcgcgcgccgcttccgcttaaataacggcgggggaggccgcggcaccaactaagaacggccatgcaccaccacccacggaatcgagaaagagctatcaatctgtcaatcctgtccgtgtaatggaagaagagatcgccgcgctggtcattgacaacgactcggaccgatg

SEQ ID NO: 15730 - DNA, 203 bp, Homo sapiens
  source 1..203: mol_type = other DNA
ggcgcgccagtcctaatagtgccagggccgcgcgcgcgcgccgcttccgcttaaataacggcgggggaggccgcgggccgcaggctccactcctggtggtgcccttccgtcaattcctttaagtttcagctttgcaaccatactccccccggaatggaagaagagatcgccgcgctggtcattgacaacgactcggaccgatg

SEQ ID NO: 15731 - DNA, 203 bp, Homo sapiens
  source 1..203: mol_type = other DNA
ggcgcgccagtcctatagcgggttgggccgcgcgcgcgcgccgcttccgcttaaataacggcgggggaggccgcggtcggaactaagaacggccatgcaccaccacccacggaatcgagaaagagctatcaatctgtcaatcctgtcctcgcaatggaagaagagatcgccgcgctggtcattgacaacgactcggaccgatg

SEQ ID NO: 15732 - DNA, 203 bp, Homo sapiens
  source 1..203: mol_type = other DNA
ggcgcgccagtcctatagggacaagggccgcgcgcgcgcgccgcttccgcttaaataacggcgggggaggccgcggtcggcaggctccactcctggtggtgcccttccgtcaattcctttaagtttcagctttgcaaccatactcccctcgcaatggaagaagagatcgccgcgctggtcattgacaacgactcggaccgatg

SEQ ID NO: 15733 - DNA, 203 bp, Homo sapiens
  source 1..203: mol_type = other DNA
ggcgcgccagtcctcaatagagtggggccgcgcgcgcgcgccgcttccgcttaaataacggcgggggaggccgcggtcgggatttaatgagccattcgcagtttcactgtaccggccgtgcgtactcagacatgcatggcttaatctttcgcaatggaagaagagatcgccgcgctggtcattgacaacgactcggaccgatg

SEQ ID NO: 15734 - DNA, 203 bp, Homo sapiens
  source 1..203: mol_type = other DNA
ggcgcgccagtcctcatagtacaagggccgcgcgcgcgcgccgcttccgcttaaataacggcgggggaggccgcggtcggtactaagaacggccatgcaccaccacccacggaatcgagaaagagctatcaatctgtcaatcctgtcgtcgcaatggaagaagagatcgccgcgctggtcattgacaacgactcggaccgatg

SEQ ID NO: 15735 - DNA, 203 bp, Homo sapiens
  source 1..203: mol_type = other DNA
ggcgcgccagtcctataggtcctggggccgcgcgcgcgcgccgcttccgcttaaataacggcgggggaggccgcggtcggtaggctccactcctggtggtgcccttccgtcaattcctttaagtttcagctttgcaaccatactcccgtcgcaatggaagaagagatcgccgcgctggtcattgacaacgactcggaccgatg

SEQ ID NO: 15736 - DNA, 203 bp, Homo sapiens
  source 1..203: mol_type = other DNA
ggcgcgccagtcctgcacataggagggccgcgcgcgcgcgccgcttccgcttaaataacggcgggggaggccgcggtcggtatttaatgagccattcgcagtttcactgtaccggccgtgcgtactcagacatgcatggcttaatctgtcgcaatggaagaagagatcgccgcgctggtcattgacaacgactcggaccgatg

SEQ ID NO: 15737 - DNA, 203 bp, Homo sapiens
  source 1..203: mol_type = other DNA
ggcgcgccagtcctaatagtaatcgggccgcgcgcgcgcgccgcttccgcttaaataacggcgggggaggccgcggtcggtctcagaccggccgtccagctctcaccggccgttcttccgccaccggccgttcgcgtttcaccggccgtcgcaatggaaccggccgtcgccgcgctaccggccgtcaacgactcggaccgatg

SEQ ID NO: 15738 - DNA, 203 bp, Homo sapiens
  source 1..203: mol_type = other DNA
ggcgcgccagtcctatagtagggagggccgcgcgcgcgcgccgcttccgcttaaataacggcgggggaggccgcggtcggtctcagaccggccgtccagctctcaccggccgttcttccgccaccggccgttcgcgtttcaccggccgtcgcaatggaaccggccgtcgccgcgctggtcattgacaacgactcggaccgatg

SEQ ID NO: 15739 - DNA, 203 bp, Homo sapiens
  source 1..203: mol_type = other DNA
ggcgcgccagtcctccgatttggggggccgcgcgcgcgcgccgcttccgcttaaataacggcgggggaggccgcggtcggtctcagatgagccattcgcagtttcactgtaccggccgtgcgtactcagacatgcatggctttgccggtcgcaatggaagaagagatcgccgcgctggtcattgacaacgactcggaccgatg

SEQ ID NO: 15740 - DNA, 203 bp, Homo sapiens
  source 1..203: mol_type = other DNA
ggcgcgccagtcctcacacgtcaagggccgcgcgcgcgcgccgcttccgcttaaataacggcgggggaggccgcggtcggtctcagccggcgggtccagctctcccggcgggttcttccgccccggcgggttcgcgtttcccggcgggtcgcaatggaccggcgggtcgccgcgctggtcattgacaacgactcggaccgatg

SEQ ID NO: 15741 - DNA, 203 bp, Homo sapiens
  source 1..203: mol_type = other DNA
ggcgcgccagtcctcgtgacgtgtgggccgcgcgcgcgcgccgcttccgcttaaataacggcgggggaggccgcggtcggtctcaggggagtatgccagctctcgggagtagttcttccgccgggagtacgtcgcgtttcgggagtagtcgcaatggagggagtaatcgccgcgctggtcattgacaacgactcggaccgatg

SEQ ID NO: 15742 - DNA, 203 bp, Homo sapiens
  source 1..203: mol_type = other DNA
ggcgcgccagtcctacagttactagggccgcgcgcgcgcgccgcttccgcttaaataacggcgggggaggccgcggtcggtctcagtactccctgccagctctctactcccgttcttccgcctactccccgtcgcgtttctactcccgtcgcaatggatactcccatcgccgcgctggtcattgacaacgactcggaccgatg

SEQ ID NO: 15743 - DNA, 203 bp, Homo sapiens
  source 1..203: mol_type = other DNA
ggcgcgccagtccttggttaccatgggccgcgcgcgcgcgccgcttccgcttaaataacggcgggggaggccgcggtcggtctcagtactccctgccagctctctactcccgttcttccgcctactccccgtcgcgtttctactcccgtcgcaatggatactcccatcgccgcgcttactcccgacaacgactcggaccgatg

SEQ ID NO: 15744 - DNA, 203 bp, Homo sapiens
  source 1..203: mol_type = other DNA
ggcgcgccagtccttgtagtaacagggccgcgcgcgcgcgccgcttccgcttaaataacggcgggggaggccgcggtcggtctcagtcactttggtttcccggaagctgcccggcgggtcatgggaataacgccgccgcatctgccggtcgcaatggaagaagagatcgccgcgctggtcattgacaacgactcggaccgatg

SEQ ID NO: 15745 - DNA, 203 bp, Homo sapiens
  source 1..203: mol_type = other DNA
ggcgcgccagtcctgtattgtaaagggccgcgcgcgcgcgccgcttccgcttaaataacggcgggggaggccgcggtcggtctcagtcgccaagtttcagctttgcaaccatactccccccggaacccaaagactttttctctgccggtcgcaatggaagaagagatcgccgcgctggtcattgacaacgactcggaccgatg

SEQ ID NO: 15746 - DNA, 203 bp, Homo sapiens
  source 1..203: mol_type = other DNA
ggcgcgccagtcctgctattgtaagggccgcgcgcgcgcgccgcttccgcttaaataacggcgggggaggccgcggtcggtctcagtcgcccctggtggtgcccttccgtcaattcctttaagtttcagctttgcaattctctgccggtcgcaatggaagaagagatcgccgcgctggtcattgacaacgactcggaccgatg

SEQ ID NO: 15747 - DNA, 203 bp, Homo sapiens
  source 1..203: mol_type = other DNA
ggcgcgccagtcctgccttgcgcggggccgcgcgcgcgcgccgcttccgcttaaataacggcgggggaggccgcggtcggtctcagtcgccgctatgcaccaccacccacggaatcgagaaagagctatcaatccgtttctctgccggtcgcaatggaagaagagatcgccgcgctggtcattgacaacgactcggaccgatg

SEQ ID NO: 15748 - DNA, 203 bp, Homo sapiens
  source 1..203: mol_type = other DNA
ggcgcgccagtcctctcaaatacagggccgcgcgcgcgcgccgcttccgcttaaataacggcgggggaggccgcggtcggtctcagtcgccgctgccagcgtttcactgtaccggccgtgcgtactcaccgtcgcgtttctctgccggtcgcaatggaagaagagatcgccgcgctggtcattgacaacgactcggaccgatg

SEQ ID NO: 15749 - DNA, 203 bp, Homo sapiens
  source 1..203: mol_type = other DNA
ggcgcgccagtcctgtcaaaataggggccgcgcgcgcgcgccgcttccgcttaaataacggcgggggaggccgcggtcggtctcagtcgccgctgccagctcccacccacggaatcgagaaagagccgccgtcgcgtttctctgccggtcgcaatggaagaagagatcgccgcgctggtcattgacaacgactcggaccgatg

SEQ ID NO: 15750 - DNA, 203 bp, Homo sapiens
  source 1..203: mol_type = other DNA
ggcgcgccagtcctgcaaatacatgggccgcgcgcgcgcgccgcttccgcttaaataacggcgggggaggccgcggtcggtctcagtcgccgctgccagctcccttccgtcaattcctttaagtttcgccgtcgcgtttctctgccggtcgcaatggaagaagagatcgccgcgctggtcattgacaacgactcggaccgatg

SEQ ID NO: 15751 - DNA, 203 bp, Homo sapiens
  source 1..203: mol_type = other DNA
ggcgcgccagtcctcaaatattgagggccgcgcgcgcgcgccgcttccgcttaaataacggcgggggaggccgcggtcggtctcagtcgccgctgccagctctcaaacattcttggcaaatgcttccgccgtcgcgtttctctgccggtcgcaatggaagaagagatcgccgcgctggtcattgacaacgactcggaccgatg

SEQ ID NO: 15752 - DNA, 203 bp, Homo sapiens
  source 1..203: mol_type = other DNA
ggcgcgccagtcctactaaatacggggccgcgcgcgcgcgccgcttccgcttaaataacggcgggggaggccgcggtcggtctcagtcgccgctgccagctctcacccacggaatcgagaaagatccgccgtcgcgtttctctgccggtcgcaatggaagaagagatcgccgcgctggtcattgacaacgactcggaccgatg

SEQ ID NO: 15753 - DNA, 203 bp, Homo sapiens
  source 1..203: mol_type = other DNA
ggcgcgccagtcctgggtaaatatgggccgcgcgcgcgcgccgcttccgcttaaataacggcgggggaggccgcggtcggtctcagtcgccgctgccagctctcaccggccgttcttccgccaccggccgttcgcgtttcaccggccgtcgcaatggaaccggccgtcgccgcgctaccggccgtcaacgactcggaccgatg

SEQ ID NO: 15754 - DNA, 203 bp, Homo sapiens
  source 1..203: mol_type = other DNA
ggcgcgccagtcctcaaatactaggggccgcgcgcgcgcgccgcttccgcttaaataacggcgggggaggccgcggtcggtctcagtcgccgctgccagctctcaccggccgttcttccgccaccggccgttcgcgtttcaccggccgtcgcaatggaaccggccgtcgccgcgctggtcattgacaacgactcggaccgatg

SEQ ID NO: 15755 - DNA, 203 bp, Homo sapiens
  source 1..203: mol_type = other DNA
ggcgcgccagtcctccctaaatacgggccgcgcgcgcgcgccgcttccgcttaaataacggcgggggaggccgcggtcggtctcagtcgccgctgccagctctcacggccggttcttccgccacggccggttcgcgtttcacggccggtcgcaatggaacggccggtcgccgcgctggtcattgacaacgactcggaccgatg

SEQ ID NO: 15756 - DNA, 203 bp, Homo sapiens
  source 1..203: mol_type = other DNA
ggcgcgccagtcctggcctaaatagggccgcgcgcgcgcgccgcttccgcttaaataacggcgggggaggccgcggtcggtctcagtcgccgctgccagctctcccggcgggttcttccgccccggcgggttcgcgtttcccggcgggtcgcaatggaccggcgggtcgccgcgctccggcgggtcaacgactcggaccgatg

SEQ ID NO: 15757 - DNA, 203 bp, Homo sapiens
  source 1..203: mol_type = other DNA
ggcgcgccagtccttatttagcgcgggccgcgcgcgcgcgccgcttccgcttaaataacggcgggggaggccgcggtcggtctcagtcgccgctgccagctctcgcaaccatactcccccccgctccgccgtcgcgtttctctgccggtcgcaatggaagaagagatcgccgcgctggtcattgacaacgactcggaccgatg

SEQ ID NO: 15758 - DNA, 203 bp, Homo sapiens
  source 1..203: mol_type = other DNA
ggcgcgccagtccttacgctatttgggccgcgcgcgcgcgccgcttccgcttaaataacggcgggggaggccgcggtcggtctcagtcgccgctgccagctctcgcacgcccggcgggtcccgctccgccgtcgcgtttctctgccggtcgcaatggaagaagagatcgccgcgctggtcattgacaacgactcggaccgatg

SEQ ID NO: 15759 - DNA, 203 bp, Homo sapiens
  source 1..203: mol_type = other DNA
ggcgcgccagtcctcgggttggacgggccgcgcgcgcgcgccgcttccgcttaaataacggcgggggaggccgcggtcggtctcagtcgccgctgccagctctcgcactctgattctccgccgctccgccgtcgcgtttctctgccggtcgcaatggaagaagagatcgccgcgctggtcattgacaacgactcggaccgatg

SEQ ID NO: 15760 - DNA, 203 bp, Homo sapiens
  source 1..203: mol_type = other DNA
ggcgcgccagtcctgactcgtaccgggccgcgcgcgcgcgccgcttccgcttaaataacggcgggggaggccgcggtcggtctcagtcgccgctgccagctctcgcactctgttcttccgccgctccgccgtcgcgtttcttcttggcaaacaatggattcttggcaaaccgcgctttcttggcaaaacgactcggaccgatg

SEQ ID NO: 15761 - DNA, 203 bp, Homo sapiens
  source 1..203: mol_type = other DNA
ggcgcgccagtcctctcgtacacggggccgcgcgcgcgcgccgcttccgcttaaataacggcgggggaggccgcggtcggtctcagtcgccgctgccagctctcgcactctgttcttccgcctactccccgtcgcgtttctactcccgtcgcaatggatactcccatcgccgcgcttactcccgacaacgactcggaccgatg

SEQ ID NO: 15762 - DNA, 203 bp, Homo sapiens
  source 1..203: mol_type = other DNA
ggcgcgccagtcctagtcgtacgtgggccgcgcgcgcgcgccgcttccgcttaaataacggcgggggaggccgcggtcggtctcagtcgccgctgccagctctcgcactctgttcttccgccttcttggcaaagcgtttcttcttggcaaacaatggattcttggcaaaccgcgctttcttggcaaaacgactcggaccgatg

SEQ ID NO: 15763 - DNA, 203 bp, Homo sapiens
  source 1..203: mol_type = other DNA
ggcgcgccagtcctgtacggttctgggccgcgcgcgcgcgccgcttccgcttaaataacggcgggggaggccgcggtcggtctcagtcgccgctgccagctctcttcttggcaaattccgccttcttggcaaagcgtttcttcttggcaaacaatggattcttggcaaaccgcgctttcttggcaaaacgactcggaccgatg

SEQ ID NO: 15764 - DNA, 203 bp, Homo sapiens
  source 1..203: mol_type = other DNA
ggcgcgccagtcctgtctgaaccggggccgcgcgcgcgcgccgcttccgcttaaataacggcgggggaggccgcggtcggtctcagtcgccgctgccagctcttcactgtaccggccgtgcgtacccgccgtcgcgtttctctgccggtcgcaatggaagaagagatcgccgcgctggtcattgacaacgactcggaccgatg

SEQ ID NO: 15765 - DNA, 203 bp, Homo sapiens
  source 1..203: mol_type = other DNA
ggcgcgccagtcctacgagaaccggggccgcgcgcgcgcgccgcttccgcttaaataacggcgggggaggccgcggtcggtctcagtcgccgctgccagctcttcactgtaccggccgtgcgtactcgccgtcgcgtttctctgccggtcgcaatggaagaagagatcgccgcgctggtcattgacaacgactcggaccgatg

SEQ ID NO: 15766 - DNA, 203 bp, Homo sapiens
  source 1..203: mol_type = other DNA
ggcgcgccagtcctgtgaaccgcggggccgcgcgcgcgcgccgcttccgcttaaataacggcgggggaggccgcggtcggtctcagtcgccgctgccagctggaagctgcccggcgggtcatgggaagccgtcgcgtttctctgccggtcgcaatggaagaagagatcgccgcgctggtcattgacaacgactcggaccgatg

SEQ ID NO: 15767 - DNA, 203 bp, Homo sapiens
  source 1..203: mol_type = other DNA
ggcgcgccagtcctgagccgacgcgggccgcgcgcgcgcgccgcttccgcttaaataacggcgggggaggccgcggtcggtctcagtcgccgctgccagtgcccttccgtcaattcctttaagtttcagcgtcgcgtttctctgccggtcgcaatggaagaagagatcgccgcgctggtcattgacaacgactcggaccgatg

SEQ ID NO: 15768 - DNA, 203 bp, Homo sapiens
  source 1..203: mol_type = other DNA
ggcgcgccagtcctagccgacgttgggccgcgcgcgcgcgccgcttccgcttaaataacggcgggggaggccgcggtcggtctcagtcgccgctgccataatgaaaacattcttggcaaatgctttcgctgtcgcgtttctctgccggtcgcaatggaagaagagatcgccgcgctggtcattgacaacgactcggaccgatg

SEQ ID NO: 15769 - DNA, 203 bp, Homo sapiens
  source 1..203: mol_type = other DNA
ggcgcgccagtcctagtgccgaaggggccgcgcgcgcgcgccgcttccgcttaaataacggcgggggaggccgcggtcggtctcagtcgccgctgccgcagtttcactgtaccggccgtgcgtactcagactcgcgtttctctgccggtcgcaatggaagaagagatcgccgcgctggtcattgacaacgactcggaccgatg

SEQ ID NO: 15770 - DNA, 203 bp, Homo sapiens
  source 1..203: mol_type = other DNA
ggcgcgccagtccttttcgccgaagggccgcgcgcgcgcgccgcttccgcttaaataacggcgggggaggccgcggtcggtctcagtcgccgctgcctcccggaagctgcccggcgggtcatgggaataactcgcgtttctctgccggtcgcaatggaagaagagatcgccgcgctggtcattgacaacgactcggaccgatg

SEQ ID NO: 15771 - DNA, 203 bp, Homo sapiens
  source 1..203: mol_type = other DNA
ggcgcgccagtcctagccgattgagggccgcgcgcgcgcgccgcttccgcttaaataacggcgggggaggccgcggtcggtctcagtcgccgctgccttaatgaaaacattcttggcaaatgctttcgctctcgcgtttctctgccggtcgcaatggaagaagagatcgccgcgctggtcattgacaacgactcggaccgatg

SEQ ID NO: 15772 - DNA, 203 bp, Homo sapiens
  source 1..203: mol_type = other DNA
ggcgcgccagtcctacgtgccgaagggccgcgcgcgcgcgccgcttccgcttaaataacggcgggggaggccgcggtcggtctcagtcgccgctgcgcaccaccacccacggaatcgagaaagagctatcaacgcgtttctctgccggtcgcaatggaagaagagatcgccgcgctggtcattgacaacgactcggaccgatg

SEQ ID NO: 15773 - DNA, 203 bp, Homo sapiens
  source 1..203: mol_type = other DNA
ggcgcgccagtccttcgccgagtggggccgcgcgcgcgcgccgcttccgcttaaataacggcgggggaggccgcggtcggtctcagtcgccgctgctggtgcccttccgtcaattcctttaagtttcagcttcgcgtttctctgccggtcgcaatggaagaagagatcgccgcgctggtcattgacaacgactcggaccgatg

SEQ ID NO: 15774 - DNA, 203 bp, Homo sapiens
  source 1..203: mol_type = other DNA
ggcgcgccagtccttgtcagccgagggccgcgcgcgcgcgccgcttccgcttaaataacggcgggggaggccgcggtcggtctcagtcgccgctgcttcccggaagctgcccggcgggtcatgggaataacgcgcgtttctctgccggtcgcaatggaagaagagatcgccgcgctggtcattgacaacgactcggaccgatg

SEQ ID NO: 15775 - DNA, 203 bp, Homo sapiens
  source 1..203: mol_type = other DNA
ggcgcgccagtcctgccgagttcggggccgcgcgcgcgcgccgcttccgcttaaataacggcgggggaggccgcggtcggtctcagtcgccgctggattaatgaaaacattcttggcaaatgctttcgctctggcgtttctctgccggtcgcaatggaagaagagatcgccgcgctggtcattgacaacgactcggaccgatg

SEQ ID NO: 15776 - DNA, 203 bp, Homo sapiens
  source 1..203: mol_type = other DNA
ggcgcgccagtcctttagccgactgggccgcgcgcgcgcgccgcttccgcttaaataacggcgggggaggccgcggtcggtctcagtcgccgctggtggtgcccttccgtcaattcctttaagtttcagctttgcatttctctgccggtcgcaatggaagaagagatcgccgcgctggtcattgacaacgactcggaccgatg

SEQ ID NO: 15777 - DNA, 203 bp, Homo sapiens
  source 1..203: mol_type = other DNA
ggcgcgccagtcctgccgaatagggggccgcgcgcgcgcgccgcttccgcttaaataacggcgggggaggccgcggtcggtctcagtcgccgctttcgcagtttcactgtaccggccgtgcgtactcagacatgcgtttctctgccggtcgcaatggaagaagagatcgccgcgctggtcattgacaacgactcggaccgatg

SEQ ID NO: 15778 - DNA, 203 bp, Homo sapiens
  source 1..203: mol_type = other DNA
ggcgcgccagtcctgaaagccgatgggccgcgcgcgcgcgccgcttccgcttaaataacggcgggggaggccgcggtcggtctcagtcgccgtggtttcccggaagctgcccggcgggtcatgggaataacgccgctttctctgccggtcgcaatggaagaagagatcgccgcgctggtcattgacaacgactcggaccgatg

SEQ ID NO: 15779 - DNA, 203 bp, Homo sapiens
  source 1..203: mol_type = other DNA
ggcgcgccagtcctgccgatcagtgggccgcgcgcgcgcgccgcttccgcttaaataacggcgggggaggccgcggtcggtctcagtcgcctcttgattaatgaaaacattcttggcaaatgctttcgctctggtccttctctgccggtcgcaatggaagaagagatcgccgcgctggtcattgacaacgactcggaccgatg

SEQ ID NO: 15780 - DNA, 203 bp, Homo sapiens
  source 1..203: mol_type = other DNA
ggcgcgccagtccttgccgaaaatgggccgcgcgcgcgcgccgcttccgcttaaataacggcgggggaggccgcggtcggtctcagtcgcggccatgcaccaccacccacggaatcgagaaagagctatcaatctgtcactctgccggtcgcaatggaagaagagatcgccgcgctggtcattgacaacgactcggaccgatg

SEQ ID NO: 15781 - DNA, 203 bp, Homo sapiens
  source 1..203: mol_type = other DNA
ggcgcgccagtccttcggcagagtgggccgcgcgcgcgcgccgcttccgcttaaataacggcgggggaggccgcggtcggtctcagtcgctttggtttcccggaagctgcccggcgggtcatgggaataacgccgccgtctctgccggtcgcaatggaagaagagatcgccgcgctggtcattgacaacgactcggaccgatg

SEQ ID NO: 15782 - DNA, 203 bp, Homo sapiens
  source 1..203: mol_type = other DNA
ggcgcgccagtcctgtcggcatacgggccgcgcgcgcgcgccgcttccgcttaaataacggcgggggaggccgcggtcggtctcagtttgccaagaaagctctctttgccaagaattccgcctttgccaagaagcgtttctttgccaagaacaatggatttgccaagaaccgcgctggtcattgacaacgactcggaccgatg

SEQ ID NO: 15783 - DNA, 203 bp, Homo sapiens
  source 1..203: mol_type = other DNA
ggcgcgccagtcctaagtcggcatgggccgcgcgcgcgcgccgcttccgcttaaataacggcgggggaggccgcggtcggtctcttcctttaagtttcagctttgcaaccatactccccccggaacccaaagactttggtttccccggtcgcaatggaagaagagatcgccgcgctggtcattgacaacgactcggaccgatg

SEQ ID NO: 15784 - DNA, 203 bp, Homo sapiens
  source 1..203: mol_type = other DNA
ggcgcgccagtcctgtcggctacggggccgcgcgcgcgcgccgcttccgcttaaataacggcgggggaggccgcggtcgtgatttaatgagccattcgcagtttcactgtaccggccgtgcgtactcagacatgcatggcttaatctttcgcaatggaagaagagatcgccgcgctggtcattgacaacgactcggaccgatg

SEQ ID NO: 15785 - DNA, 203 bp, Homo sapiens
  source 1..203: mol_type = other DNA
ggcgcgccagtcctacacctcggcgggccgcgcgcgcgcgccgcttccgcttaaataacggcgggggaggccgcggtggaacccaaagactttggtttcccggaagctgcccggcgggtcatgggaataacgccgccgcatcgccggtcggcaatggaagaagagatcgccgcgctggtcattgacaacgactcggaccgatg

SEQ ID NO: 15786 - DNA, 203 bp, Homo sapiens
  source 1..203: mol_type = other DNA
ggcgcgccagtccttgggctcggcgggccgcgcgcgcgcgccgcttccgcttaaataacggcgggggaggccgtaagccgcaggctccactcctggtggtgcccttccgtcaattcctttaagtttcagctttgcaaccatactccccccggaacggaagaagagatcgccgcgctggtcattgacaacgactcggaccgatg

SEQ ID NO: 15787 - DNA, 203 bp, Homo sapiens
  source 1..203: mol_type = other DNA
ggcgcgccagtccttatcggcaaggggccgcgcgcgcgcgccgcttccgcttaaataacggcgggggaggcgcccttccgtcaattcctttaagtttcagctttgcaaccatactccccccggaacccaaagactttggtttcccggaagctgcccgaagaagagatcgccgcgctggtcattgacaacgactcggaccgatg

SEQ ID NO: 15788 - DNA, 203 bp, Homo sapiens
  source 1..203: mol_type = other DNA
ggcgcgccagtcctgcttcggcacgggccgcgcgcgcgcgccgcttccgcttaaataacggcgggggaggcttcgaacctccgactttcgttcttgattaatgaaaacattcttggcaaatgctttcgctctggtccgtcttgcgccggtccaagaatagaagagatcgccgcgctggtcattgacaacgactcggaccgatg

SEQ ID NO: 15789 - DNA, 203 bp, Homo sapiens
  source 1..203: mol_type = other DNA
ggcgcgccagtcctcccgctaccggggccgcgcgcgcgcgccgcttccgcttaaataacggcgggggtggtgcccttccgtcaattcctttaagtttcagctttgcaaccatactccccccggaacccaaagactttggtttcccggaagctgcccggcggagagatcgccgcgctggtcattgacaacgactcggaccgatg

SEQ ID NO: 15790 - DNA, 203 bp, Homo sapiens
  source 1..203: mol_type = other DNA
ggcgcgccagtcctcacacccttagggccgcgcgcgcgcgccgcttccgcttaaataacggcgggggtggtgcccttccgtcaattcctttaagtttcagctttgcaaccatactccccccggaacccaaagactttggtttcccggaagctgcccggcgggtagatcgccgcgctggtcattgacaacgactcggaccgatg

SEQ ID NO: 15791 - DNA, 203 bp, Homo sapiens
  source 1..203: mol_type = other DNA
ggcgcgccagtcctaaagcccgttgggccgcgcgcgcgcgccgcttccgcttaaataacggcgtgagtcaaattaagccgcaggctccactcctggtggtgcccttccgtcaattcctttaagtttcagctttgcaaccatactccccccggaacccaaagacttatcgccgcgctggtcattgacaacgactcggaccgatg

SEQ ID NO: 15792 - DNA, 203 bp, Homo sapiens
  source 1..203: mol_type = other DNA
ggcgcgccagtcctgttcgggcttgggccgcgcgcgcgcgccgcttccgcttaaataacgggaccaaaggaaccataactgatttaatgagccattcgcagtttcactgtaccggccgtgcgtactcagacatgcatggcttaatctttgagacaagcatatgctaccgccgcgctggtcattgacaacgactcggaccgatg

SEQ ID NO: 15793 - DNA, 203 bp, Homo sapiens
  source 1..203: mol_type = other DNA
ggcgcgccagtcctctttctcgcggggccgcgcgcgcgcgccgcttccgcttaaataacgtgttgagtcaaattaagccgcaggctccactcctggtggtgcccttccgtcaattcctttaagtttcagctttgcaaccatactccccccggaacccaaagactttggttcgcgctggtcattgacaacgactcggaccgatg

SEQ ID NO: 15794 - DNA, 203 bp, Homo sapiens
  source 1..203: mol_type = other DNA
ggcgcgccagtcctcacctcgcgggggccgcgcgcgcgcgccgcttccgcttaaataactgcaaccatactccccccggaacccaaagactttggtttcccggaagctgcccggcgggtcatgggaataacgccgccgcatcgccggtcggcatcgtttatggtcggaaccgcgctggtcattgacaacgactcggaccgatg

SEQ ID NO: 15795 - DNA, 203 bp, Homo sapiens
  source 1..203: mol_type = other DNA
ggcgcgccagtcctgaccgcgagagggccgcgcgcgcgcgccgcttccgcttaaataccactcctggtggtgcccttccgtcaattcctttaagtttcagctttgcaaccatactccccccggaacccaaagactttggtttcccggaagctgcccggcgggtcatgggaagcgctggtcattgacaacgactcggaccgatg

SEQ ID NO: 15796 - DNA, 203 bp, Homo sapiens
  source 1..203: mol_type = other DNA
ggcgcgccagtcctacgcgagtgagggccgcgcgcgcgcgccgcttccgcttaaataccgtgttgagtcaaattaagccgcaggctccactcctggtggtgcccttccgtcaattcctttaagtttcagctttgcaaccatactccccccggaacccaaagactttggtttgcgctggtcattgacaacgactcggaccgatg

SEQ ID NO: 15797 - DNA, 203 bp, Homo sapiens
  source 1..203: mol_type = other DNA
ggcgcgccagtcctacgcgagaacgggccgcgcgcgcgcgccgcttccgcttaaatagagcgaccaaaggaaccataactgatttaatgagccattcgcagtttcactgtaccggccgtgcgtactcagacatgcatggcttaatctttgagacaagcatatgctactggcgcgctggtcattgacaacgactcggaccgatg

SEQ ID NO: 15798 - DNA, 203 bp, Homo sapiens
  source 1..203: mol_type = other DNA
ggcgcgccagtcctgacacaccatgggccgcgcgcgcgcgccgcttccgcttaaatcccgtgttgagtcaaattaagccgcaggctccactcctggtggtgcccttccgtcaattcctttaagtttcagctttgcaaccatactccccccggaacccaaagactttggtttccgctggtcattgacaacgactcggaccgatg

SEQ ID NO: 15799 - DNA, 203 bp, Homo sapiens
  source 1..203: mol_type = other DNA
ggcgcgccagtcctgtgtcagtaggggccgcgcgcgcgcgccgcttccgcttaaatcgagcgaccaaaggaaccataactgatttaatgagccattcgcagtttcactgtaccggccgtgcgtactcagacatgcatggcttaatctttgagacaagcatatgctactggcacgctggtcattgacaacgactcggaccgatg

SEQ ID NO: 15800 - DNA, 203 bp, Homo sapiens
  source 1..203: mol_type = other DNA
ggcgcgccagtcctacaggtgtcagggccgcgcgcgcgcgccgcttccgcttaagacggtatctgatcgtcttcgaacctccgactttcgttcttgattaatgaaaacattcttggcaaatgctttcgctctggtccgtcttgcgccggtccaagaatttcacctctagcggcgctggtcattgacaacgactcggaccgatg

SEQ ID NO: 15801 - DNA, 203 bp, Homo sapiens
  source 1..203: mol_type = other DNA
ggcgcgccagtccttgtgtcaccggggccgcgcgcgcgcgccgcttccgcttacagctttgcaaccatactccccccggaacccaaagactttggtttcccggaagctgcccggcgggtcatgggaataacgccgccgcatcgccggtcggcatcgtttatggtcggaactacgatggtcattgacaacgactcggaccgatg

SEQ ID NO: 15802 - DNA, 203 bp, Homo sapiens
  source 1..203: mol_type = other DNA
ggcgcgccagtcctttgacaccacgggccgcgcgcgcgcgccgcttccgcttacgacggtatctgatcgtcttcgaacctccgactttcgttcttgattaatgaaaacattcttggcaaatgctttcgctctggtccgtcttgcgccggtccaagaatttcacctctagcggcgctggtcattgacaacgactcggaccgatg

SEQ ID NO: 15803 - DNA, 203 bp, Homo sapiens
  source 1..203: mol_type = other DNA
ggcgcgccagtcctatgacactgcgggccgcgcgcgcgcgccgcttccgcttagagcgagcgaccaaaggaaccataactgatttaatgagccattcgcagtttcactgtaccggccgtgcgtactcagacatgcatggcttaatctttgagacaagcatatgctactggcaggatggtcattgacaacgactcggaccgatg

SEQ ID NO: 15804 - DNA, 203 bp, Homo sapiens
  source 1..203: mol_type = other DNA
ggcgcgccagtcctgcgcaggacggggccgcgcgcgcgcgccgcttccggaggtttcccgtgttgagtcaaattaagccgcaggctccactcctggtggtgcccttccgtcaattcctttaagtttcagctttgcaaccatactccccccggaacccaaagactttggtttcccggaagcattgacaacgactcggaccgatg

SEQ ID NO: 15805 - DNA, 203 bp, Homo sapiens
  source 1..203: mol_type = other DNA
ggcgcgccagtcctagcgcaggccgggccgcgcgcgcgcgccgcttcctgaggtttcccgtgttgagtcaaattaagccgcaggctccactcctggtggtgcccttccgtcaattcctttaagtttcagctttgcaaccatactccccccggaacccaaagactttggtttcccggaagcattgacaacgactcggaccgatg

SEQ ID NO: 15806 - DNA, 203 bp, Homo sapiens
  source 1..203: mol_type = other DNA
ggcgcgccagtcctattctgcgccgggccgcgcgcgcgcgccgcttcgtgaggtttcccgtgttgagtcaaattaagccgcaggctccactcctggtggtgcccttccgtcaattcctttaagtttcagctttgcaaccatactccccccggaacccaaagactttggtttcccggaagctttgacaacgactcggaccgatg

SEQ ID NO: 15807 - DNA, 203 bp, Homo sapiens
  source 1..203: mol_type = other DNA
ggcgcgccagtccttatgctgcgcgggccgcgcgcgcgcgccgcttggtgaggtttcccgtgttgagtcaaattaagccgcaggctccactcctggtggtgcccttccgtcaattcctttaagtttcagctttgcaaccatactccccccggaacccaaagactttggtttcccggaagctgtgacaacgactcggaccgatg

SEQ ID NO: 15808 - DNA, 203 bp, Homo sapiens
  source 1..203: mol_type = other DNA
ggcgcgccagtcctccagtgggtggggccgcgcgtcaattcctttaccgccgtcaattcctttagggacgtcaattcctttatcagcgtcaattcctttatctccgtcaattcctttacgcccgtcaattcctttatttccgtcaattcctttatggacgtcaattcctttacgctggtcattgacaacgactcggaccgatg

SEQ ID NO: 15809 - DNA, 203 bp, Homo sapiens
  source 1..203: mol_type = other DNA
ggcgcgccagtcctaagtgggtcagggccgcgtactcccgccgcttccgctactcccacggcgggggatactcccgtcggtctcagtactccctgccagctctctactcccgttcttccgcctactccccgtcgcgtttctactcccgtcgcaatggatactcccatcgccgcgcttactcccgacaacgactcggaccgatg

SEQ ID NO: 15810 - DNA, 203 bp, Homo sapiens
  source 1..203: mol_type = other DNA
ggcgcgccagtcctcccactgcgtgttgtgttagttgtgttagtgtaggagaggagcgagcgaccaaaggaaccataactgatttaatgagccattcgcagtttcactgtaccggccgtgcgtactcagacatgcatggcttaatctttgagacaagcatatgctactggcaggatcaaccaggtagtcgactcggaccgatg

SEQ ID NO: 15811 - DNA, 203 bp, Homo sapiens
  source 1..203: mol_type = other DNA
ggcgcgccagtcctcgatagtggggttgtgttagttgtgttagttaagccgcaggctccactcctggtggtgcccttccgtcaattcctttaagtttcagctttgcaaccatactccccccggaacccaaagactttggtttcccggaagctgcccggcgggtcatgggaataacgccgccgcatagtcgactcggaccgatg

SEQ ID NO: 15812 - DNA, 203 bp, Homo sapiens
  source 1..203: mol_type = other DNA
ggcgcgccagtcctcgggcccactgttgtgttagttgtgttagttaagccgcaggctccactcctggtggtgcccttccgtcaattcctttaagtttcagctttgcaaccatactccccccggaacccaaagactttggtttcccggaagctgcccggcgggtcatgggaataacgccgccgcttagtcgactcggaccgatg

SEQ ID NO: 15813 - DNA, 203 bp, Homo sapiens
  source 1..203: mol_type = other DNA
ggcgcgccagtcctaagcccacttgttgtgttagttgtgttagttcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaattagtcgactcggaccgatg

SEQ ID NO: 15814 - DNA, 203 bp, Homo sapiens
  source 1..203: mol_type = other DNA
ggcgcgccagtcctagtgggacttgttgtgttagttgtgttagttgggaactacgacggtatctgatcgtcttcgaacctccgactttcgttcttgattaatgaaaacattcttggcaaatgctttcgctctggtccgtcttgcgccggtccaagaatttcacctctagcggcgcaatacgagttagtcgactcggaccgatg

SEQ ID NO: 15815 - DNA, 203 bp, Homo sapiens
  source 1..203: mol_type = other DNA
ggcgcgccagtcctacgcgctgacgttgtgttagttgtgttagttgtaagtttcagctttgcaaccatactccccccggaacccaaagactttggtttcccggaagctgcccggcgggtcatgggaataacgccgccgcatcgccggtcggcatcgtttatggtcggaactacgacggtatcgttagtcgactcggaccgatg

SEQ ID NO: 15816 - DNA, 203 bp, Homo sapiens
  source 1..203: mol_type = other DNA
ggcgcgccagtccttcgccctagagttgtgttagttgtgttagttgtgccgcaggctccactcctggtggtgcccttccgtcaattcctttaagtttcagctttgcaaccatactccccccggaacccaaagactttggtttcccggaagctgcccggcgggtcatgggaataacgccgcgtgttagtcgactcggaccgatg

SEQ ID NO: 15817 - DNA, 203 bp, Homo sapiens
  source 1..203: mol_type = other DNA
ggcgcgccagtcctaccggtgctagttgtgttagttgtgttagttgtgtgtttcagctttgcaaccatactccccccggaacccaaagactttggtttcccggaagctgcccggcgggtcatgggaataacgccgccgcatcgccggtcggcatcgtttatggtcggaactacgacggttgtgttagtcgactcggaccgatg

SEQ ID NO: 15818 - DNA, 203 bp, Homo sapiens
  source 1..203: mol_type = other DNA
ggcgcgccagtccttcgtgcgtcagttgtgttagttgtgttagttgtgttagacgacggtatctgatcgtcttcgaacctccgactttcgttcttgattaatgaaaacattcttggcaaatgctttcgctctggtccgtcttgcgccggtccaagaatttcacctctagcggcgcaagttgtgttagtcgactcggaccgatg

SEQ ID NO: 15819 - DNA, 203 bp, Homo sapiens
  source 1..203: mol_type = other DNA
ggcgcgccagtccttgcgtcacgagttgtgttagttgtgttagttgtgttagggagcgagcgaccaaaggaaccataactgatttaatgagccattcgcagtttcactgtaccggccgtgcgtactcagacatgcatggcttaatctttgagacaagcatatgctactggcaggatagttgtgttagtcgactcggaccgatg

SEQ ID NO: 15820 - DNA, 203 bp, Homo sapiens
  source 1..203: mol_type = other DNA
ggcgcgccagtcctgcgtgacgctgttgtgttagttgtgttagttgtgttagtcagctttgcaaccatactccccccggaacccaaagactttggtttcccggaagctgcccggcgggtcatgggaataacgccgccgcatcgccggtcggcatcgtttatggtcggaactacgatagttgtgttagtcgactcggaccgatg

SEQ ID NO: 15821 - DNA, 203 bp, Homo sapiens
  source 1..203: mol_type = other DNA
ggcgcgccagtcctcaagcgtcacgttgtgttagttgtgttagttgtgttagtcgacggtatctgatcgtcttcgaacctccgactttcgttcttgattaatgaaaacattcttggcaaatgctttcgctctggtccgtcttgcgccggtccaagaatttcacctctagcggcgctagttgtgttagtcgactcggaccgatg

SEQ ID NO: 15822 - DNA, 203 bp, Homo sapiens
  source 1..203: mol_type = other DNA
ggcgcgccagtcctgtgacgcagagttgtgttagttgtgttagttgtgttagttgaattaaccagacaaatcgctccaccaactaagaacggccatgcaccaccacccacggaatcgagaaagagctatcaatctgtcaatcctgtccgtgtccgggccgggtgaggtttcccgttagttgtgttagtcgactcggaccgatg

SEQ ID NO: 15823 - DNA, 203 bp, Homo sapiens
  source 1..203: mol_type = other DNA
ggcgcgccagtcctctctcgcgttgttgtgttagttgtgttagttgtgttagttggctttgcaaccatactccccccggaacccaaagactttggtttcccggaagctgcccggcgggtcatgggaataacgccgccgcatcgccggtcggcatcgtttatggtcggaactacgttagttgtgttagtcgactcggaccgatg

SEQ ID NO: 15824 - DNA, 203 bp, Homo sapiens
  source 1..203: mol_type = other DNA
ggcgcgccagtccttctaacgcgggttgtgttagttgtgttagttgtgttagttgtcgagcgaccaaaggaaccataactgatttaatgagccattcgcagtttcactgtaccggccgtgcgtactcagacatgcatggcttaatctttgagacaagcatatgctactggcatgttagttgtgttagtcgactcggaccgatg

SEQ ID NO: 15825 - DNA, 203 bp, Homo sapiens
  source 1..203: mol_type = other DNA
ggcgcgccagtccttaacgcgagtgttgtgttagttgtgttagttgtgttagttgtctttgcaaccatactccccccggaacccaaagactttggtttcccggaagctgcccggcgggtcatgggaataacgccgccgcatcgccggtcggcatcgtttatggtcggaactatgttagttgtgttagtcgactcggaccgatg

SEQ ID NO: 15826 - DNA, 203 bp, Homo sapiens
  source 1..203: mol_type = other DNA
ggcgcgccagtcctcgcaacgcgggttgtgttagttgtgttagttgtgttagttgtgccactcctggtggtgcccttccgtcaattcctttaagtttcagctttgcaaccatactccccccggaacccaaagactttggtttcccggaagctgcccggcgggtcatgggaagtgttagttgtgttagtcgactcggaccgatg

SEQ ID NO: 15827 - DNA, 203 bp, Homo sapiens
  source 1..203: mol_type = other DNA
ggcgcgccagtccttcaacgcgcagttgtgttagttgtgttagttgtgttagttgtgccgtgttgagtcaaattaagccgcaggctccactcctggtggtgcccttccgtcaattcctttaagtttcagctttgcaaccatactccccccggaacccaaagactttggtttgtgttagttgtgttagtcgactcggaccgatg

SEQ ID NO: 15828 - DNA, 203 bp, Homo sapiens
  source 1..203: mol_type = other DNA
ggcgcgccagtccttggcgcaggagttgtgttagttgtgttagttgtgttagttgtgttaaccagacaaatcgctccaccaactaagaacggccatgcaccaccacccacggaatcgagaaagagctatcaatctgtcaatcctgtccgtgtccgggccgggtgaggtttcgtgttagttgtgttagtcgactcggaccgatg

SEQ ID NO: 15829 - DNA, 203 bp, Homo sapiens
  source 1..203: mol_type = other DNA
ggcgcgccagtccttggcgcgttagttgtgttagttgtgttagttgtgttagttgtgttaaccagacaaatcgctccaccaactaagaacggccatgcaccaccacccacggaatcgagaaagagctatcaatctgtcaatcctgtccgtgtccgggccgggtgaggttttgtgttagttgtgttagtcgactcggaccgatg

SEQ ID NO: 15830 - DNA, 203 bp, Homo sapiens
  source 1..203: mol_type = other DNA
ggcgcgccagtccttgtgccacgtgttgtgttagttgtgttagttgtgttagttgtgttaatctgatcgtcttcgaacctccgactttcgttcttgattaatgaaaacattcttggcaaatgctttcgctctggtccgtcttgcgccggtccaagaatttcacctctagttgtgttagttgtgttagtcgactcggaccgatg

SEQ ID NO: 15831 - DNA, 203 bp, Homo sapiens
  source 1..203: mol_type = other DNA
ggcgcgccagtcctgtatgccaccgttgtgttagttgtgttagttgtgttagttgtgttacgaccaaaggaaccataactgatttaatgagccattcgcagtttcactgtaccggccgtgcgtactcagacatgcatggcttaatctttgagacaagcatatgctactgttgtgttagttgtgttagtcgactcggaccgatg

SEQ ID NO: 15832 - DNA, 203 bp, Homo sapiens
  source 1..203: mol_type = other DNA
ggcgcgccagtcctgaagtggctcgttgtgttagttgtgttagttgtgttagttgtgttagcaaccatactccccccggaacccaaagactttggtttcccggaagctgcccggcgggtcatgggaataacgccgccgcatcgccggtcggcatcgtttatggtcggagttgtgttagttgtgttagtcgactcggaccgatg

SEQ ID NO: 15833 - DNA, 203 bp, Homo sapiens
  source 1..203: mol_type = other DNA
ggcgcgccagtcctgccaccatttgttgtgttagttgtgttagttgtgttagttgtgttagtcagacaaatcgctccaccaactaagaacggccatgcaccaccacccacggaatcgagaaagagctatcaatctgtcaatcctgtccgtgtccgggccgggtgagtagttgtgttagttgtgttagtcgactcggaccgatg

SEQ ID NO: 15834 - DNA, 203 bp, Homo sapiens
  source 1..203: mol_type = other DNA
ggcgcgccagtcctagccacgccggttgtgttagttgtgttagttgtgttagttgtgttagtcctggtggtgcccttccgtcaattcctttaagtttcagctttgcaaccatactccccccggaacccaaagactttggtttcccggaagctgcccggcgggtcattagttgtgttagttgtgttagtcgactcggaccgatg

SEQ ID NO: 15835 - DNA, 203 bp, Homo sapiens
  source 1..203: mol_type = other DNA
ggcgcgccagtcctagtggcattcgttgtgttagttgtgttagttgtgttagttgtgttagttagacaaatcgctccaccaactaagaacggccatgcaccaccacccacggaatcgagaaagagctatcaatctgtcaatcctgtccgtgtccgggccgggtgattagttgtgttagttgtgttagtcgactcggaccgatg

SEQ ID NO: 15836 - DNA, 203 bp, Homo sapiens
  source 1..203: mol_type = other DNA
ggcgcgccagtcctaagtggccctgttgtgttagttgtgttagttgtgttagttgtgttagttgcaaaggaaccataactgatttaatgagccattcgcagtttcactgtaccggccgtgcgtactcagacatgcatggcttaatctttgagacaagcatatgcgttagttgtgttagttgtgttagtcgactcggaccgatg

SEQ ID NO: 15837 - DNA, 203 bp, Homo sapiens
  source 1..203: mol_type = other DNA
ggcgcgccagtcctggtggccctagttgtgttagttgtgttagttgtgttagttgtgttagttggacaaatcgctccaccaactaagaacggccatgcaccaccacccacggaatcgagaaagagctatcaatctgtcaatcctgtccgtgtccgggccgggtggttagttgtgttagttgtgttagtcgactcggaccgatg

SEQ ID NO: 15838 - DNA, 203 bp, Homo sapiens
  source 1..203: mol_type = other DNA
ggcgcgccagtcctgggccaccttgttgtgttagttgtgttagttgtgttagttgtgttagttgtgatactccccccggaacccaaagactttggtttcccggaagctgcccggcgggtcatgggaataacgccgccgcatcgccggtcggcatcgtttatggtgttagttgtgttagttgtgttagtcgactcggaccgatg

SEQ ID NO: 15839 - DNA, 203 bp, Homo sapiens
  source 1..203: mol_type = other DNA
ggcgcgccagtcctcctagccactgttgtgttagttgtgttagttgtgttagttgtgttagttgtggtggtgcccttccgtcaattcctttaagtttcagctttgcaaccatactccccccggaacccaaagactttggtttcccggaagctgcccggcgggttgttagttgtgttagttgtgttagtcgactcggaccgatg

SEQ ID NO: 15840 - DNA, 203 bp, Homo sapiens
  source 1..203: mol_type = other DNA
ggcgcgccagtcctgtggcacttcgttgtgttagttgtgttagttgtgttagttgtgttagttgtgtaggaaccataactgatttaatgagccattcgcagtttcactgtaccggccgtgcgtactcagacatgcatggcttaatctttgagacaagcatatgtgttagttgtgttagttgtgttagtcgactcggaccgatg

SEQ ID NO: 15841 - DNA, 203 bp, Homo sapiens
  source 1..203: mol_type = other DNA
ggcgcgccagtcctccagtggcccgttgtgttagttgtgttagttgtgttagttgtgttagttgtgtcgtcttcgaacctccgactttcgttcttgattaatgaaaacattcttggcaaatgctttcgctctggtccgtcttgcgccggtccaagaatttcagtgttagttgtgttagttgtgttagtcgactcggaccgatg

SEQ ID NO: 15842 - DNA, 203 bp, Homo sapiens
  source 1..203: mol_type = other DNA
ggcgcgccagtcctatcgtggcaggttgtgttagttgtgttagttgtgttagttgtgttagttgtgttaatcgctccaccaactaagaacggccatgcaccaccacccacggaatcgagaaagagctatcaatctgtcaatcctgtccgtgtccgggccgttgtgttagttgtgttagttgtgttagtcgactcggaccgatg

SEQ ID NO: 15843 - DNA, 203 bp, Homo sapiens
  source 1..203: mol_type = other DNA
ggcgcgccagtcctaccgagtggcgttgtgttagttgtgttagttgtgttagttgtgttagttgtgttaccggccgtagttgtgttaccggccgtagttgtgttaccggccgtagttgtgttaccggccgtagttgtgttaccggccgtagttgtgttaccggccgtagttgtgttaccggccgtagtcgactcggaccgatg

SEQ ID NO: 15844 - DNA, 203 bp, Homo sapiens
  source 1..203: mol_type = other DNA
ggcgcgccagtcctccttagtggcgttgtgttagttgtgttagttgtgttagttgtgttagttgtgttagaaccataactgatttaatgagccattcgcagtttcactgtaccggccgtgcgtactcagacatgcatggcttaatctttgagacaagcagttgtgttagttgtgttagttgtgttagtcgactcggaccgatg

SEQ ID NO: 15845 - DNA, 203 bp, Homo sapiens
  source 1..203: mol_type = other DNA
ggcgcgccagtcctgcagtgccacgttgtgttagttgtgttagttgtgttagttgtgttagttgtgttagtattaagccgcaggctccactcctggtggtgcccttccgtcaattcctttaagtttcagctttgcaaccatactccccccggaaccctagttgtgttagttgtgttagttgtgttagtcgactcggaccgatg

SEQ ID NO: 15846 - DNA, 203 bp, Homo sapiens
  source 1..203: mol_type = other DNA
ggcgcgccagtcctcgaagtggccgttgtgttagttgtgttagttgtgttagttgtgttagttgtgttagtccccccggaacccaaagactttggtttcccggaagctgcccggcgggtcatgggaataacgccgccgcatcgccggtcggcatcgttagttgtgttagttgtgttagttgtgttagtcgactcggaccgatg

SEQ ID NO: 15847 - DNA, 203 bp, Homo sapiens
  source 1..203: mol_type = other DNA
ggcgcgccagtccttacccgtggcgttgtgttagttgtgttagttgtgttagttgtgttagttgtgttagtgcccttccgtcaattcctttaagtttcagctttgcaaccatactccccccggaacccaaagactttggtttcccggaagctgcccggagttgtgttagttgtgttagttgtgttagtcgactcggaccgatg

SEQ ID NO: 15848 - DNA, 203 bp, Homo sapiens
  source 1..203: mol_type = other DNA
ggcgcgccagtccttttacgtggcgttgtgttagttgtgttagttgtgttagttgtgttagttgtgttagtgcccttccgtcaattcctttaagtttcagctttgcaaccatactccccccggaacccaaagactttggtttcccggaagctgcccgtagttgtgttagttgtgttagttgtgttagtcgactcggaccgatg

SEQ ID NO: 15849 - DNA, 203 bp, Homo sapiens
  source 1..203: mol_type = other DNA
ggcgcgccagtcctcatgggtggcgttgtgttagttgtgttagttgtgttagttgtgttagttgtgttagttccataactgatttaatgagccattcgcagtttcactgtaccggccgtgcgtactcagacatgcatggcttaatctttgagacaattagttgtgttagttgtgttagttgtgttagtcgactcggaccgatg

SEQ ID NO: 15850 - DNA, 203 bp, Homo sapiens
  source 1..203: mol_type = other DNA
ggcgcgccagtccttagccaccctgttgtgttagttgtgttagttgtgttagttgtgttagttgtgttagttcccccggaacccaaagactttggtttcccggaagctgcccggcgggtcatgggaataacgccgccgcatcgccggtcggcatcgttagttgtgttagttgtgttagttgtgttagtcgactcggaccgatg

SEQ ID NO: 15851 - DNA, 203 bp, Homo sapiens
  source 1..203: mol_type = other DNA
ggcgcgccagtccttcgaactacggttgtgttagttgtgttagttgtgttagttgtgttagttgtgttagttcccttccgtcaattcctttaagtttcagctttgcaaccatactccccccggaacccaaagactttggtttcccggaagctgcccttagttgtgttagttgtgttagttgtgttagtcgactcggaccgatg

SEQ ID NO: 15852 - DNA, 203 bp, Homo sapiens
  source 1..203: mol_type = other DNA
ggcgcgccagtccttcgaacgtttgttgtgttagttgtgttagttgtgttagttgtgttagttgtgttagttgcgaacctccgactttcgttcttgattaatgaaaacattcttggcaaatgctttcgctctggtccgtcttgcgccggtccaaggttagttgtgttagttgtgttagttgtgttagtcgactcggaccgatg

SEQ ID NO: 15853 - DNA, 203 bp, Homo sapiens
  source 1..203: mol_type = other DNA
ggcgcgccagtccttcgaacctgagttgtgttagttgtgttagttgtgttagttgtgttagttgtgttagttgtaagccgcaggctccactcctggtggtgcccttccgtcaattcctttaagtttcagctttgcaaccatactccccccggaacgttagttgtgttagttgtgttagttgtgttagtcgactcggaccgatg

SEQ ID NO: 15854 - DNA, 203 bp, Homo sapiens
  source 1..203: mol_type = other DNA
ggcgcgccagtcctctgttcgactgttgtgttagttgtgttagttgtgttagttgtgttagttgtgttagttgtgaacctccgactttcgttcttgattaatgaaaacattcttggcaaatgctttcgctctggtccgtcttgcgccggtccagtgttagttgtgttagttgtgttagttgtgttagtcgactcggaccgatg

SEQ ID NO: 15855 - DNA, 203 bp, Homo sapiens
  source 1..203: mol_type = other DNA
ggcgcgccagtcctgtccgtcccggttgtgttagttgtgttagttgtgttagttgtgttagttgtgttagttgtgtaactgatttaatgagccattcgcagtttcactgtaccggccgtgcgtactcagacatgcatggcttaatctttgagtgtgttagttgtgttagttgtgttagttgtgttagtcgactcggaccgatg

SEQ ID NO: 15856 - DNA, 203 bp, Homo sapiens
  source 1..203: mol_type = other DNA
ggcgcgccagtccttgtccggtcggttgtgttagttgtgttagttgtgttagttgtgttagttgtgttagttgtgtacctccgactttcgttcttgattaatgaaaacattcttggcaaatgctttcgctctggtccgtcttgcgccggtcctgtgttagttgtgttagttgtgttagttgtgttagtcgactcggaccgatg

SEQ ID NO: 15857 - DNA, 203 bp, Homo sapiens
  source 1..203: mol_type = other DNA
ggcgcgccagtcctagctgtccgagttgtgttagttgtgttagttgtgttagttgtgttagttgtgttagttgtgtcggaacccaaagactttggtttcccggaagctgcccggcgggtcatgggaataacgccgccgcatcgccggtcggctgtgttagttgtgttagttgtgttagttgtgttagtcgactcggaccgatg

SEQ ID NO: 15858 - DNA, 203 bp, Homo sapiens
  source 1..203: mol_type = other DNA
ggcgcgccagtcctaagtccggttgttgtgttagttgtgttagttgtgttagttgtgttagttgtgttagttgtgtgccgcaggctccactcctggtggtgcccttccgtcaattcctttaagtttcagctttgcaaccatactccccccggtgtgttagttgtgttagttgtgttagttgtgttagtcgactcggaccgatg

SEQ ID NO: 15859 - DNA, 203 bp, Homo sapiens
  source 1..203: mol_type = other DNA
ggcgcgccagtcctcgtccgctaggttgtgttagttgtgttagttgtgttagttgtgttagttgtgttagttgtgttaccaactaagaacggccatgcaccaccacccacggaatcgagaaagagctatcaatctgtcaatcctgtccgtgttgtgttagttgtgttagttgtgttagttgtgttagtcgactcggaccgatg

SEQ ID NO: 15860 - DNA, 203 bp, Homo sapiens
  source 1..203: mol_type = other DNA
ggcgcgccagtcctggtccgtggcgttgtgttagttgtgttagttgtgttagttgtgttagttgtgttagttgtgttacgcaggctccactcctggtggtgcccttccgtcaattcctttaagtttcagctttgcaaccatactccccccgttgtgttagttgtgttagttgtgttagttgtgttagtcgactcggaccgatg

SEQ ID NO: 15861 - DNA, 203 bp, Homo sapiens
  source 1..203: mol_type = other DNA
ggcgcgccagtcctgtggtccgccgttgtgttagttgtgttagttgtgttagttgtgttagttgtgttagttgtgttactccgactttcgttcttgattaatgaaaacattcttggcaaatgctttcgctctggtccgtcttgcgccggtgttgtgttagttgtgttagttgtgttagttgtgttagtcgactcggaccgatg

SEQ ID NO: 15862 - DNA, 203 bp, Homo sapiens
  source 1..203: mol_type = other DNA
ggcgcgccagtcctacagcgtccggttgtgttagttgtgttagttgtgttagttgtgttagttgtgttagttgtgttactgatttaatgagccattcgcagtttcactgtaccggccgtgcgtactcagacatgcatggcttaatctttggttgtgttagttgtgttagttgtgttagttgtgttagtcgactcggaccgatg

SEQ ID NO: 15863 - DNA, 203 bp, Homo sapiens
  source 1..203: mol_type = other DNA
ggcgcgccagtcctagtccgaaaggttgtgttagttgtgttagttgtgttagttgtgttagttgtgttagttgtgttagaacccaaagactttggtttcccggaagctgcccggcgggtcatgggaataacgccgccgcatcgccggtcagttgtgttagttgtgttagttgtgttagttgtgttagtcgactcggaccgatg

SEQ ID NO: 15864 - DNA, 203 bp, Homo sapiens
  source 1..203: mol_type = other DNA
ggcgcgccagtcctgcgtccgttggttgtgttagttgtgttagttgtgttagttgtgttagttgtgttagttgtgttaggcaggctccactcctggtggtgcccttccgtcaattcctttaagtttcagctttgcaaccatactcccccagttgtgttagttgtgttagttgtgttagttgtgttagtcgactcggaccgatg

SEQ ID NO: 15865 - DNA, 203 bp, Homo sapiens
  source 1..203: mol_type = other DNA
ggcgcgccagtccttgtccgagctgttgtgttagttgtgttagttgtgttagttgtgttagttgtgttagttgtgttaggtcaattcctttaagtttcagctttgcaaccatactccccccggaacccaaagactttggtttcccggaaagttgtgttagttgtgttagttgtgttagttgtgttagtcgactcggaccgatg

SEQ ID NO: 15866 - DNA, 203 bp, Homo sapiens
  source 1..203: mol_type = other DNA
ggcgcgccagtcctttgtccgatagttgtgttagttgtgttagttgtgttagttgtgttagttgtgttagttgtgttagtaactaagaacggccatgcaccaccacccacggaatcgagaaagagctatcaatctgtcaatcctgtcctagttgtgttagttgtgttagttgtgttagttgtgttagtcgactcggaccgatg

SEQ ID NO: 15867 - DNA, 203 bp, Homo sapiens
  source 1..203: mol_type = other DNA
ggcgcgccagtcctgtccgggacggttgtgttagttgtgttagttgtgttagttgtgttagttgtgttagttgtgttagtacccaaagactttggtttcccggaagctgcccggcgggtcatgggaataacgccgccgcatcgccggttagttgtgttagttgtgttagttgtgttagttgtgttagtcgactcggaccgatg

SEQ ID NO: 15868 - DNA, 203 bp, Homo sapiens
  source 1..203: mol_type = other DNA
ggcgcgccagtcctacagtccgctgttgtgttagttgtgttagttgtgttagttgtgttagttgtgttagttgtgttagtcaggctccactcctggtggtgcccttccgtcaattcctttaagtttcagctttgcaaccatactcccctagttgtgttagttgtgttagttgtgttagttgtgttagtcgactcggaccgatg

SEQ ID NO: 15869 - DNA, 203 bp, Homo sapiens
  source 1..203: mol_type = other DNA
ggcgcgccagtcctccgtccgggagttgtgttagttgtgttagttgtgttagttgtgttagttgtgttagttgtgttagtccgactttcgttcttgattaatgaaaacattcttggcaaatgctttcgctctggtccgtcttgcgccggagttgtgttagttgtgttagttgtgttagttgtgttagtcgactcggaccgatg

SEQ ID NO: 15870 - DNA, 203 bp, Homo sapiens
  source 1..203: mol_type = other DNA
ggcgcgccagtcctcaattgtccggttgtgttagttgtgttagttgtgttagttgtgttagttgtgttagttgtgttagtgatttaatgagccattcgcagtttcactgtaccggccgtgcgtactcagacatgcatggcttaatctttagttgtgttagttgtgttagttgtgttagttgtgttagtcgactcggaccgatg

SEQ ID NO: 15871 - DNA, 203 bp, Homo sapiens
  source 1..203: mol_type = other DNA
ggcgcgccagtcctgcagtccgtggttgtgttagttgtgttagttgtgttagttgtgttagttgtgttagttgtgttagttactaagaacggccatgcaccaccacccacggaatcgagaaagagctatcaatctgtcaatcctgtcttagttgtgttagttgtgttagttgtgttagttgtgttagtcgactcggaccgatg

SEQ ID NO: 15872 - DNA, 203 bp, Homo sapiens
  source 1..203: mol_type = other DNA
ggcgcgccagtcctgagagtccgtgttgtgttagttgtgttagttgtgttagttgtgttagttgtgttagttgtgttagttaggctccactcctggtggtgcccttccgtcaattcctttaagtttcagctttgcaaccatactcccttagttgtgttagttgtgttagttgtgttagttgtgttagtcgactcggaccgatg

SEQ ID NO: 15873 - DNA, 203 bp, Homo sapiens
  source 1..203: mol_type = other DNA
ggcgcgccagtcctgacgtccgcagttgtgttagttgtgttagttgtgttagttgtgttagttgtgttagttgtgttagttcaattcctttaagtttcagctttgcaaccatactccccccggaacccaaagactttggtttcccggttagttgtgttagttgtgttagttgtgttagttgtgttagtcgactcggaccgatg

SEQ ID NO: 15874 - DNA, 203 bp, Homo sapiens
  source 1..203: mol_type = other DNA
ggcgcgccagtcctgtgttgtccggttgtgttagttgtgttagttgtgttagttgtgttagttgtgttagttgtgttagttgggctccactcctggtggtgcccttccgtcaattcctttaagtttcagctttgcaaccatactccgttagttgtgttagttgtgttagttgtgttagttgtgttagtcgactcggaccgatg

SEQ ID NO: 15875 - DNA, 203 bp, Homo sapiens
  source 1..203: mol_type = other DNA
ggcgcgccagtcctgtccgaggctgttgtgttagttgtgttagttgtgttagttgtgttagttgtgttagttgtgttagttgtattcctttaagtttcagctttgcaaccatactccccccggaacccaaagactttggtttccctgttagttgtgttagttgtgttagttgtgttagttgtgttagtcgactcggaccgatg

SEQ ID NO: 15876 - DNA, 203 bp, Homo sapiens
  source 1..203: mol_type = other DNA
ggcgcgccagtccttacggacccggttgtgttagttgtgttagttgtgttagttgtgttagttgtgttagttgtgttagttgtgaagaacggccatgcaccaccacccacggaatcgagaaagagctatcaatctgtcaatcctgtgttagttgtgttagttgtgttagttgtgttagttgtgttagtcgactcggaccgatg

SEQ ID NO: 15877 - DNA, 203 bp, Homo sapiens
  source 1..203: mol_type = other DNA
ggcgcgccagtcctacggacaggggttgtgttagttgtgttagttgtgttagttgtgttagttgtgttagttgtgttagttgtgctccactcctggtggtgcccttccgtcaattcctttaagtttcagctttgcaaccatactctgttagttgtgttagttgtgttagttgtgttagttgtgttagtcgactcggaccgatg

SEQ ID NO: 15878 - DNA, 203 bp, Homo sapiens
  source 1..203: mol_type = other DNA
ggcgcgccagtcctagctacggacgttgtgttagttgtgttagttgtgttagttgtgttagttgtgttagttgtgttagttgtgctccactcctggtggtgcccttccgtcaattcctttaagtttcagctttgcaaccatactgtgttagttgtgttagttgtgttagttgtgttagttgtgttagtcgactcggaccgatg

SEQ ID NO: 15879 - DNA, 203 bp, Homo sapiens
  source 1..203: mol_type = other DNA
ggcgcgccagtcctcggactaaccgttgtgttagttgtgttagttgtgttagttgtgttagttgtgttagttgtgttagttgtgctttcgttcttgattaatgaaaacattcttggcaaatgctttcgctctggtccgtcttgcgtgttagttgtgttagttgtgttagttgtgttagttgtgttagtcgactcggaccgatg

SEQ ID NO: 15880 - DNA, 203 bp, Homo sapiens
  source 1..203: mol_type = other DNA
ggcgcgccagtcctacggaccacggttgtgttagttgtgttagttgtgttagttgtgttagttgtgttagttgtgttagttgtgtaagactttggtttcccggaagctgcccggcgggtcatgggaataacgccgccgcatcgtgtgttagttgtgttagttgtgttagttgtgttagttgtgttagtcgactcggaccgatg

SEQ ID NO: 15881 - DNA, 203 bp, Homo sapiens
  source 1..203: mol_type = other DNA
ggcgcgccagtccttgcggacgctgttgtgttagttgtgttagttgtgttagttgtgttagttgtgttagttgtgttagttgtgtaatgagccattcgcagtttcactgtaccggccgtgcgtactcagacatgcatggcttatgtgttagttgtgttagttgtgttagttgtgttagttgtgttagtcgactcggaccgatg

SEQ ID NO: 15882 - DNA, 203 bp, Homo sapiens
  source 1..203: mol_type = other DNA
ggcgcgccagtccttgttcggacagttgtgttagttgtgttagttgtgttagttgtgttagttgtgttagttgtgttagttgtgtagaacggccatgcaccaccacccacggaatcgagaaagagctatcaatctgtcaatcctgtgttagttgtgttagttgtgttagttgtgttagttgtgttagtcgactcggaccgatg

SEQ ID NO: 15883 - DNA, 203 bp, Homo sapiens
  source 1..203: mol_type = other DNA
ggcgcgccagtccttagcggacgtgttgtgttagttgtgttagttgtgttagttgtgttagttgtgttagttgtgttagttgtgttaaacggccatgcaccaccacccacggaatcgagaaagagctatcaatctgtcaatgttgtgttagttgtgttagttgtgttagttgtgttagttgtgttagtcgactcggaccgatg

SEQ ID NO: 15884 - DNA, 203 bp, Homo sapiens
  source 1..203: mol_type = other DNA
ggcgcgccagtcctaaccggaccagttgtgttagttgtgttagttgtgttagttgtgttagttgtgttagttgtgttagttgtgttacactcctggtggtgcccttccgtcaattcctttaagtttcagctttgcaaccatgttgtgttagttgtgttagttgtgttagttgtgttagttgtgttagtcgactcggaccgatg

SEQ ID NO: 15885 - DNA, 203 bp, Homo sapiens
  source 1..203: mol_type = other DNA
ggcgcgccagtcctcggacgagttgttgtgttagttgtgttagttgtgttagttgtgttagttgtgttagttgtgttagttgtgttacccgccggagttgtgttacccgccggagttgtgttacccgccggagttgtgttacccgccggagttgtgttacccgccggagttgtgttagttgtgttagtcgactcggaccgatg

SEQ ID NO: 15886 - DNA, 203 bp, Homo sapiens
  source 1..203: mol_type = other DNA
ggcgcgccagtcctctatcggacggttgtgttagttgtgttagttgtgttagttgtgttagttgtgttagttgtgttagttgtgttagtcggccatgcaccaccacccacggaatcgagaaagagctatcaatctgtcatagttgtgttagttgtgttagttgtgttagttgtgttagttgtgttagtcgactcggaccgatg

SEQ ID NO: 15887 - DNA, 203 bp, Homo sapiens
  source 1..203: mol_type = other DNA
ggcgcgccagtcctacggacgttagttgtgttagttgtgttagttgtgttagttgtgttagttgtgttagttgtgttagttgtgttagttgaagtttcagctttgcaaccatactccccccggaacccaaagactttgttagttgtgttagttgtgttagttgtgttagttgtgttagttgtgttagtcgactcggaccgatg

SEQ ID NO: 15888 - DNA, 203 bp, Homo sapiens
  source 1..203: mol_type = other DNA
ggcgcgccagtcctcaccggacttgttgtgttagttgtgttagttgtgttagttgtgttagttgtgttagttgtgttagttgtgttagttgcctggtggtgcccttccgtcaattcctttaagtttcagctttgcaagttagttgtgttagttgtgttagttgtgttagttgtgttagttgtgttagtcgactcggaccgatg

SEQ ID NO: 15889 - DNA, 203 bp, Homo sapiens
  source 1..203: mol_type = other DNA
ggcgcgccagtcctgcggcggactgttgtgttagttgtgttagttgtgttagttgtgttagttgtgttagttgtgttagttgtgttagttggccatgcaccaccacccacggaatcgagaaagagctatcaatctgtcttagttgtgttagttgtgttagttgtgttagttgtgttagttgtgttagtcgactcggaccgatg

SEQ ID NO: 15890 - DNA, 203 bp, Homo sapiens
  source 1..203: mol_type = other DNA
ggcgcgccagtcctcgtcacggacgttgtgttagttgtgttagttgtgttagttgtgttagttgtgttagttgtgttagttgtgttagttgtagtttcagctttgcaaccatactccccccggaacccaaagactttgttagttgtgttagttgtgttagttgtgttagttgtgttagttgtgttagtcgactcggaccgatg

SEQ ID NO: 15891 - DNA, 203 bp, Homo sapiens
  source 1..203: mol_type = other DNA
ggcgcgccagtcctcaacggacgagttgtgttagttgtgttagttgtgttagttgtgttagttgtgttagttgtgttagttgtgttagttgtcattcgcagtttcactgtaccggccgtgcgtactcagacatgcatgttagttgtgttagttgtgttagttgtgttagttgtgttagttgtgttagtcgactcggaccgatg

SEQ ID NO: 15892 - DNA, 203 bp, Homo sapiens
  source 1..203: mol_type = other DNA
ggcgcgccagtcctcaaagcggacgttgtgttagttgtgttagttgtgttagttgtgttagttgtgttagttgtgttagttgtgttagttgtctggtggtgcccttccgtcaattcctttaagtttcagctttgcatgttagttgtgttagttgtgttagttgtgttagttgtgttagttgtgttagtcgactcggaccgatg

SEQ ID NO: 15893 - DNA, 203 bp, Homo sapiens
  source 1..203: mol_type = other DNA
ggcgcgccagtcctaatgcggacggttgtgttagttgtgttagttgtgttagttgtgttagttgtgttagttgtgttagttgtgttagttgtgcatgcaccaccacccacggaatcgagaaagagctatcaatctgtgttagttgtgttagttgtgttagttgtgttagttgtgttagttgtgttagtcgactcggaccgatg

SEQ ID NO: 15894 - DNA, 203 bp, Homo sapiens
  source 1..203: mol_type = other DNA
ggcgcgccagtcctagtacgcacagttgtgttagttgtgttagttgtgttagttgtgttagttgtgttagttgtgttagttgtgttagttgtgtatgcaccaccacccacggaatcgagaaagagctatcaatctgtgttagttgtgttagttgtgttagttgtgttagttgtgttagttgtgttagtcgactcggaccgatg

SEQ ID NO: 15895 - DNA, 203 bp, Homo sapiens
  source 1..203: mol_type = other DNA
ggcgcgccagtcctacgcacagaagttgtgttagttgtgttagttgtgttagttgtgttagttgtgttagttgtgttagttgtgttagttgtgtggtggtgcccttccgtcaattcctttaagtttcagctttgcgtgttagttgtgttagttgtgttagttgtgttagttgtgttagttgtgttagtcgactcggaccgatg

SEQ ID NO: 15896 - DNA, 203 bp, Homo sapiens
  source 1..203: mol_type = other DNA
ggcgcgccagtccttaattagtccgttgtgttagttgtgttagttgtgttagttgtgttagttgtgttagttgtgttagttgtgttagttgtgttaggcagtttcactgtaccggccgtgcgtactcagacagttgtgttagttgtgttagttgtgttagttgtgttagttgtgttagttgtgttagtcgactcggaccgatg

SEQ ID NO: 15897 - DNA, 203 bp, Homo sapiens
  source 1..203: mol_type = other DNA
ggcgcgccagtcctgttaatttctgttgtgttagttgtgttagttgtgttagttgtgttagttgtgttagttgtgttagttgtgttagttgtgttagggtgcccttccgtcaattcctttaagtttcagctagttgtgttagttgtgttagttgtgttagttgtgttagttgtgttagttgtgttagtcgactcggaccgatg

SEQ ID NO: 15898 - DNA, 203 bp, Homo sapiens
  source 1..203: mol_type = other DNA
ggcgcgccagtcctttcgtaattagttgtgttagttgtgttagttgtgttagttgtgttagttgtgttagttgtgttagttgtgttagttgtgttagttccggaagctgcccggcgggtcatgggaatattagttgtgttagttgtgttagttgtgttagttgtgttagttgtgttagttgtgttagtcgactcggaccgatg

SEQ ID NO: 15899 - DNA, 203 bp, Homo sapiens
  source 1..203: mol_type = other DNA
ggcgcgccagtcctgcgttaatttgttgtgttagttgtgttagttgtgttagttgtgttagttgtgttagttgtgttagttgtgttagttgtgttagttgctttgcaaccatactccccccggaacccgttagttgtgttagttgtgttagttgtgttagttgtgttagttgtgttagttgtgttagtcgactcggaccgatg

SEQ ID NO: 15900 - DNA, 203 bp, Homo sapiens
  source 1..203: mol_type = other DNA
ggcgcgccagtcctctctaattttgttgtgttagttgtgttagttgtgttagttgtgttagttgtgttagttgtgttagttgtgttagttgtgttagttgtgccacccacggaatcgagaaagagcgtgttagttgtgttagttgtgttagttgtgttagttgtgttagttgtgttagttgtgttagtcgactcggaccgatg

SEQ ID NO: 15901 - DNA, 203 bp, Homo sapiens
  source 1..203: mol_type = other DNA
ggcgcgccagtccttaatttcacggttgtgttagttgtgttagttgtgttagttgtgttagttgtgttagttgtgttagttgtgttagttgtgttagttgtgccttccgtcaattcctttaagtttgtgttagttgtgttagttgtgttagttgtgttagttgtgttagttgtgttagttgtgttagtcgactcggaccgatg

SEQ ID NO: 15902 - DNA, 203 bp, Homo sapiens
  source 1..203: mol_type = other DNA
ggcgcgccagtcctctcttagatcgttgtgttagttgtgttagttgtgttagttgtgttagttgtgttagttgtgttagttgtgttagttgtgttagttgtgtaaaacattcttggcaaatgctttgtgttagttgtgttagttgtgttagttgtgttagttgtgttagttgtgttagttgtgttagtcgactcggaccgatg

SEQ ID NO: 15903 - DNA, 203 bp, Homo sapiens
  source 1..203: mol_type = other DNA
ggcgcgccagtcctagggcgttaggttgtgttagttgtgttagttgtgttagttgtgttagttgtgttagttgtgttagttgtgttagttgtgttagttgtgttacaaccatactccccccgggttgtgttagttgtgttagttgtgttagttgtgttagttgtgttagttgtgttagttgtgttagtcgactcggaccgatg

SEQ ID NO: 15904 - DNA, 203 bp, Homo sapiens
  source 1..203: mol_type = other DNA
ggcgcgccagtcctagaggcgttagttgtgttagttgtgttagttgtgttagttgtgttagttgtgttagttgtgttagttgtgttagttgtgttagttgtgttacccacggaatcgagaaaggttgtgttagttgtgttagttgtgttagttgtgttagttgtgttagttgtgttagttgtgttagtcgactcggaccgatg

SEQ ID NO: 15905 - DNA, 203 bp, Homo sapiens
  source 1..203: mol_type = other DNA
ggcgcgccagtccttcaggctccagttgtgttagttgtgttagttgtgttagttgtgttagttgtgttagttgtgttagttgtgttagttgtgttagttgtgttaccggccgtagttgtgttaccggccgtagttgtgttaccggccgtagttgtgttaccggccgtagttgtgttagttgtgttagtcgactcggaccgatg

SEQ ID NO: 15906 - DNA, 203 bp, Homo sapiens
  source 1..203: mol_type = other DNA
ggcgcgccagtcctcgctccactcgttgtgttagttgtgttagttgtgttagttgtgttagttgtgttagttgtgttagttgtgttagttgtgttagttgtgttagccgtcaattcctttaaagttgtgttagttgtgttagttgtgttagttgtgttagttgtgttagttgtgttagttgtgttagtcgactcggaccgatg

SEQ ID NO: 15907 - DNA, 203 bp, Homo sapiens
  source 1..203: mol_type = other DNA
ggcgcgccagtcctctccagcgctgttgtgttagttgtgttagttgtgttagttgtgttagttgtgttagttgtgttagttgtgttagttgtgttagttgtgttagctgcccggcgggtcatagttgtgttagttgtgttagttgtgttagttgtgttagttgtgttagttgtgttagttgtgttagtcgactcggaccgatg

SEQ ID NO: 15908 - DNA, 203 bp, Homo sapiens
  source 1..203: mol_type = other DNA
ggcgcgccagtcctgaatgctccagttgtgttagttgtgttagttgtgttagttgtgttagttgtgttagttgtgttagttgtgttagttgtgttagttgtgttagctgtaccggccgtgcgagttgtgttagttgtgttagttgtgttagttgtgttagttgtgttagttgtgttagttgtgttagtcgactcggaccgatg

SEQ ID NO: 15909 - DNA, 203 bp, Homo sapiens
  source 1..203: mol_type = other DNA
ggcgcgccagtcctgtctccacatgttgtgttagttgtgttagttgtgttagttgtgttagttgtgttagttgtgttagttgtgttagttgtgttagttgtgttagttgcccggcgggtgttagttgtgttagttgtgttagttgtgttagttgtgttagttgtgttagttgtgttagttgtgttagtcgactcggaccgatg

SEQ ID NO: 15910 - DNA, 203 bp, Homo sapiens
  source 1..203: mol_type = other DNA
ggcgcgccagtcctgctccaggtcgttgtgttagttgtgttagttgtgttagttgtgttagttgtgttagttgtgttagttgtgttagttgtgttagttgtgttagttgtatactccctgttagttgtgttagttgtgttagttgtgttagttgtgttagttgtgttagttgtgttagttgtgttagtcgactcggaccgatg

SEQ ID NO: 15911 - DNA, 203 bp, Homo sapiens
  source 1..203: mol_type = other DNA
ggcgcgccagtccttctccagctggttgtgttagttgtgttagttgtgttagttgtgttagttgtgttagttgtgttagttgtgttagttgtgttagttgtgttagttgtcaattccttgttagttgtgttagttgtgttagttgtgttagttgtgttagttgtgttagttgtgttagttgtgttagtcgactcggaccgatg

SEQ ID NO: 15912 - DNA, 203 bp, Homo sapiens
  source 1..203: mol_type = other DNA
ggcgcgccagtcctgctcctgtcggttgtgttagttgtgttagttgtgttagttgtgttagttgtgttagttgtgttagttgtgttagttgtgttagttgtgttagttgtccggcgggtgttagttgtgttagttgtgttagttgtgttagttgtgttagttgtgttagttgtgttagttgtgttagtcgactcggaccgatg

SEQ ID NO: 15913 - DNA, 203 bp, Homo sapiens
  source 1..203: mol_type = other DNA
ggcgcgccagtcctgcagctccctgttgtgttagttgtgttagttgtgttagttgtgttagttgtgttagttgtgttagttgtgttagttgtgttagttgtgttagttgtgcggcgggtgttagttgtgttagttgtgttagttgtgttagttgtgttagttgtgttagttgtgttagttgtgttagtcgactcggaccgatg

SEQ ID NO: 15914 - DNA, 203 bp, Homo sapiens
  source 1..203: mol_type = other DNA
ggcgcgccagtcctatctccaccggttgtgttagttgtgttagttgtgttagttgtgttagttgtgttagttgtgttagttgtgttagttgtgttagttgtgttagttgtgcttggcgtgttagttgtgttagttgtgttagttgtgttagttgtgttagttgtgttagttgtgttagttgtgttagtcgactcggaccgatg

SEQ ID NO: 15915 - DNA, 203 bp, Homo sapiens
  source 1..203: mol_type = other DNA
ggcgcgccagtcctagctcctcacgttgtgttagttgtgttagttgtgttagttgtgttagttgtgttagttgtgttagttgtgttagttgtgttagttgtgttagttgtggaatcggtgttagttgtgttagttgtgttagttgtgttagttgtgttagttgtgttagttgtgttagttgtgttagtcgactcggaccgatg

SEQ ID NO: 15916 - DNA, 203 bp, Homo sapiens
  source 1..203: mol_type = other DNA
ggcgcgccagtcctctccataccagttgtgttagttgtgttagttgtgttagttgtgttagttgtgttagttgtgttagttgtgttagttgtgttagttgtgttagttgtgtactctgtgttagttgtgttagttgtgttagttgtgttagttgtgttagttgtgttagttgtgttagttgtgttagtcgactcggaccgatg

SEQ ID NO: 15917 - DNA, 203 bp, Homo sapiens
  source 1..203: mol_type = other DNA
ggcgcgccagtcctctcctaacgggttgtgttagttgtgttagttgtgttagttgtgttagttgtgttagttgtgttagttgtgttagttgtgttagttgtgttagttgtgtattctgtgttagttgtgttagttgtgttagttgtgttagttgtgttagttgtgttagttgtgttagttgtgttagtcgactcggaccgatg

SEQ ID NO: 15918 - DNA, 203 bp, Homo sapiens
  source 1..203: mol_type = other DNA
ggcgcgccagtcctaggtcactccgttgtgttagttgtgttagttgtgttagttgtgttagttgtgttagttgtgttagttgtgttagttgtgttagttgtgttagttgtgtcggctgtgttagttgtgttagttgtgttagttgtgttagttgtgttagttgtgttagttgtgttagttgtgttagtcgactcggaccgatg

SEQ ID NO: 15919 - DNA, 203 bp, Homo sapiens
  source 1..203: mol_type = other DNA
ggcgcgccagtcctagtttgctccgttgtgttagttgtgttagttgtgttagttgtgttagttgtgttagttgtgttagttgtgttagttgtgttagttgtgttagttgtgttagttgtgttaccggccgtagttgtgttaccggccgtagttgtgttaccggccgtagttgtgttaccggccgtagtcgactcggaccgatg

SEQ ID NO: 15920 - DNA, 203 bp, Homo sapiens
  source 1..203: mol_type = other DNA
ggcgcgccagtccttgctccaggagttgtgttagttgtgttagttgtgttagttgtgttagttgtgttagttgtgttagttgtgttagttgtgttagttgtgttagttgtgttagttgtgttacggccggtagttgtgttacggccggtagttgtgttacggccggtagttgtgttagttgtgttagtcgactcggaccgatg

SEQ ID NO: 15921 - DNA, 203 bp, Homo sapiens
  source 1..203: mol_type = other DNA
ggcgcgccagtcctagtgctccaggttgtgttagttgtgttagttgtgttagttgtgttagttgtgttagttgtgttagttgtgttagttgtgttagttgtgttagttgtgttagttgtgttagttgtgttagttgtgttacccgccggagttgtgttacccgccggagttgtgttagttgtgttagtcgactcggaccgatg

SEQ ID NO: 15922 - DNA, 203 bp, Homo sapiens
  source 1..203: mol_type = other DNA
ggcgcgccagtcctgatcgctcctgttgtgttagttgtgttagttgtgttagttgtgttagttgtgttagttgtgttagttgtgttagttgtgttagttgtgttagttgtgttagttgtgttagttgtgttagttgtgttaccggccgtagttgtgttaccggccgtagttgtgttaccggccgtagtcgactcggaccgatg

SEQ ID NO: 15923 - DNA, 203 bp, Homo sapiens
  source 1..203: mol_type = other DNA
ggcgcgccagtcctgggctccattgttgtgttagttgtgttagttgtgttagttgtgttagttgtgttagttgtgttagttgtgttagttgtgttagttgtgttagttgtgttagttgtgttagttgtgttagttgtgttacggccggtagttgtgttacggccggtagttgtgttagttgtgttagtcgactcggaccgatg

SEQ ID NO: 15924 - DNA, 203 bp, Homo sapiens
  source 1..203: mol_type = other DNA
ggcgcgccagtccttctccacgaggttgtgttagttgtgttagttgtgttagttgtgttagttgtgttagttgtgttagttgtgttagttgtgttagttgtgttagttgtgttagttgtgttagttgtgttagttgtgttagttgtgttagttgtgttaccggccgtagttgtgttaccggccgtagtcgactcggaccgatg

SEQ ID NO: 15925 - DNA, 203 bp, Homo sapiens
  source 1..203: mol_type = other DNA
ggcgcgccagtccttctccatacggttgtgttagttgtgttagttgtgttagttgtgttagttgtgttagttgtgttagttgtgttagttgtgttagttgtgttagttgtgttagttgtgttagttgtgttagttgtgttagttgtgttagttgtgttccggcgggtagttgtgttccggcgggtagtcgactcggaccgatg

SEQ ID NO: 15926 - DNA, 203 bp, Homo sapiens
  source 1..203: mol_type = other DNA
ggcgcgccagtcctgggtggctccgttgtgttagttgtgttagttgtgttagttgtgttagttgtgttagttgtgttagttgtgttagttgtgttagttgtgttagttgtgttagttgtgttagttgtgttagttgtgttagttgtgttagttgtgtttactcccttagttgtgttagttgtgttagtcgactcggaccgatg

SEQ ID NO: 15927 - DNA, 203 bp, Homo sapiens
  source 1..203: mol_type = other DNA
ggcgcgccagtcctgctcctagaagttgtgttagttgtgttagttgtgttagttgtgttagttgtgttagttgtgttagttgtgttagttgtgttagttgtgttagttgtgttagttgtgttagttgtgttagttgtgttagttgtgttagttgtgtttactcccttagttgtgtttactcccttagtcgactcggaccgatg

SEQ ID NO: 15928 - DNA, 203 bp, Homo sapiens
  source 1..203: mol_type = other DNA
ggcgcgccagtcctaggttctcccgttgtgttagttgtgttagttgtgttagttgtgttagttgtgttagttgtgttagttgtgttagttgtgttagttgtgttagttgtgttagttgtgttagttgtgttagttgtgttagttgtgttagttgtgttttcttggcaaattgtgttagttgtgttagtcgactcggaccgatg

SEQ ID NO: 15929 - DNA, 203 bp, Homo sapiens
  source 1..203: mol_type = other DNA
ggcgcgccagtcctcaagctcctcgttgtgttagttgtgttagttgtgttagttgtgttagttgtgttagttgtgttagttgtgttagttgtgttagttgtgttagttgtgttagttgtgttagttgtgttagttgtgttcacggaatcgagaatgttcacggaatcgagaatgttagttgtgttagtcgactcggaccgatg

SEQ ID NO: 15930 - DNA, 203 bp, Homo sapiens
  source 1..203: mol_type = other DNA
ggcgcgccagtcctctccaagtatgttgtgttagttgtgttagttgtgttagttgtgttagttgtgttagttgtgttagttgtgttagttgtgttagttgtgttagttgtgttagttgtgttagttgtgttagttgtgttccggcgggtagttgtgttccggcgggtagttgtgttccggcgggtagtcgactcggaccgatg

SEQ ID NO: 15931 - DNA, 203 bp, Homo sapiens
  source 1..203: mol_type = other DNA
ggcgcgccagtcctatctccatgcgttgtgttagttgtgttagttgtgttagttgtgttagttgtgttagttgtgttagttgtgttagttgtgttagttgtgttagttgtgttagttgtgttagttgtgttagttgtgtttaaaggaattgacgtgtttaaaggaattgacgtgttagttgtgttagtcgactcggaccgatg

SEQ ID NO: 15932 - DNA, 203 bp, Homo sapiens
  source 1..203: mol_type = other DNA
ggcgcgccagtccttacgcactccgttgtgttagttgtgttagttgtgttagttgtgttagttgtgttagttgtgttagttgtgttagttgtgttagttgtgttagttgtgttagttgtgttagttgtgttagttgtgtttactcccttagttgtgtttactcccttagttgtgttagttgtgttagtcgactcggaccgatg

SEQ ID NO: 15933 - DNA, 203 bp, Homo sapiens
  source 1..203: mol_type = other DNA
ggcgcgccagtcctatctctccaagttgtgttagttgtgttagttgtgttagttgtgttagttgtgttagttgtgttagttgtgttagttgtgttagttgtgttagttgtgttagttgtgttagttgtgttagttgtgtttactcccttagttgtgtttactcccttagttgtgtttactcccttagtcgactcggaccgatg

SEQ ID NO: 15934 - DNA, 203 bp, Homo sapiens
  source 1..203: mol_type = other DNA
ggcgcgccagtcctcctgctccacgttgtgttagttgtgttagttgtgttagttgtgttagttgtgttagttgtgttagttgtgttagttgtgttagttgtgttagttgtgttagttgtgttagttgtgttagttgtgttttctcgattccgtgtgttttctcgattccgtgtgttagttgtgttagtcgactcggaccgatg

SEQ ID NO: 15935 - DNA, 203 bp, Homo sapiens
  source 1..203: mol_type = other DNA
ggcgcgccagtcctctcctctgacgttgtgttagttgtgttagttgtgttagttgtgttagttgtgttagttgtgttagttgtgttagttgtgttagttgtgttagttgtgttagttgtgttagttgtgttagttgtgttttcttggcaaattgtgttttcttggcaaattgtgttagttgtgttagtcgactcggaccgatg

SEQ ID NO: 15936 - DNA, 203 bp, Homo sapiens
  source 1..203: mol_type = other DNA
ggcgcgccagtcctctcccagtgagttgtgttagttgtgttagttgtgttagttgtgttagttgtgttagttgtgttagttgtgttagttgtgttagttgtgttagttgtgttagttgtgtttaaaggaattgacgtgtttaaaggaattgacgtgtttaaaggaattgacgtgttagttgtgttagtcgactcggaccgatg

SEQ ID NO: 15937 - DNA, 203 bp, Homo sapiens
  source 1..203: mol_type = other DNA
ggcgcgccagtcctctgccactccgttgtgttagttgtgttagttgtgttagttgtgttagttgtgttagttgtgttagttgtgttagttgtgttagttgtgttagttgtgttagttgtgttttcttggcaaattgtgttttcttggcaaattgtgttttcttggcaaattgtgttagttgtgttagtcgactcggaccgatg

SEQ ID NO: 15938 - DNA, 203 bp, Homo sapiens
  source 1..203: mol_type = other DNA
ggcgcgccagtcctcagtggagacgttgtgttagttgtgttagttgtgttagttgtgttagttgtgttagttgtgttagttgtgttagttgtgttagttgtgttcactgtaccggccgtgcgtactgtgttagttgtgttagttgtgttagttgtgttagttgtgttagttgtgttagttgtgttagtcgactcggaccgatg

SEQ ID NO: 15939 - DNA, 203 bp, Homo sapiens
  source 1..203: mol_type = other DNA
ggcgcgccagtcctggagcacgatgttgtgttagttgtgttagttgtgttagttgtgttagttgtgttagttgtgttagttgtgttagttgtgttagttgtgttcactgtaccggccgtgcgtattgtgttagttgtgttagttgtgttagttgtgttagttgtgttagttgtgttagttgtgttagtcgactcggaccgatg

SEQ ID NO: 15940 - DNA, 203 bp, Homo sapiens
  source 1..203: mol_type = other DNA
ggcgcgccagtcctggagtgcgttgttgtgttagttgtgttagttgtgttagttgtgttagttgtgttagttgtgttagttgtgttagttgtgttagttgtgttttccgtcaattcctttaagtttgtgttagttgtgttagttgtgttagttgtgttagttgtgttagttgtgttagttgtgttagtcgactcggaccgatg

SEQ ID NO: 15941 - DNA, 203 bp, Homo sapiens
  source 1..203: mol_type = other DNA
ggcgcgccagtcctgggaggccctgttgtgttagttgtgttagttgtgttagttgtgttagttgtgttagttgtgttagttgtgttagttgtgttagttgtgttttctcgattccgtgtgttttctcgattccgtgtgttttctcgattccgtgtgttttctcgattccgtgtgttagttgtgttagtcgactcggaccgatg

SEQ ID NO: 15942 - DNA, 203 bp, Homo sapiens
  source 1..203: mol_type = other DNA
ggcgcgccagtcctgaggagctttgttgtgttagttgtgttagttgtgttagttgtgttagttgtgttagttgtgttagttgtgttagttgtgttagttgtgttttcttggcaaattgtgttttcttggcaaattgtgttttcttggcaaattgtgttttcttggcaaattgtgttagttgtgttagtcgactcggaccgatg

SEQ ID NO: 15943 - DNA, 203 bp, Homo sapiens
  source 1..203: mol_type = other DNA
ggcgcgccagtcctcatacgggaggttgtgttagttgtgttagttgtgttagttgtgttagttgtgttagttgtgttagttgtgttagttgtgttagttgttttgcaaccatactccccccggaacctgttagttgtgttagttgtgttagttgtgttagttgtgttagttgtgttagttgtgttagtcgactcggaccgatg

SEQ ID NO: 15944 - DNA, 203 bp, Homo sapiens
  source 1..203: mol_type = other DNA
ggcgcgccagtcctaacgggaggggttgtgttagttgtgttagttgtgttagttgtgttagttgtgttagttgtgttagttgtgttagttgtgttattcccggaagctgcccggcgggtcatgggaataacggttgtgttagttgtgttagttgtgttagttgtgttagttgtgttagttgtgttagtcgactcggaccgatg

SEQ ID NO: 15945 - DNA, 203 bp, Homo sapiens
  source 1..203: mol_type = other DNA
ggcgcgccagtcctactgggagccgttgtgttagttgtgttagttgtgttagttgtgttagttgtgttagttgtgttagttgtgttagttgtgttgattaatgaaaacattcttggcaaatgctttcgctctgttgtgttagttgtgttagttgtgttagttgtgttagttgtgttagttgtgttagtcgactcggaccgatg

SEQ ID NO: 15946 - DNA, 203 bp, Homo sapiens
  source 1..203: mol_type = other DNA
ggcgcgccagtcctgggagactgtgttgtgttagttgtgttagttgtgttagttgtgttagttgtgttagttgtgttagttgtgttagttgtgtttcgcagtttcactgtaccggccgtgcgtactcagacatgtgtgttagttgtgttagttgtgttagttgtgttagttgtgttagttgtgttagtcgactcggaccgatg

SEQ ID NO: 15947 - DNA, 203 bp, Homo sapiens
  source 1..203: mol_type = other DNA
ggcgcgccagtcctggagctaatggttgtgttagttgtgttagttgtgttagttgtgttagttgtgttagttgtgttagttgtgttagttgtgtttcgcagtttcactgtaccggccgtgcgtactcagacatttgtgttagttgtgttagttgtgttagttgtgttagttgtgttagttgtgttagtcgactcggaccgatg

SEQ ID NO: 15948 - DNA, 203 bp, Homo sapiens
  source 1..203: mol_type = other DNA
ggcgcgccagtcctaggagagggcgttgtgttagttgtgttagttgtgttagttgtgttagttgtgttagttgtgttagttgtgttagttgtgtttgcaccaccacccacggaatcgagaaagagctatcaatttgtgttagttgtgttagttgtgttagttgtgttagttgtgttagttgtgttagtcgactcggaccgatg

SEQ ID NO: 15949 - DNA, 203 bp, Homo sapiens
  source 1..203: mol_type = other DNA
ggcgcgccagtcctaggtaggagcgttgtgttagttgtgttagttgtgttagttgtgttagttgtgttagttgtgttagttgtgttagttgtgtttttcccggaagctgcccggcgggtcatgggaataacgcttgtgttagttgtgttagttgtgttagttgtgttagttgtgttagttgtgttagtcgactcggaccgatg

SEQ ID NO: 15950 - DNA, 203 bp, Homo sapiens
  source 1..203: mol_type = other DNA
ggcgcgccagtcctggagtcgcacgttgtgttagttgtgttagttgtgttagttgtgttagttgtgttagttgtgttagttgtgttagttgttggtttcccggaagctgcccggcgggtcatgggaataacgccgccgttagttgtgttagttgtgttagttgtgttagttgtgttagttgtgttagtcgactcggaccgatg

SEQ ID NO: 15951 - DNA, 203 bp, Homo sapiens
  source 1..203: mol_type = other DNA
ggcgcgccagtccttgacaggagcgttgtgttagttgtgttagttgtgttagttgtgttagttgtgttagttgtgttagttgtgttagtttaagtttcagctttgcaaccatactccccccggaacccaaagactttgttagttgtgttagttgtgttagttgtgttagttgtgttagttgtgttagtcgactcggaccgatg

SEQ ID NO: 15952 - DNA, 203 bp, Homo sapiens
  source 1..203: mol_type = other DNA
ggcgcgccagtcctccgaggagatgttgtgttagttgtgttagttgtgttagttgtgttagttgtgttagttgtgttagttgtgttagtttcctggtggtgcccttccgtcaattcctttaagtttcagctttgcaacttagttgtgttagttgtgttagttgtgttagttgtgttagttgtgttagtcgactcggaccgatg

SEQ ID NO: 15953 - DNA, 203 bp, Homo sapiens
  source 1..203: mol_type = other DNA
ggcgcgccagtcctggagccgcttgttgtgttagttgtgttagttgtgttagttgtgttagttgtgttagttgtgttagttgtgttatcgttcttgattaatgaaaacattcttggcaaatgctttcgctctggtccgtctgttgtgttagttgtgttagttgtgttagttgtgttagttgtgttagtcgactcggaccgatg

SEQ ID NO: 15954 - DNA, 203 bp, Homo sapiens
  source 1..203: mol_type = other DNA
ggcgcgccagtcctaggagctgcggttgtgttagttgtgttagttgtgttagttgtgttagttgtgttagttgtgttagttgtgttatgagccattcgcagtttcactgtaccggccgtgcgtactcagacatgcatggctgttgtgttagttgtgttagttgtgttagttgtgttagttgtgttagtcgactcggaccgatg

SEQ ID NO: 15955 - DNA, 203 bp, Homo sapiens
  source 1..203: mol_type = other DNA
ggcgcgccagtcctttaggagcgcgttgtgttagttgtgttagttgtgttagttgtgttagttgtgttagttgtgttagttgtgttatgagccattcgcagtttcactgtaccggccgtgcgtactcagacatgcatggcttttgtgttagttgtgttagttgtgttagttgtgttagttgtgttagtcgactcggaccgatg

SEQ ID NO: 15956 - DNA, 203 bp, Homo sapiens
  source 1..203: mol_type = other DNA
ggcgcgccagtcctcaataggagcgttgtgttagttgtgttagttgtgttagttgtgttagttgtgttagttgtgttagttgtgttcacggaatcgagaatgttcacggaatcgagaatgttcacggaatcgagaatgttcacggaatcgagaatgttcacggaatcgagaatgttagttgtgttagtcgactcggaccgatg

SEQ ID NO: 15957 - DNA, 203 bp, Homo sapiens
  source 1..203: mol_type = other DNA
ggcgcgccagtcctgtccaaggaggttgtgttagttgtgttagttgtgttagttgtgttagttgtgttagttgtgttagttgtgttccactcctggtggtgcccttccgtcaattcctttaagtttcagctttgcaaccatattgtgttagttgtgttagttgtgttagttgtgttagttgtgttagtcgactcggaccgatg

SEQ ID NO: 15958 - DNA, 203 bp, Homo sapiens
  source 1..203: mol_type = other DNA
ggcgcgccagtcctgctggagccggttgtgttagttgtgttagttgtgttagttgtgttagttgtgttagttgtgttagttgtgttccggcgggtagttgtgttccggcgggtagttgtgttccggcgggtagttgtgttccggcgggtagttgtgttccggcgggtagttgtgttagttgtgttagtcgactcggaccgatg

SEQ ID NO: 15959 - DNA, 203 bp, Homo sapiens
  source 1..203: mol_type = other DNA
ggcgcgccagtcctgcaggagcatgttgtgttagttgtgttagttgtgttagttgtgttagttgtgttagttgtgttagttgtgttccggcgggtagttgtgttccggcgggtagttgtgttccggcgggtagttgtgttccggcgggtagttgtgttccggcgggtagttgtgttccggcgggtagtcgactcggaccgatg

SEQ ID NO: 15960 - DNA, 203 bp, Homo sapiens
  source 1..203: mol_type = other DNA
ggcgcgccagtcctatggagaggtgttgtgttagttgtgttagttgtgttagttgtgttagttgtgttagttgtgttagttgtgttcctttaagtttcagctttgcaaccatactccccccggaacccaaagactttggtttttgtgttagttgtgttagttgtgttagttgtgttagttgtgttagtcgactcggaccgatg

SEQ ID NO: 15961 - DNA, 203 bp, Homo sapiens
  source 1..203: mol_type = other DNA
ggcgcgccagtcctacgtcaggaggttgtgttagttgtgttagttgtgttagttgtgttagttgtgttagttgtgttagttgtgtttactcccttagttgtgtttactcccttagttgtgtttactcccttagttgtgtttactcccttagttgtgtttactcccttagttgtgttagttgtgttagtcgactcggaccgatg

SEQ ID NO: 15962 - DNA, 203 bp, Homo sapiens
  source 1..203: mol_type = other DNA
ggcgcgccagtcctcatgtggagcgttgtgttagttgtgttagttgtgttagttgtgttagttgtgttagttgtgttagttgtttaatgagccattcgcagtttcactgtaccggccgtgcgtactcagacatgcatggcttaatcgttagttgtgttagttgtgttagttgtgttagttgtgttagtcgactcggaccgatg

SEQ ID NO: 15963 - DNA, 203 bp, Homo sapiens
  source 1..203: mol_type = other DNA
ggcgcgccagtccttctggtggaggttgtgttagttgtgttagttgtgttagttgtgttagttgtgttagttgtgttccgtcaattcctttaagtttcagctttgcaaccatactccccccggaacccaaagactttggtttcccggaagctggtgttagttgtgttagttgtgttagttgtgttagtcgactcggaccgatg

SEQ ID NO: 15964 - DNA, 203 bp, Homo sapiens
  source 1..203: mol_type = other DNA
ggcgcgccagtccttagcgcacaagttgtgttagttgtgttagttgtgttagttgtgttagttgtgttagttgttccaccaactaagaacggccatgcaccaccacccacggaatcgagaaagagctatcaatctgtcaatcctgtccgtgtcctgttagttgtgttagttgtgttagttgtgttagtcgactcggaccgatg

SEQ ID NO: 15965 - DNA, 203 bp, Homo sapiens
  source 1..203: mol_type = other DNA
ggcgcgccagtccttgtgcgctacgttgtgttagttgtgttagttgtgttagttgtgttagttgtgttatcttcgaacctccgactttcgttcttgattaatgaaaacattcttggcaaatgctttcgctctggtccgtcttgcgccggtccaagaattgttgtgttagttgtgttagttgtgttagtcgactcggaccgatg

SEQ ID NO: 15966 - DNA, 203 bp, Homo sapiens
  source 1..203: mol_type = other DNA
ggcgcgccagtccttcgtagcgcagttgtgttagttgtgttagttgtgttagttgtgttagttgtgttcaaattaagccgcaggctccactcctggtggtgcccttccgtcaattcctttaagtttcagctttgcaaccatactccccccggaacccaaagtgtgttagttgtgttagttgtgttagtcgactcggaccgatg

SEQ ID NO: 15967 - DNA, 203 bp, Homo sapiens
  source 1..203: mol_type = other DNA
ggcgcgccagtcctcattgtatgcgttgtgttagttgtgttagttgtgttagttgtgttagttgtgttccggcgggtagttgtgttccggcgggtagttgtgttccggcgggtagttgtgttccggcgggtagttgtgttccggcgggtagttgtgttccggcgggtagttgtgttccggcgggtagtcgactcggaccgatg

SEQ ID NO: 15968 - DNA, 203 bp, Homo sapiens
  source 1..203: mol_type = other DNA
ggcgcgccagtcctacattgtattgttgtgttagttgtgttagttgtgttagttgtgttagttgtgttggtgcccttccgtcaattcctttaagtttcagctttgcaaccatactccccccggaacccaaagactttggtttcccggaagctgcccggcggtgtgttagttgtgttagttgtgttagtcgactcggaccgatg

SEQ ID NO: 15969 - DNA, 203 bp, Homo sapiens
  source 1..203: mol_type = other DNA
ggcgcgccagtcctatacaatcatgttgtgttagttgtgttagttgtgttagttgtgttagtttgatcgtcttcgaacctccgactttcgttcttgattaatgaaaacattcttggcaaatgctttcgctctggtccgtcttgcgccggtccaagaatttcacctttagttgtgttagttgtgttagtcgactcggaccgatg

SEQ ID NO: 15970 - DNA, 203 bp, Homo sapiens
  source 1..203: mol_type = other DNA
ggcgcgccagtcctccaggtacaagttgtgttagttgtgttagttgtgttagttgtgtttatctgatcgtcttcgaacctccgactttcgttcttgattaatgaaaacattcttggcaaatgctttcgctctggtccgtcttgcgccggtccaagaatttcacctctagttgtgttagttgtgttagtcgactcggaccgatg

SEQ ID NO: 15971 - DNA, 203 bp, Homo sapiens
  source 1..203: mol_type = other DNA
ggcgcgccagtcctacaggtaagcgttgtgttagttgtgttagttgtgttagttttcccgtgttgagtcaaattaagccgcaggctccactcctggtggtgcccttccgtcaattcctttaagtttcagctttgcaaccatactccccccggaacccaaagactttggtttcccgtagttgtgttagtcgactcggaccgatg

SEQ ID NO: 15972 - DNA, 203 bp, Homo sapiens
  source 1..203: mol_type = other DNA
ggcgcgccagtcctagacaggtaggttgtgttagttgtgttagttgtgttatacgacggtatctgatcgtcttcgaacctccgactttcgttcttgattaatgaaaacattcttggcaaatgctttcgctctggtccgtcttgcgccggtccaagaatttcacctctagcggcgcaagttgtgttagtcgactcggaccgatg

SEQ ID NO: 15973 - DNA, 203 bp, Homo sapiens
  source 1..203: mol_type = other DNA
ggcgcgccagtccttgccttttgggttgtgttagttgtgttagttgtgttcacggaatcgagaatgttcacggaatcgagaatgttcacggaatcgagaatgttcacggaatcgagaatgttcacggaatcgagaatgttcacggaatcgagaatgttcacggaatcgagaatgttagttgtgttagtcgactcggaccgatg

SEQ ID NO: 15974 - DNA, 203 bp, Homo sapiens
  source 1..203: mol_type = other DNA
ggcgcgccagtcctcctcctctgcgttgtgttagttgtgttagttgtgttctacgacggtatctgatcgtcttcgaacctccgactttcgttcttgattaatgaaaacattcttggcaaatgctttcgctctggtccgtcttgcgccggtccaagaatttcacctctagcggcgcaatttgtgttagtcgactcggaccgatg

SEQ ID NO: 15975 - DNA, 203 bp, Homo sapiens
  source 1..203: mol_type = other DNA
ggcgcgccagtcctaaggcagtctgttgtgttagttgtgttagttgtgttgcaggctccactcctggtggtgcccttccgtcaattcctttaagtttcagctttgcaaccatactccccccggaacccaaagactttggtttcccggaagctgcccggcgggtcatgggaataacgccttgtgttagtcgactcggaccgatg

SEQ ID NO: 15976 - DNA, 203 bp, Homo sapiens
  source 1..203: mol_type = other DNA
ggcgcgccagtcctattgtgccacgttgtgttagttgtgttagttgtgtttactcccttagttgtgtttactcccttagttgtgtttactcccttagttgtgtttactcccttagttgtgtttactcccttagttgtgtttactcccttagttgtgtttactcccttagttgtgtttactcccttagtcgactcggaccgatg

SEQ ID NO: 15977 - DNA, 203 bp, Homo sapiens
  source 1..203: mol_type = other DNA
ggcgcgccagtccttatgcctattgttgtgttagttgtgttagttgtgtttttcagctttgcaaccatactccccccggaacccaaagactttggtttcccggaagctgcccggcgggtcatgggaataacgccgccgcatcgccggtcggcatcgtttatggtcggaactacgacggttgtgttagtcgactcggaccgatg

SEQ ID NO: 15978 - DNA, 203 bp, Homo sapiens
  source 1..203: mol_type = other DNA
ggcgcgccagtcctgactaggcaagttgtgttcgtcaattcctttatgttcgtcaattcctttatgttcgtcaattcctttatgttcgtcaattcctttatgttcgtcaattcctttatgttcgtcaattcctttatgttcgtcaattcctttatgttcgtcaattcctttatgttagttgtgttagtcgactcggaccgatg

SEQ ID NO: 15979 - DNA, 203 bp, Homo sapiens
  source 1..203: mol_type = other DNA
ggcgcgccagtcctctcctcctatgttgtgtttactcccttagttgtgtttactcccttagttgtgtttactcccttagttgtgtttactcccttagttgtgtttactcccttagttgtgtttactcccttagttgtgtttactcccttagttgtgtttactcccttagttgtgtttactcccttagtcgactcggaccgatg

SEQ ID NO: 15980 - DNA, 203 bp, Homo sapiens
  source 1..203: mol_type = other DNA
ggcgcgccagtcctttaggcagcctaccggccgtctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 15981 - DNA, 203 bp, Homo sapiens
  source 1..203: mol_type = other DNA
ggcgcgccagtcctcttacctgggtaccggccgtctgacatttctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 15982 - DNA, 203 bp, Homo sapiens
  source 1..203: mol_type = other DNA
ggcgcgccagtcctgaccctcctataccggccgtctgacatttctgacatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 15983 - DNA, 203 bp, Homo sapiens
  source 1..203: mol_type = other DNA
ggcgcgccagtcctcctccatagctaccggccgtctgacatttctgacatttctgacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 15984 - DNA, 203 bp, Homo sapiens
  source 1..203: mol_type = other DNA
ggcgcgccagtcctatgcctatggtcacggaatcgagaaatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 15985 - DNA, 203 bp, Homo sapiens
  source 1..203: mol_type = other DNA
ggcgcgccagtcctctgccttcaatcccactcaaaatccaaaatcactaccagccactatctgctagaccggcgggtcgaataggtccggcgggtcaaaatatgccggcgggtgacattagtccggcgggtatcaatctcccggcgggtttataccgcccggcgggtacatatactccggcgggtaaacgactcggaccgatg

SEQ ID NO: 15986 - DNA, 203 bp, Homo sapiens
  source 1..203: mol_type = other DNA
ggcgcgccagtcctcaggaggtgttcccactcaaaatccaaaatcactaccagccactatctgctagacctagagtgcgaataggtaaataaaaccaaaatatgccggcgggtgacattagtccggcgggtatcaatctcccggcgggtttataccgcccggcgggtacatatactccggcgggtaaacgactcggaccgatg

SEQ ID NO: 15987 - DNA, 203 bp, Homo sapiens
  source 1..203: mol_type = other DNA
ggcgcgccagtcctgcaatacctgtcccactcaaaatccaaaatcactaccagccactatctgctagacctagagtgcgaataggtaaataaaaccaaaatatggggtaaatagacattagtaccggccgtatcaatctcaccggccgtttataccgcaccggccgtacatatactaccggccgtaaacgactcggaccgatg

SEQ ID NO: 15988 - DNA, 203 bp, Homo sapiens
  source 1..203: mol_type = other DNA
ggcgcgccagtcctttgcctacagtcccactcaaaatccaaaatcactaccagccactatctgctagacctagagtgcgaataggtaaataaaaccaaaatatggggtaaatagacattagttagagttcaatcaatctcaacaaccatttataccgcaccggccgtacatatactaccggccgtaaacgactcggaccgatg

SEQ ID NO: 15989 - DNA, 203 bp, Homo sapiens
  source 1..203: mol_type = other DNA
ggcgcgccagtccttcaaggaggctcccactcaaaatccaaaatcactaccagccactatctgctagacctagagtgcgaataggtaaataaaaccaaaatatggggtaaatagacattagttagagttcaatcaatctcaacaaccatttataccgccaattcaatacatatactaccggccgtaaacgactcggaccgatg

SEQ ID NO: 15990 - DNA, 203 bp, Homo sapiens
  source 1..203: mol_type = other DNA
ggcgcgccagtcctgtttacctgttcccactcaaaatccaaaatcactaccagccactatctgctagacctagagtgcgaataggtaaataaaaccaaaatatggggtaaatagacattagttagagttcaatcaatctcaacaaccatttataccgcccggcgggtacatatactccggcgggtaaacgactcggaccgatg

SEQ ID NO: 15991 - DNA, 203 bp, Homo sapiens
  source 1..203: mol_type = other DNA
ggcgcgccagtcctcaaaggcaattcccactcaaaatccaaaatcactaccagccactatctgctagacctagagtgcgaataggtaaataaaaccaaaatatggggtaaatagacattagttagagttcaatcaatctccacggaatcgagaaccgccacggaatcgagaatactataaatcttaaacgactcggaccgatg

SEQ ID NO: 15992 - DNA, 203 bp, Homo sapiens
  source 1..203: mol_type = other DNA
ggcgcgccagtcctagagtacctgtcccactcaaaatccaaaatcactaccagccactatctgctagacctagagtgcgaataggtaaataaaaccaaaatatggggtaaatagacattagttagagttcaatcaatctctactcccatttataccgctactcccatacatatacttactcccttaaacgactcggaccgatg

SEQ ID NO: 15993 - DNA, 203 bp, Homo sapiens
  source 1..203: mol_type = other DNA
ggcgcgccagtcctacgtggaggatcccactcaaaatccaaaatcactaccagccactatctgctagacctagagtgcgaataggtaaataaaaccaaaatatggggtaaatagacattagttagagttcaatcaatctcttcttggcaaaataccgcttcttggcaaaatatactttcttggcaaaacgactcggaccgatg

SEQ ID NO: 15994 - DNA, 203 bp, Homo sapiens
  source 1..203: mol_type = other DNA
ggcgcgccagtccttcaaaaggcatcccactcaaaatccaaaatcactaccagccactatctgctagacctagagtgcgaataggttactcccaccaaaatatgtactccctagacattagttactccccaatcaatctctactcccatttataccgctactcccatacatatacttactcccttaaacgactcggaccgatg

SEQ ID NO: 15995 - DNA, 203 bp, Homo sapiens
  source 1..203: mol_type = other DNA
ggcgcgccagtcctaatcctccattcccactccacggaatcgagaactaccacggaatcgagaatagacacggaatcgagaaaggtcacggaatcgagaatatgcacggaatcgagaatagtcacggaatcgagaatctccacggaatcgagaaccgccacggaatcgagaatactataaatcttaaacgactcggaccgatg

SEQ ID NO: 15996 - DNA, 203 bp, Homo sapiens
  source 1..203: mol_type = other DNA
ggcgcgccagtcctcggtttcatatccggcgggtctgacatttctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 15997 - DNA, 203 bp, Homo sapiens
  source 1..203: mol_type = other DNA
ggcgcgccagtcctgggagttgcctccggcgggtctgacatttctgacatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 15998 - DNA, 203 bp, Homo sapiens
  source 1..203: mol_type = other DNA
ggcgcgccagtcctcacgggagtctccttcctaccggccgtgcctgggccaccggccgttgctgtggaaccggccgtggggccctgaccggccgtctgagcaccaccggccgtagcctgcctaccggccgtacccctagcaccggccgtggggaggcaaccggccgtaggccaggcaccggccgtggtcgactcggaccgatg

SEQ ID NO: 15999 - DNA, 203 bp, Homo sapiens
  source 1..203: mol_type = other DNA
ggcgcgccagtcctcgacgggagttccttcctcacggaatcgagaaggcccacggaatcgagaatggacacggaatcgagaacctgcacggaatcgagaacacccacggaatcgagaagcctcacggaatcgagaatagccacggaatcgagaaggcacacggaatcgagaaaggctacctcgggggtcgactcggaccgatg

SEQ ID NO: 16000 - DNA, 203 bp, Homo sapiens
  source 1..203: mol_type = other DNA
ggcgcgccagtcctactccctgtgtccttcctccggcgggtgcctgggccccggcgggttgctgtggaccggcgggtggggccctgccggcgggtctgagcaccccggcgggtagcctgcctccggcgggtacccctagcccggcgggtggggaggcaccggcgggtaggccaggcccggcgggtggtcgactcggaccgatg

SEQ ID NO: 16001 - DNA, 203 bp, Homo sapiens
  source 1..203: mol_type = other DNA
ggcgcgccagtcctattactcccgtccttcctctgcacctggcctgggccacacccaagtgctgtggacgtcaattcctttacctgcgtcaattcctttacacccgtcaattcctttagcctcgtcaattcctttatagccgtcaattcctttaggcacgtcaattcctttaaggctacctcgggggtcgactcggaccgatg

SEQ ID NO: 16002 - DNA, 203 bp, Homo sapiens
  source 1..203: mol_type = other DNA
ggcgcgccagtcctatcgtttgactccttcctctgcacctggcctgggccacacccaagtgctgtggactggcccgaggggccctgcacgtggccctgagcacccacggaatcgagaagcctcacggaatcgagaatagccacggaatcgagaaggcacacggaatcgagaaaggctacctcgggggtcgactcggaccgatg

SEQ ID NO: 16003 - DNA, 203 bp, Homo sapiens
  source 1..203: mol_type = other DNA
ggcgcgccagtccttgaaacgagttccttcctctgcacctggcctgggccacacccaagtgctgtggactggcccgaggggccctgcacgtggccctgagcacctactcccgtagcctgccttactcccagacccctagctactcccaaggggaggcatactcccgcaggccaggctactcccggggtcgactcggaccgatg

SEQ ID NO: 16004 - DNA, 203 bp, Homo sapiens
  source 1..203: mol_type = other DNA
ggcgcgccagtcctgaaacgactttccttcctctgcacctggcctgggccacacccaagtgctgtggactggcccgaggggccctgcacgtggccctgagcacctctcagcgtagcctgcctagtccctagacccctagcaccggccgtggggaggcaaccggccgtaggccaggcaccggccgtggtcgactcggaccgatg

SEQ ID NO: 16005 - DNA, 203 bp, Homo sapiens
  source 1..203: mol_type = other DNA
ggcgcgccagtcctagtcgtttggtccttcctctgcacctggcctgggccacacccaagtgctgtggactggcccgaggggccctgcacgtggccctgagcacctctcagcgtagcctgcctagtccctagacccctagccagctccaaggggaggcacctccaagcaggccaggctactcccggggtcgactcggaccgatg

SEQ ID NO: 16006 - DNA, 203 bp, Homo sapiens
  source 1..203: mol_type = other DNA
ggcgcgccagtcctcaaacgaggttccttcctctgcacctggcctgggccacacccaagtgctgtggactggcccgaggggccctgcacgtggccctgagcacctctcagcgtagcctgcctagtccctagacccctagccagctccaaggggaggcacgtcaattcctttaaggctacctcgggggtcgactcggaccgatg

SEQ ID NO: 16007 - DNA, 203 bp, Homo sapiens
  source 1..203: mol_type = other DNA
ggcgcgccagtcctgcaaaacgactccttcctctgcacctggcctgggccacacccaagtgctgtggactggcccgaggggccctgcacgtggccctgagcacctctcagcgtagcctgcctagtccctagacccctagccagctccaaggggaggcattcttggcaaagccaggcttcttggcaaatcgactcggaccgatg

SEQ ID NO: 16008 - DNA, 203 bp, Homo sapiens
  source 1..203: mol_type = other DNA
ggcgcgccagtcctcgagtcgttttccttcctctgcacctggcctgggccacacccaagtgctgtggactggcccgaggggccctgcacgtggccctgagcacctctcagcgtagcctgcctagtccctagacccctagccgtcaattcctttaggcacgtcaattcctttaaggctacctcgggggtcgactcggaccgatg

SEQ ID NO: 16009 - DNA, 203 bp, Homo sapiens
  source 1..203: mol_type = other DNA
ggcgcgccagtcctcgaaacgaactccttcctctgcacctggcctgggccacacccaagtgctgtggactggcccgaggggccctgcacgtggccctgagcacctctcagcgtagcctgcctagtccctagacccctagctactcccaaggggaggcatactcccgcaggccaggctactcccggggtcgactcggaccgatg

SEQ ID NO: 16010 - DNA, 203 bp, Homo sapiens
  source 1..203: mol_type = other DNA
ggcgcgccagtccttgcaaacgattccttcctctgcacctggcctgggccacacccaagtgctgtggactggcccgaggggccctgcacgtggccctgagcacctctcagcgtagcctgcctcacggaatcgagaatagccacggaatcgagaaggcacacggaatcgagaaaggctacctcgggggtcgactcggaccgatg

SEQ ID NO: 16011 - DNA, 203 bp, Homo sapiens
  source 1..203: mol_type = other DNA
ggcgcgccagtcctcgctggtcaatccttcctctgcacctggcctgggccacacccaagtgctgtggactggcccgaggggccctgcacgtggccctgagcacctctcagcgtagcctgcctcgtcaattcctttatagccgtcaattcctttaggcacgtcaattcctttaaggctacctcgggggtcgactcggaccgatg

SEQ ID NO: 16012 - DNA, 203 bp, Homo sapiens
  source 1..203: mol_type = other DNA
ggcgcgccagtccttaccagctgctccttcctctgcacctggcctgggccacacccaagtgctgtggactggcccgaggggccctgccggcgggtctgagcaccccggcgggtagcctgcctccggcgggtacccctagcccggcgggtggggaggcaccggcgggtaggccaggcccggcgggtggtcgactcggaccgatg

SEQ ID NO: 16013 - DNA, 203 bp, Homo sapiens
  source 1..203: mol_type = other DNA
ggcgcgccagtcctgtgattaaggtccttcctctgcacctggcctgggccacacccaagtgctgtggattcttggcaaaggccctgttcttggcaaagagcaccttcttggcaaacctgcctttcttggcaaaccctagcttcttggcaaaggaggcattcttggcaaagccaggcttcttggcaaatcgactcggaccgatg

SEQ ID NO: 16014 - DNA, 203 bp, Homo sapiens
  source 1..203: mol_type = other DNA
ggcgcgccagtccttcttaatttgtctcacggaatcgagaattctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16015 - DNA, 203 bp, Homo sapiens
  source 1..203: mol_type = other DNA
ggcgcgccagtcctcttaatgccgtctcacggaatcgagaattctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16016 - DNA, 203 bp, Homo sapiens
  source 1..203: mol_type = other DNA
ggcgcgccagtcctggatctcccatctcgtcaattcctttattctgacatttctgacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16017 - DNA, 203 bp, Homo sapiens
  source 1..203: mol_type = other DNA
ggcgcgccagtccttctagcgccctctgacaccggccgtatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16018 - DNA, 203 bp, Homo sapiens
  source 1..203: mol_type = other DNA
ggcgcgccagtcctgggcgcatgttctgacataccggccgtttctgacataccggccgtttctgacataccggccgtttctgacataccggccgtttctgacataccggccgtttctgacataccggccgtttctgacataccggccgtttctgacataccggccgtttctgacataccggccgtttccgactcggaccgatg

SEQ ID NO: 16019 - DNA, 203 bp, Homo sapiens
  source 1..203: mol_type = other DNA
ggcgcgccagtccttggcgccctctctgacataccggccgtttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16020 - DNA, 203 bp, Homo sapiens
  source 1..203: mol_type = other DNA
ggcgcgccagtcctgcgcccaacctctgacataccggccgtttctgacatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16021 - DNA, 203 bp, Homo sapiens
  source 1..203: mol_type = other DNA
ggcgcgccagtcctgcgccctgtctctgacatcacggaatcgagaaacatcacggaatcgagaaacatcacggaatcgagaaacatcacggaatcgagaaacatcacggaatcgagaaacatcacggaatcgagaaacatcacggaatcgagaaacatttctgacatttctgacatttctgacatttccgactcggaccgatg

SEQ ID NO: 16022 - DNA, 203 bp, Homo sapiens
  source 1..203: mol_type = other DNA
ggcgcgccagtcctgagattgttctctgacatcacggaatcgagaaacatcacggaatcgagaaacatcacggaatcgagaaacatcacggaatcgagaaacatttctgacatttctgacatcacggaatcgagaaacatcacggaatcgagaaacatttctgacatttctgacatttctgacatttccgactcggaccgatg

SEQ ID NO: 16023 - DNA, 203 bp, Homo sapiens
  source 1..203: mol_type = other DNA
ggcgcgccagtcctcgaacaatgctctgacatcacggaatcgagaaacatcacggaatcgagaaacatcacggaatcgagaaacatcacggaatcgagaaacatttctgacatttctgacatcacggaatcgagaaacatttctgacatttctgacatcacggaatcgagaaacatttctgacatttccgactcggaccgatg

SEQ ID NO: 16024 - DNA, 203 bp, Homo sapiens
  source 1..203: mol_type = other DNA
ggcgcgccagtcctactcgccaactctgacatcacggaatcgagaaacatcacggaatcgagaaacatcacggaatcgagaaacatttctgacatttctgacatcacggaatcgagaaacatcacggaatcgagaaacatttctgacatttctgacatttctgacatttctgacatttctgacatttccgactcggaccgatg

SEQ ID NO: 16025 - DNA, 203 bp, Homo sapiens
  source 1..203: mol_type = other DNA
ggcgcgccagtcctacgttggccttctgacatcacggaatcgagaaacatcacggaatcgagaaacatcacggaatcgagaaacatttctgacatttctgacatcacggaatcgagaaacatttctgacatttctgacatttctgacatttctgacatcacggaatcgagaaacatttctgacatttccgactcggaccgatg

SEQ ID NO: 16026 - DNA, 203 bp, Homo sapiens
  source 1..203: mol_type = other DNA
ggcgcgccagtcctttggcgaaagtctgacatcacggaatcgagaaacatcacggaatcgagaaacatcacggaatcgagaaacatttctgacatttctgacatttctgacatttctgacatcacggaatcgagaaacatcacggaatcgagaaacatttctgacatttctgacatttctgacatttccgactcggaccgatg

SEQ ID NO: 16027 - DNA, 203 bp, Homo sapiens
  source 1..203: mol_type = other DNA
ggcgcgccagtccttggccaaccctctgacatcacggaatcgagaaacatcacggaatcgagaaacatcacggaatcgagaaacatttctgacatttctgacatttctgacatttctgacatcacggaatcgagaaacatttctgacatttctgacatcacggaatcgagaaacatttctgacatttccgactcggaccgatg

SEQ ID NO: 16028 - DNA, 203 bp, Homo sapiens
  source 1..203: mol_type = other DNA
ggcgcgccagtcctgttggcgctctctgacatcacggaatcgagaaacatcacggaatcgagaaacatcacggaatcgagaaacatttctgacatttctgacatttctgacatttctgacatcacggaatcgagaaacatttctgacatttctgacatttctgacatttctgacatttctgacatttccgactcggaccgatg

SEQ ID NO: 16029 - DNA, 203 bp, Homo sapiens
  source 1..203: mol_type = other DNA
ggcgcgccagtcctaagccaaatatctgacatcacggaatcgagaaacatcacggaatcgagaaacatcacggaatcgagaaacatttctgacatttctgacatttctgacatttctgacatttctgacatttctgacatttctgacatttctgacatttctgacatttctgacatttctgacatttccgactcggaccgatg

SEQ ID NO: 16030 - DNA, 203 bp, Homo sapiens
  source 1..203: mol_type = other DNA
ggcgcgccagtcctggccaaaccctctgacatcacggaatcgagaaacatcacggaatcgagaaacatttctgacatttctgacatcacggaatcgagaaacatcacggaatcgagaaacatttctgacatttctgacatcacggaatcgagaaacatttctgacatttctgacatttctgacatttccgactcggaccgatg

SEQ ID NO: 16031 - DNA, 203 bp, Homo sapiens
  source 1..203: mol_type = other DNA
ggcgcgccagtcctatttggcgactctgacatcacggaatcgagaaacatcacggaatcgagaaacatttctgacatttctgacatcacggaatcgagaaacatcacggaatcgagaaacatttctgacatttctgacatttctgacatttctgacatttctgacatttctgacatttctgacatttccgactcggaccgatg

SEQ ID NO: 16032 - DNA, 203 bp, Homo sapiens
  source 1..203: mol_type = other DNA
ggcgcgccagtcctcgttggcgcgtctgacatcacggaatcgagaaacatcacggaatcgagaaacatttctgacatttctgacatcacggaatcgagaaacatttctgacatttctgacatcacggaatcgagaaacatcacggaatcgagaaacatttctgacatttctgacatttctgacatttccgactcggaccgatg

SEQ ID NO: 16033 - DNA, 203 bp, Homo sapiens
  source 1..203: mol_type = other DNA
ggcgcgccagtccttcttgccaaatctgacatcacggaatcgagaaacatttctgacatttctgacatcacggaatcgagaaacatcacggaatcgagaaacatcacggaatcgagaaacatcacggaatcgagaaacatcacggaatcgagaaacatttctgacatttctgacatttctgacatttccgactcggaccgatg

SEQ ID NO: 16034 - DNA, 203 bp, Homo sapiens
  source 1..203: mol_type = other DNA
ggcgcgccagtcctttggctgccatctgacatcacggaatcgagaaacatttctgacatttctgacatcacggaatcgagaaacatcacggaatcgagaaacatttctgacatttctgacatcacggaatcgagaaacatcacggaatcgagaaacatcacggaatcgagaaacatttctgacatttccgactcggaccgatg

SEQ ID NO: 16035 - DNA, 203 bp, Homo sapiens
  source 1..203: mol_type = other DNA
ggcgcgccagtccttttggcctgatctgacatcacggaatcgagaaacatttctgacatttctgacatcacggaatcgagaaacatcacggaatcgagaaacatttctgacatttctgacatcacggaatcgagaaacatttctgacatttctgacatcacggaatcgagaaacatttctgacatttccgactcggaccgatg

SEQ ID NO: 16036 - DNA, 203 bp, Homo sapiens
  source 1..203: mol_type = other DNA
ggcgcgccagtcctgccaaacttctctgacatcacggaatcgagaaacatttctgacatttctgacatcacggaatcgagaaacatcacggaatcgagaaacatttctgacatttctgacatcacggaatcgagaaacatttctgacatttctgacatttctgacatttctgacatttctgacatttccgactcggaccgatg

SEQ ID NO: 16037 - DNA, 203 bp, Homo sapiens
  source 1..203: mol_type = other DNA
ggcgcgccagtcctagtgagacactctgacatcacggaatcgagaaacatttctgacatttctgacatcacggaatcgagaaacatttctgacatttctgacatcacggaatcgagaaacatcacggaatcgagaaacatttctgacatttctgacatcacggaatcgagaaacatttctgacatttccgactcggaccgatg

SEQ ID NO: 16038 - DNA, 203 bp, Homo sapiens
  source 1..203: mol_type = other DNA
ggcgcgccagtcctgtctgtgtcttctgacatcacggaatcgagaaacatttctgacatttctgacatcacggaatcgagaaacatttctgacatttctgacatttctgacatttctgacatcacggaatcgagaaacatttctgacatttctgacatcacggaatcgagaaacatttctgacatttccgactcggaccgatg

SEQ ID NO: 16039 - DNA, 203 bp, Homo sapiens
  source 1..203: mol_type = other DNA
ggcgcgccagtcctccgtgtctgatctgacatcacggaatcgagaaacatttctgacatttctgacatttctgacatttctgacatcacggaatcgagaaacatcacggaatcgagaaacatttctgacatttctgacatcacggaatcgagaaacatcacggaatcgagaaacatttctgacatttccgactcggaccgatg

SEQ ID NO: 16040 - DNA, 203 bp, Homo sapiens
  source 1..203: mol_type = other DNA
ggcgcgccagtcctactgtgtctatctgacatcacggaatcgagaaacatttctgacatttctgacatttctgacatttctgacatcacggaatcgagaaacatcacggaatcgagaaacatttctgacatttctgacatttctgacatttctgacatcacggaatcgagaaacatttctgacatttccgactcggaccgatg

SEQ ID NO: 16041 - DNA, 203 bp, Homo sapiens
  source 1..203: mol_type = other DNA
ggcgcgccagtcctagtgtctgtgtctgacatcacggaatcgagaaacatttctgacatttctgacatttctgacatttctgacatcacggaatcgagaaacatcacggaatcgagaaacatttctgacatttctgacatttctgacatttctgacatttctgacatttctgacatttctgacatttccgactcggaccgatg

SEQ ID NO: 16042 - DNA, 203 bp, Homo sapiens
  source 1..203: mol_type = other DNA
ggcgcgccagtcctctcgcgcccatctgacatcacggaatcgagaaacatttctgacatttctgacatttctgacatttctgacatttctgacatttctgacatcacggaatcgagaaacatttctgacatttctgacatttctgacatttctgacatttctgacatttctgacatttctgacatttccgactcggaccgatg

SEQ ID NO: 16043 - DNA, 203 bp, Homo sapiens
  source 1..203: mol_type = other DNA
ggcgcgccagtccttatcgcgggatctgacatcacggaatcgagaaacatttctgacatttctgacatttctgacatttctgacatttctgacatttctgacatttctgacatttctgacatttctgacatttctgacatcacggaatcgagaaacatcacggaatcgagaaacatttctgacatttccgactcggaccgatg

SEQ ID NO: 16044 - DNA, 203 bp, Homo sapiens
  source 1..203: mol_type = other DNA
ggcgcgccagtcctctcgcgggactctgacatcacggaatcgagaaacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16045 - DNA, 203 bp, Homo sapiens
  source 1..203: mol_type = other DNA
ggcgcgccagtcctctgcccgcgttctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16046 - DNA, 203 bp, Homo sapiens
  source 1..203: mol_type = other DNA
ggcgcgccagtcctgcccgcctaatctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16047 - DNA, 203 bp, Homo sapiens
  source 1..203: mol_type = other DNA
ggcgcgccagtcctaggcgggtcctctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16048 - DNA, 203 bp, Homo sapiens
  source 1..203: mol_type = other DNA
ggcgcgccagtcctagttagatcatctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16049 - DNA, 203 bp, Homo sapiens
  source 1..203: mol_type = other DNA
ggcgcgccagtcctgagccgggcttctgacatccggcgggtttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16050 - DNA, 203 bp, Homo sapiens
  source 1..203: mol_type = other DNA
ggcgcgccagtcctcgccggtctctctgacatccggcgggtttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16051 - DNA, 203 bp, Homo sapiens
  source 1..203: mol_type = other DNA
ggcgcgccagtccttacttgccggtctgacatcgtcaattcctttaacatcgtcaattcctttaacatcgtcaattcctttaacatcgtcaattcctttaacatcgtcaattcctttaacatcgtcaattcctttaacatcgtcaattcctttaacatttctgacatttctgacatttctgacatttccgactcggaccgatg

SEQ ID NO: 16052 - DNA, 203 bp, Homo sapiens
  source 1..203: mol_type = other DNA
ggcgcgccagtcctctggtgccggtctgacatcgtcaattcctttaacatcgtcaattcctttaacatcgtcaattcctttaacatcgtcaattcctttaacatcgtcaattcctttaacatcgtcaattcctttaacatttctgacatttctgacatttctgacatttctgacatttctgacatttccgactcggaccgatg

SEQ ID NO: 16053 - DNA, 203 bp, Homo sapiens
  source 1..203: mol_type = other DNA
ggcgcgccagtccttgccggtcgttctgacatcgtcaattcctttaacatcgtcaattcctttaacatcgtcaattcctttaacatcgtcaattcctttaacatcgtcaattcctttaacatttctgacatttctgacatcgtcaattcctttaacatttctgacatttctgacatttctgacatttccgactcggaccgatg

SEQ ID NO: 16054 - DNA, 203 bp, Homo sapiens
  source 1..203: mol_type = other DNA
ggcgcgccagtcctaggcagccggtctgacatcgtcaattcctttaacatcgtcaattcctttaacatcgtcaattcctttaacatcgtcaattcctttaacatttctgacatttctgacatcgtcaattcctttaacatcgtcaattcctttaacatcgtcaattcctttaacatttctgacatttccgactcggaccgatg

SEQ ID NO: 16055 - DNA, 203 bp, Homo sapiens
  source 1..203: mol_type = other DNA
ggcgcgccagtcctgataccggcgtctgacatcgtcaattcctttaacatcgtcaattcctttaacatcgtcaattcctttaacatcgtcaattcctttaacatttctgacatttctgacatcgtcaattcctttaacatttctgacatttctgacatcgtcaattcctttaacatttctgacatttccgactcggaccgatg

SEQ ID NO: 16056 - DNA, 203 bp, Homo sapiens
  source 1..203: mol_type = other DNA
ggcgcgccagtcctccggctaatctctgacatcgtcaattcctttaacatcgtcaattcctttaacatcgtcaattcctttaacatcgtcaattcctttaacatttctgacatttctgacatcgtcaattcctttaacatttctgacatttctgacatttctgacatttctgacatttctgacatttccgactcggaccgatg

SEQ ID NO: 16057 - DNA, 203 bp, Homo sapiens
  source 1..203: mol_type = other DNA
ggcgcgccagtccttcgccggcattctgacatcgtcaattcctttaacatcgtcaattcctttaacatcgtcaattcctttaacatcgtcaattcctttaacatttctgacatttctgacatttctgacatttctgacatcgtcaattcctttaacatcgtcaattcctttaacatttctgacatttccgactcggaccgatg

SEQ ID NO: 16058 - DNA, 203 bp, Homo sapiens
  source 1..203: mol_type = other DNA
ggcgcgccagtcctacgtaccggctctgacatcgtcaattcctttaacatcgtcaattcctttaacatcgtcaattcctttaacatcgtcaattcctttaacatttctgacatttctgacatttctgacatttctgacatttctgacatttctgacatcgtcaattcctttaacatttctgacatttccgactcggaccgatg

SEQ ID NO: 16059 - DNA, 203 bp, Homo sapiens
  source 1..203: mol_type = other DNA
ggcgcgccagtcctaccgtccggctctgacatcgtcaattcctttaacatcgtcaattcctttaacatcgtcaattcctttaacatttctgacatttctgacatcgtcaattcctttaacatcgtcaattcctttaacatcgtcaattcctttaacatttctgacatttctgacatttctgacatttccgactcggaccgatg

SEQ ID NO: 16060 - DNA, 203 bp, Homo sapiens
  source 1..203: mol_type = other DNA
ggcgcgccagtcctaacaaccggctctgacatcgtcaattcctttaacatcgtcaattcctttaacatcgtcaattcctttaacatttctgacatttctgacatcgtcaattcctttaacatcgtcaattcctttaacatttctgacatttctgacatcgtcaattcctttaacatttctgacatttccgactcggaccgatg

SEQ ID NO: 16061 - DNA, 203 bp, Homo sapiens
  source 1..203: mol_type = other DNA
ggcgcgccagtcctcgccggcacttctgacatcgtcaattcctttaacatcgtcaattcctttaacatcgtcaattcctttaacatttctgacatttctgacatcgtcaattcctttaacatcgtcaattcctttaacatttctgacatttctgacatttctgacatttctgacatttctgacatttccgactcggaccgatg

SEQ ID NO: 16062 - DNA, 203 bp, Homo sapiens
  source 1..203: mol_type = other DNA
ggcgcgccagtcctgaagccggcttctgacatcgtcaattcctttaacatcgtcaattcctttaacatcgtcaattcctttaacatttctgacatttctgacatcgtcaattcctttaacatttctgacatttctgacatttctgacatttctgacatttctgacatttctgacatttctgacatttccgactcggaccgatg

SEQ ID NO: 16063 - DNA, 203 bp, Homo sapiens
  source 1..203: mol_type = other DNA
ggcgcgccagtcctttcgagcgggtctgacatcgtcaattcctttaacatcgtcaattcctttaacatcgtcaattcctttaacatttctgacatttctgacatttctgacatttctgacatttctgacatttctgacatcgtcaattcctttaacatttctgacatttctgacatttctgacatttccgactcggaccgatg

SEQ ID NO: 16064 - DNA, 203 bp, Homo sapiens
  source 1..203: mol_type = other DNA
ggcgcgccagtcctatcgagctgttctgacatcgtcaattcctttaacatcgtcaattcctttaacatttctgacatttctgacatcgtcaattcctttaacatcgtcaattcctttaacatttctgacatttctgacatcgtcaattcctttaacatcgtcaattcctttaacatttctgacatttccgactcggaccgatg

SEQ ID NO: 16065 - DNA, 203 bp, Homo sapiens
  source 1..203: mol_type = other DNA
ggcgcgccagtcctttcgagcttatctgacatcgtcaattcctttaacatcgtcaattcctttaacatttctgacatttctgacatcgtcaattcctttaacatcgtcaattcctttaacatttctgacatttctgacatcgtcaattcctttaacatttctgacatttctgacatttctgacatttccgactcggaccgatg

SEQ ID NO: 16066 - DNA, 203 bp, Homo sapiens
  source 1..203: mol_type = other DNA
ggcgcgccagtccttatcgagctctctgacatcgtcaattcctttaacatcgtcaattcctttaacatttctgacatttctgacatcgtcaattcctttaacatcgtcaattcctttaacatttctgacatttctgacatttctgacatttctgacatcgtcaattcctttaacatttctgacatttccgactcggaccgatg

SEQ ID NO: 16067 - DNA, 203 bp, Homo sapiens
  source 1..203: mol_type = other DNA
ggcgcgccagtcctaagctcgacgtctgacatcgtcaattcctttaacatcgtcaattcctttaacatttctgacatttctgacatcgtcaattcctttaacatttctgacatttctgacatcgtcaattcctttaacatttctgacatttctgacatttctgacatttctgacatttctgacatttccgactcggaccgatg

SEQ ID NO: 16068 - DNA, 203 bp, Homo sapiens
  source 1..203: mol_type = other DNA
ggcgcgccagtcctggctcgaccatctgacatcgtcaattcctttaacatcgtcaattcctttaacatttctgacatttctgacatcgtcaattcctttaacatttctgacatttctgacatttctgacatttctgacatcgtcaattcctttaacatcgtcaattcctttaacatttctgacatttccgactcggaccgatg

SEQ ID NO: 16069 - DNA, 203 bp, Homo sapiens
  source 1..203: mol_type = other DNA
ggcgcgccagtcctgagacgctgctctgacatcgtcaattcctttaacatcgtcaattcctttaacatttctgacatttctgacatttctgacatttctgacatttctgacatttctgacatcgtcaattcctttaacatttctgacatttctgacatcgtcaattcctttaacatttctgacatttccgactcggaccgatg

SEQ ID NO: 16070 - DNA, 203 bp, Homo sapiens
  source 1..203: mol_type = other DNA
ggcgcgccagtcctatagcgtctatctgacatcgtcaattcctttaacatcgtcaattcctttaacatttctgacatttctgacatttctgacatttctgacatttctgacatttctgacatttctgacatttctgacatcgtcaattcctttaacatttctgacatttctgacatttctgacatttccgactcggaccgatg

SEQ ID NO: 16071 - DNA, 203 bp, Homo sapiens
  source 1..203: mol_type = other DNA
ggcgcgccagtccttgcgtctaagtctgacatcgtcaattcctttaacatcgtcaattcctttaacatttctgacatttctgacatttctgacatttctgacatttctgacatttctgacatttctgacatttctgacatttctgacatttctgacatcgtcaattcctttaacatttctgacatttccgactcggaccgatg

SEQ ID NO: 16072 - DNA, 203 bp, Homo sapiens
  source 1..203: mol_type = other DNA
ggcgcgccagtcctcgggcgtctttctgacatcgtcaattcctttaacatttctgacatttctgacatcgtcaattcctttaacatcgtcaattcctttaacatcgtcaattcctttaacatttctgacatttctgacatcgtcaattcctttaacatttctgacatttctgacatttctgacatttccgactcggaccgatg

SEQ ID NO: 16073 - DNA, 203 bp, Homo sapiens
  source 1..203: mol_type = other DNA
ggcgcgccagtcctgcgtctttaatctgacatcgtcaattcctttaacatttctgacatttctgacatcgtcaattcctttaacatcgtcaattcctttaacatcgtcaattcctttaacatttctgacatttctgacatttctgacatttctgacatttctgacatttctgacatttctgacatttccgactcggaccgatg

SEQ ID NO: 16074 - DNA, 203 bp, Homo sapiens
  source 1..203: mol_type = other DNA
ggcgcgccagtcctacaggcaaaatctgacatcgtcaattcctttaacatttctgacatttctgacatcgtcaattcctttaacatcgtcaattcctttaacatttctgacatttctgacatcgtcaattcctttaacatcgtcaattcctttaacatttctgacatttctgacatttctgacatttccgactcggaccgatg

SEQ ID NO: 16075 - DNA, 203 bp, Homo sapiens
  source 1..203: mol_type = other DNA
ggcgcgccagtcctaccgatcggatctgacatcgtcaattcctttaacatttctgacatttctgacatcgtcaattcctttaacatcgtcaattcctttaacatttctgacatttctgacatttctgacatttctgacatcgtcaattcctttaacatttctgacatttctgacatttctgacatttccgactcggaccgatg

SEQ ID NO: 16076 - DNA, 203 bp, Homo sapiens
  source 1..203: mol_type = other DNA
ggcgcgccagtcctacatgtcggatctgacatcgtcaattcctttaacatttctgacatttctgacatcgtcaattcctttaacatcgtcaattcctttaacatttctgacatttctgacatttctgacatttctgacatttctgacatttctgacatcgtcaattcctttaacatttctgacatttccgactcggaccgatg

SEQ ID NO: 16077 - DNA, 203 bp, Homo sapiens
  source 1..203: mol_type = other DNA
ggcgcgccagtcctcctactcggatctgacatcgtcaattcctttaacatttctgacatttctgacatcgtcaattcctttaacatttctgacatttctgacatcgtcaattcctttaacatcgtcaattcctttaacatcgtcaattcctttaacatcgtcaattcctttaacatttctgacatttccgactcggaccgatg

SEQ ID NO: 16078 - DNA, 203 bp, Homo sapiens
  source 1..203: mol_type = other DNA
ggcgcgccagtcctcgatctcggatctgacatcgtcaattcctttaacatttctgacatttctgacatcgtcaattcctttaacatttctgacatttctgacatcgtcaattcctttaacatcgtcaattcctttaacatttctgacatttctgacatttctgacatttctgacatttctgacatttccgactcggaccgatg

SEQ ID NO: 16079 - DNA, 203 bp, Homo sapiens
  source 1..203: mol_type = other DNA
ggcgcgccagtccttccgaatgcctctgacatcgtcaattcctttaacatttctgacatttctgacatcgtcaattcctttaacatttctgacatttctgacatcgtcaattcctttaacatttctgacatttctgacatcgtcaattcctttaacatttctgacatttctgacatttctgacatttccgactcggaccgatg

SEQ ID NO: 16080 - DNA, 203 bp, Homo sapiens
  source 1..203: mol_type = other DNA
ggcgcgccagtcctgtagctcggatctgacatcgtcaattcctttaacatttctgacatttctgacatcgtcaattcctttaacatttctgacatttctgacatttctgacatttctgacatcgtcaattcctttaacatcgtcaattcctttaacatcgtcaattcctttaacatttctgacatttccgactcggaccgatg

SEQ ID NO: 16081 - DNA, 203 bp, Homo sapiens
  source 1..203: mol_type = other DNA
ggcgcgccagtccttccgacgccctctgacatcgtcaattcctttaacatttctgacatttctgacatcgtcaattcctttaacatttctgacatttctgacatttctgacatttctgacatttctgacatttctgacatcgtcaattcctttaacatcgtcaattcctttaacatttctgacatttccgactcggaccgatg

SEQ ID NO: 16082 - DNA, 203 bp, Homo sapiens
  source 1..203: mol_type = other DNA
ggcgcgccagtcctcgtcgccggatctgacatcgtcaattcctttaacatttctgacatttctgacatcgtcaattcctttaacatttctgacatttctgacatttctgacatttctgacatttctgacatttctgacatttctgacatttctgacatcgtcaattcctttaacatttctgacatttccgactcggaccgatg

SEQ ID NO: 16083 - DNA, 203 bp, Homo sapiens
  source 1..203: mol_type = other DNA
ggcgcgccagtccttccggtctgatctgacatcgtcaattcctttaacatttctgacatttctgacatcgtcaattcctttaacatttctgacatttctgacatttctgacatttctgacatttctgacatttctgacatttctgacatttctgacatttctgacatttctgacatttctgacatttccgactcggaccgatg

SEQ ID NO: 16084 - DNA, 203 bp, Homo sapiens
  source 1..203: mol_type = other DNA
ggcgcgccagtcctaagtgcgccctctgacatcgtcaattcctttaacatttctgacatttctgacatttctgacatttctgacatcgtcaattcctttaacatcgtcaattcctttaacatttctgacatttctgacatttctgacatttctgacatcgtcaattcctttaacatttctgacatttccgactcggaccgatg

SEQ ID NO: 16085 - DNA, 203 bp, Homo sapiens
  source 1..203: mol_type = other DNA
ggcgcgccagtcctcgtagatagttctgacatcgtcaattcctttaacatttctgacatttctgacatttctgacatttctgacatcgtcaattcctttaacatttctgacatttctgacatcgtcaattcctttaacatcgtcaattcctttaacatttctgacatttctgacatttctgacatttccgactcggaccgatg

SEQ ID NO: 16086 - DNA, 203 bp, Homo sapiens
  source 1..203: mol_type = other DNA
ggcgcgccagtccttaacaatctttctgacatcgtcaattcctttaacatttctgacatttctgacatttctgacatttctgacatcgtcaattcctttaacatttctgacatttctgacatcgtcaattcctttaacatttctgacatttctgacatcgtcaattcctttaacatttctgacatttccgactcggaccgatg

SEQ ID NO: 16087 - DNA, 203 bp, Homo sapiens
  source 1..203: mol_type = other DNA
ggcgcgccagtcctctaacaatcgtctgacatcgtcaattcctttaacatttctgacatttctgacatttctgacatttctgacatcgtcaattcctttaacatttctgacatttctgacatttctgacatttctgacatcgtcaattcctttaacatcgtcaattcctttaacatttctgacatttccgactcggaccgatg

SEQ ID NO: 16088 - DNA, 203 bp, Homo sapiens
  source 1..203: mol_type = other DNA
ggcgcgccagtcctccttgtgggttctgacatcgtcaattcctttaacatttctgacatttctgacatttctgacatttctgacatcgtcaattcctttaacatttctgacatttctgacatttctgacatttctgacatttctgacatttctgacatcgtcaattcctttaacatttctgacatttccgactcggaccgatg

SEQ ID NO: 16089 - DNA, 203 bp, Homo sapiens
  source 1..203: mol_type = other DNA
ggcgcgccagtccttaacccacattctgacatcgtcaattcctttaacatttctgacatttctgacatttctgacatttctgacatttctgacatttctgacatcgtcaattcctttaacatcgtcaattcctttaacatcgtcaattcctttaacatttctgacatttctgacatttctgacatttccgactcggaccgatg

SEQ ID NO: 16090 - DNA, 203 bp, Homo sapiens
  source 1..203: mol_type = other DNA
ggcgcgccagtcctttgttgccgttctgacatcgtcaattcctttaacatttctgacatttctgacatttctgacatttctgacatttctgacatttctgacatcgtcaattcctttaacatttctgacatttctgacatcgtcaattcctttaacatcgtcaattcctttaacatttctgacatttccgactcggaccgatg

SEQ ID NO: 16091 - DNA, 203 bp, Homo sapiens
  source 1..203: mol_type = other DNA
ggcgcgccagtccttacggctccctctgacatcgtcaattcctttaacatttctgacatttctgacatttctgacatttctgacatttctgacatttctgacatttctgacatttctgacatcgtcaattcctttaacatcgtcaattcctttaacatcgtcaattcctttaacatttctgacatttccgactcggaccgatg

SEQ ID NO: 16092 - DNA, 203 bp, Homo sapiens
  source 1..203: mol_type = other DNA
ggcgcgccagtcctccgaggccgttctgacatcgtcaattcctttaacatttctgacatttctgacatttctgacatttctgacatttctgacatttctgacatttctgacatttctgacatcgtcaattcctttaacatttctgacatttctgacatcgtcaattcctttaacatttctgacatttccgactcggaccgatg

SEQ ID NO: 16093 - DNA, 203 bp, Homo sapiens
  source 1..203: mol_type = other DNA
ggcgcgccagtcctggccacggcttctgacatcgtcaattcctttaacatttctgacatttctgacatttctgacatttctgacatttctgacatttctgacatttctgacatttctgacatcgtcaattcctttaacatttctgacatttctgacatttctgacatttctgacatttctgacatttccgactcggaccgatg

SEQ ID NO: 16094 - DNA, 203 bp, Homo sapiens
  source 1..203: mol_type = other DNA
ggcgcgccagtcctttggccgtattctgacatcgtcaattcctttaacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16095 - DNA, 203 bp, Homo sapiens
  source 1..203: mol_type = other DNA
ggcgcgccagtccttggacggcagtctgacattactcccatttctgacattactcccatttctgacattactcccatttctgacattactcccatttctgacattactcccatttctgacattactcccatttctgacattactcccatttctgacattactcccatttctgacattactcccatttccgactcggaccgatg

SEQ ID NO: 16096 - DNA, 203 bp, Homo sapiens
  source 1..203: mol_type = other DNA
ggcgcgccagtcctaggtacggcatctgacattactcccatttctgacatttctgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16097 - DNA, 203 bp, Homo sapiens
  source 1..203: mol_type = other DNA
ggcgcgccagtcctatgccgtcgttctgacattactcccatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16098 - DNA, 203 bp, Homo sapiens
  source 1..203: mol_type = other DNA
ggcgcgccagtcctgccgtacacttctgacatttcaccggccgttgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16099 - DNA, 203 bp, Homo sapiens
  source 1..203: mol_type = other DNA
ggcgcgccagtcctctacagccgttctgacatttcacggaatcgagaaatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16100 - DNA, 203 bp, Homo sapiens
  source 1..203: mol_type = other DNA
ggcgcgccagtcctgccgtagatatctgacatttcacggaatcgagaaatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16101 - DNA, 203 bp, Homo sapiens
  source 1..203: mol_type = other DNA
ggcgcgccagtcctaacggcacgatctgacatttcccggcgggttgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16102 - DNA, 203 bp, Homo sapiens
  source 1..203: mol_type = other DNA
ggcgcgccagtcctagagaacggctctgacatttctgacaccggccgtatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16103 - DNA, 203 bp, Homo sapiens
  source 1..203: mol_type = other DNA
ggcgcgccagtccttagaaacggctctgacatttctgacatcacggaatcgagaaacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16104 - DNA, 203 bp, Homo sapiens
  source 1..203: mol_type = other DNA
ggcgcgccagtcctagaggccgtgtctgacatttctgacatcacggaatcgagaaacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16105 - DNA, 203 bp, Homo sapiens
  source 1..203: mol_type = other DNA
ggcgcgccagtcctgccgtgttgttctgacatttctgacatcgtcaattcctttaacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16106 - DNA, 203 bp, Homo sapiens
  source 1..203: mol_type = other DNA
ggcgcgccagtcctggccgtgtcatctgacatttctgacatcgtcaattcctttaacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16107 - DNA, 203 bp, Homo sapiens
  source 1..203: mol_type = other DNA
ggcgcgccagtcctagtgccgttttctgacatttctgacatcgtcaattcctttaacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16108 - DNA, 203 bp, Homo sapiens
  source 1..203: mol_type = other DNA
ggcgcgccagtcctgtaacggcggtctgacatttctgacatcgtcaattcctttaacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16109 - DNA, 203 bp, Homo sapiens
  source 1..203: mol_type = other DNA
ggcgcgccagtcctgattgccgtatctgacatttctgacattactcccatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16110 - DNA, 203 bp, Homo sapiens
  source 1..203: mol_type = other DNA
ggcgcgccagtcctcaaggacggctctgacatttctgacattccggcgggttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16111 - DNA, 203 bp, Homo sapiens
  source 1..203: mol_type = other DNA
ggcgcgccagtcctcgctgacggctctgacatttctgacatttcaccggccgttgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16112 - DNA, 203 bp, Homo sapiens
  source 1..203: mol_type = other DNA
ggcgcgccagtcctcttgccgtactctgacatttctgacatttccacggaatcgagaatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16113 - DNA, 203 bp, Homo sapiens
  source 1..203: mol_type = other DNA
ggcgcgccagtcctctcacacggctctgacatttctgacatttcccggcgggttgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16114 - DNA, 203 bp, Homo sapiens
  source 1..203: mol_type = other DNA
ggcgcgccagtcctcaacggctgttctgacatttctgacatttccgtcaattcctttatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16115 - DNA, 203 bp, Homo sapiens
  source 1..203: mol_type = other DNA
ggcgcgccagtccttcacggcaaatctgacatttctgacatttctcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaattttccgactcggaccgatg

SEQ ID NO: 16116 - DNA, 203 bp, Homo sapiens
  source 1..203: mol_type = other DNA
ggcgcgccagtccttgcacggcgttctgacatttctgacatttctgaaagtttcagctttgcaaccatactccccccggaacccaaagactttggtttcccggaagctgcccggcgggtcatgggaataacgccgccgcatcgccggtcggcatcgtttatggtcggaactacgacggtatacatttccgactcggaccgatg

SEQ ID NO: 16117 - DNA, 203 bp, Homo sapiens
  source 1..203: mol_type = other DNA
ggcgcgccagtcctcctgaacggctctgacatttctgacatttctgacaaccggccgttttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16118 - DNA, 203 bp, Homo sapiens
  source 1..203: mol_type = other DNA
ggcgcgccagtcctctgtgccgtgtctgacatttctgacatttctgacaactacgacggtatctgatcgtcttcgaacctccgactttcgttcttgattaatgaaaacattcttggcaaatgctttcgctctggtccgtcttgcgccggtccaagaatttcacctctagcggcgcaatacgacatttccgactcggaccgatg

SEQ ID NO: 16119 - DNA, 203 bp, Homo sapiens
  source 1..203: mol_type = other DNA
ggcgcgccagtcctcgtggccgtttctgacatttctgacatttctgacaagaggagcgagcgaccaaaggaaccataactgatttaatgagccattcgcagtttcactgtaccggccgtgcgtactcagacatgcatggcttaatctttgagacaagcatatgctactggcaggatcaatgacatttccgactcggaccgatg

SEQ ID NO: 16120 - DNA, 203 bp, Homo sapiens
  source 1..203: mol_type = other DNA
ggcgcgccagtcctgccgtatgtttctgacatttctgacatttctgacaccggcgggttttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16121 - DNA, 203 bp, Homo sapiens
  source 1..203: mol_type = other DNA
ggcgcgccagtcctagacggcgtctctgacatttctgacatttctgacagtttcagctttgcaaccatactccccccggaacccaaagactttggtttcccggaagctgcccggcgggtcatgggaataacgccgccgcatcgccggtcggcatcgtttatggtcggaactacgacggttgacatttccgactcggaccgatg

SEQ ID NO: 16122 - DNA, 203 bp, Homo sapiens
  source 1..203: mol_type = other DNA
ggcgcgccagtcctatacggctggtctgacatttctgacatttctgacataccggccgtttctgacataccggccgtttctgacataccggccgtttctgacataccggccgtttctgacataccggccgtttctgacatttctgacatttctgacatttctgacatttctgacataccggccgtttccgactcggaccgatg

SEQ ID NO: 16123 - DNA, 203 bp, Homo sapiens
  source 1..203: mol_type = other DNA
ggcgcgccagtccttgccgtaggctctgacatttctgacatttctgacataccggccgtttctgacataccggccgtttctgacataccggccgtttctgacataccggccgtttctgacatttctgacatttctgacataccggccgtttctgacataccggccgtttctgacataccggccgtttccgactcggaccgatg

SEQ ID NO: 16124 - DNA, 203 bp, Homo sapiens
  source 1..203: mol_type = other DNA
ggcgcgccagtccttacggctaaatctgacatttctgacatttctgacataccggccgtttctgacataccggccgtttctgacataccggccgtttctgacataccggccgtttctgacatttctgacatttctgacataccggccgtttctgacataccggccgtttctgacatttctgacatttccgactcggaccgatg

SEQ ID NO: 16125 - DNA, 203 bp, Homo sapiens
  source 1..203: mol_type = other DNA
ggcgcgccagtccttaacggcccatctgacatttctgacatttctgacataccggccgtttctgacataccggccgtttctgacataccggccgtttctgacataccggccgtttctgacatttctgacatttctgacatttctgacatttctgacatttctgacatttctgacatttctgacatttccgactcggaccgatg

SEQ ID NO: 16126 - DNA, 203 bp, Homo sapiens
  source 1..203: mol_type = other DNA
ggcgcgccagtcctgcttagccgttctgacatttctgacatttctgacataccggccgtttctgacataccggccgtttctgacataccggccgtttctgacatttctgacatttctgacataccggccgtttctgacataccggccgtttctgacataccggccgtttctgacataccggccgtttccgactcggaccgatg

SEQ ID NO: 16127 - DNA, 203 bp, Homo sapiens
  source 1..203: mol_type = other DNA
ggcgcgccagtcctctacggcatttctgacatttctgacatttctgacataccggccgtttctgacataccggccgtttctgacataccggccgtttctgacatttctgacatttctgacataccggccgtttctgacataccggccgtttctgacataccggccgtttctgacatttctgacatttccgactcggaccgatg

SEQ ID NO: 16128 - DNA, 203 bp, Homo sapiens
  source 1..203: mol_type = other DNA
ggcgcgccagtcctgccgtgaacctctgacatttctgacatttctgacataccggccgtttctgacataccggccgtttctgacataccggccgtttctgacatttctgacatttctgacataccggccgtttctgacatttctgacatttctgacataccggccgtttctgacataccggccgtttccgactcggaccgatg

SEQ ID NO: 16129 - DNA, 203 bp, Homo sapiens
  source 1..203: mol_type = other DNA
ggcgcgccagtcctgcagacggcgtctgacatttctgacatttctgacataccggccgtttctgacataccggccgtttctgacataccggccgtttctgacatttctgacatttctgacataccggccgtttctgacatttctgacatttctgacatttctgacatttctgacatttctgacatttccgactcggaccgatg

SEQ ID NO: 16130 - DNA, 203 bp, Homo sapiens
  source 1..203: mol_type = other DNA
ggcgcgccagtcctcgtgacggcgtctgacatttctgacatttctgacataccggccgtttctgacataccggccgtttctgacataccggccgtttctgacatttctgacatttctgacatttctgacatttctgacataccggccgtttctgacataccggccgtttctgacataccggccgtttccgactcggaccgatg

SEQ ID NO: 16131 - DNA, 203 bp, Homo sapiens
  source 1..203: mol_type = other DNA
ggcgcgccagtcctatatgccgtttctgacatttctgacatttctgacataccggccgtttctgacataccggccgtttctgacataccggccgtttctgacatttctgacatttctgacatttctgacatttctgacataccggccgtttctgacatttctgacatttctgacataccggccgtttccgactcggaccgatg

SEQ ID NO: 16132 - DNA, 203 bp, Homo sapiens
  source 1..203: mol_type = other DNA
ggcgcgccagtcctacggcacacctctgacatttctgacatttctgacataccggccgtttctgacataccggccgtttctgacataccggccgtttctgacatttctgacatttctgacatttctgacatttctgacataccggccgtttctgacatttctgacatttctgacatttctgacatttccgactcggaccgatg

SEQ ID NO: 16133 - DNA, 203 bp, Homo sapiens
  source 1..203: mol_type = other DNA
ggcgcgccagtcctcccttgccgttctgacatttctgacatttctgacataccggccgtttctgacataccggccgtttctgacataccggccgtttctgacatttctgacatttctgacatttctgacatttctgacatttctgacatttctgacatttctgacatttctgacataccggccgtttccgactcggaccgatg

SEQ ID NO: 16134 - DNA, 203 bp, Homo sapiens
  source 1..203: mol_type = other DNA
ggcgcgccagtcctcgccgtgctatctgacatttctgacatttctgacataccggccgtttctgacataccggccgtttctgacatttctgacatttctgacataccggccgtttctgacataccggccgtttctgacataccggccgtttctgacataccggccgtttctgacataccggccgtttccgactcggaccgatg

SEQ ID NO: 16135 - DNA, 203 bp, Homo sapiens
  source 1..203: mol_type = other DNA
ggcgcgccagtcctcaggtgggtctctgacatttctgacatttctgacataccggccgtttctgacataccggccgtttctgacatttctgacatttctgacataccggccgtttctgacataccggccgtttctgacataccggccgtttctgacataccggccgtttctgacatttctgacatttccgactcggaccgatg

SEQ ID NO: 16136 - DNA, 203 bp, Homo sapiens
  source 1..203: mol_type = other DNA
ggcgcgccagtcctatggtgggcctctgacatttctgacatttctgacataccggccgtttctgacataccggccgtttctgacatttctgacatttctgacataccggccgtttctgacataccggccgtttctgacataccggccgtttctgacatttctgacatttctgacatttctgacatttccgactcggaccgatg

SEQ ID NO: 16137 - DNA, 203 bp, Homo sapiens
  source 1..203: mol_type = other DNA
ggcgcgccagtcctcttggtgggctctgacatttctgacatttctgacataccggccgtttctgacataccggccgtttctgacatttctgacatttctgacataccggccgtttctgacataccggccgtttctgacatttctgacatttctgacatttctgacatttctgacataccggccgtttccgactcggaccgatg

SEQ ID NO: 16138 - DNA, 203 bp, Homo sapiens
  source 1..203: mol_type = other DNA
ggcgcgccagtcctgttagggccgtctgacatttctgacatttctgacataccggccgtttctgacataccggccgtttctgacatttctgacatttctgacataccggccgtttctgacatttctgacatttctgacatttctgacatttctgacatttctgacatttctgacataccggccgtttccgactcggaccgatg

SEQ ID NO: 16139 - DNA, 203 bp, Homo sapiens
  source 1..203: mol_type = other DNA
ggcgcgccagtcctttgccctaagtctgacatttctgacatttctgacataccggccgtttctgacataccggccgtttctgacatttctgacatttctgacataccggccgtttctgacatttctgacatttctgacatttctgacatttctgacatttctgacatttctgacatttctgacatttccgactcggaccgatg

SEQ ID NO: 16140 - DNA, 203 bp, Homo sapiens
  source 1..203: mol_type = other DNA
ggcgcgccagtcctgccctaatcatctgacatttctgacatttctgacataccggccgtttctgacataccggccgtttctgacatttctgacatttctgacatttctgacatttctgacataccggccgtttctgacataccggccgtttctgacataccggccgtttctgacatttctgacatttccgactcggaccgatg

SEQ ID NO: 16141 - DNA, 203 bp, Homo sapiens
  source 1..203: mol_type = other DNA
ggcgcgccagtcctttgttagggctctgacatttctgacatttctgacataccggccgtttctgacataccggccgtttctgacatttctgacatttctgacatttctgacatttctgacataccggccgtttctgacataccggccgtttctgacatttctgacatttctgacatttctgacatttccgactcggaccgatg

SEQ ID NO: 16142 - DNA, 203 bp, Homo sapiens
  source 1..203: mol_type = other DNA
ggcgcgccagtcctagtatcccggtctgacatttctgacatttctgacataccggccgtttctgacataccggccgtttctgacatttctgacatttctgacatttctgacatttctgacataccggccgtttctgacatttctgacatttctgacataccggccgtttctgacatttctgacatttccgactcggaccgatg

SEQ ID NO: 16143 - DNA, 203 bp, Homo sapiens
  source 1..203: mol_type = other DNA
ggcgcgccagtcctctttgcccggtctgacatttctgacatttctgacataccggccgtttctgacataccggccgtttctgacatttctgacatttctgacatttctgacatttctgacataccggccgtttctgacatttctgacatttctgacatttctgacatttctgacataccggccgtttccgactcggaccgatg

SEQ ID NO: 16144 - DNA, 203 bp, Homo sapiens
  source 1..203: mol_type = other DNA
ggcgcgccagtcctttgggcccggtctgacatttctgacatttctgacataccggccgtttctgacataccggccgtttctgacatttctgacatttctgacatttctgacatttctgacatttctgacatttctgacataccggccgtttctgacataccggccgtttctgacataccggccgtttccgactcggaccgatg

SEQ ID NO: 16145 - DNA, 203 bp, Homo sapiens
  source 1..203: mol_type = other DNA
ggcgcgccagtcctaagcgcgctgtctgacatttctgacatttctgacataccggccgtttctgacataccggccgtttctgacatttctgacatttctgacatttctgacatttctgacatttctgacatttctgacatttctgacatttctgacataccggccgtttctgacatttctgacatttccgactcggaccgatg

SEQ ID NO: 16146 - DNA, 203 bp, Homo sapiens
  source 1..203: mol_type = other DNA
ggcgcgccagtcctagaggcgcgctctgacatttctgacatttctgacataccggccgtttctgacataccggccgtttctgacatttctgacatttctgacatttctgacatttctgacatttctgacatttctgacatttctgacatttctgacatttctgacatttctgacataccggccgtttccgactcggaccgatg

SEQ ID NO: 16147 - DNA, 203 bp, Homo sapiens
  source 1..203: mol_type = other DNA
ggcgcgccagtcctcaactgactctctgacatttctgacatttctgacataccggccgtttctgacataccggccgtttctgacatttctgacatttctgacatttctgacatttctgacatttctgacatttctgacatttctgacatttctgacatttctgacatttctgacatttctgacatttccgactcggaccgatg

SEQ ID NO: 16148 - DNA, 203 bp, Homo sapiens
  source 1..203: mol_type = other DNA
ggcgcgccagtcctcatgagtcagtctgacatttctgacatttctgacataccggccgtttctgacatttctgacatttctgacataccggccgtttctgacataccggccgtttctgacataccggccgtttctgacataccggccgtttctgacataccggccgtttctgacataccggccgtttccgactcggaccgatg

SEQ ID NO: 16149 - DNA, 203 bp, Homo sapiens
  source 1..203: mol_type = other DNA
ggcgcgccagtcctgagtcatggatctgacatttctgacatttctgacataccggccgtttctgacatttctgacatttctgacataccggccgtttctgacataccggccgtttctgacataccggccgtttctgacataccggccgtttctgacataccggccgtttctgacatttctgacatttccgactcggaccgatg

SEQ ID NO: 16150 - DNA, 203 bp, Homo sapiens
  source 1..203: mol_type = other DNA
ggcgcgccagtcctatctgactcgtctgacatttctgacatttctgacataccggccgtttctgacatttctgacatttctgacataccggccgtttctgacataccggccgtttctgacataccggccgtttctgacataccggccgtttctgacatttctgacatttctgacataccggccgtttccgactcggaccgatg

SEQ ID NO: 16151 - DNA, 203 bp, Homo sapiens
  source 1..203: mol_type = other DNA
ggcgcgccagtccttgactcaagatctgacatttctgacatttctgacataccggccgtttctgacatttctgacatttctgacataccggccgtttctgacataccggccgtttctgacataccggccgtttctgacatttctgacatttctgacataccggccgtttctgacataccggccgtttccgactcggaccgatg

SEQ ID NO: 16152 - DNA, 203 bp, Homo sapiens
  source 1..203: mol_type = other DNA
ggcgcgccagtcctggagtcatattctgacatttctgacatttctgacataccggccgtttctgacatttctgacatttctgacataccggccgtttctgacataccggccgtttctgacataccggccgtttctgacatttctgacatttctgacatttctgacatttctgacataccggccgtttccgactcggaccgatg

SEQ ID NO: 16153 - DNA, 203 bp, Homo sapiens
  source 1..203: mol_type = other DNA
ggcgcgccagtccttgactcactttctgacatttctgacatttctgacataccggccgtttctgacatttctgacatttctgacataccggccgtttctgacataccggccgtttctgacatttctgacatttctgacataccggccgtttctgacataccggccgtttctgacatttctgacatttccgactcggaccgatg

SEQ ID NO: 16154 - DNA, 203 bp, Homo sapiens
  source 1..203: mol_type = other DNA
ggcgcgccagtcctgagtcagcactctgacatttctgacatttctgacataccggccgtttctgacatttctgacatttctgacataccggccgtttctgacataccggccgtttctgacatttctgacatttctgacataccggccgtttctgacatttctgacatttctgacataccggccgtttccgactcggaccgatg

SEQ ID NO: 16155 - DNA, 203 bp, Homo sapiens
  source 1..203: mol_type = other DNA
ggcgcgccagtcctagagtcagtttctgacatttctgacatttctgacataccggccgtttctgacatttctgacatttctgacataccggccgtttctgacataccggccgtttctgacatttctgacatttctgacatttctgacatttctgacataccggccgtttctgacataccggccgtttccgactcggaccgatg

SEQ ID NO: 16156 - DNA, 203 bp, Homo sapiens
  source 1..203: mol_type = other DNA
ggcgcgccagtccttgcgagtcagtctgacatttctgacatttctgacataccggccgtttctgacatttctgacatttctgacataccggccgtttctgacataccggccgtttctgacatttctgacatttctgacatttctgacatttctgacataccggccgtttctgacatttctgacatttccgactcggaccgatg

SEQ ID NO: 16157 - DNA, 203 bp, Homo sapiens
  source 1..203: mol_type = other DNA
ggcgcgccagtcctcgagtcagcgtctgacatttctgacatttctgacataccggccgtttctgacatttctgacatttctgacataccggccgtttctgacataccggccgtttctgacatttctgacatttctgacatttctgacatttctgacatttctgacatttctgacatttctgacatttccgactcggaccgatg

SEQ ID NO: 16158 - DNA, 203 bp, Homo sapiens
  source 1..203: mol_type = other DNA
ggcgcgccagtcctccgagtcatttctgacatttctgacatttctgacataccggccgtttctgacatttctgacatttctgacataccggccgtttctgacatttctgacatttctgacataccggccgtttctgacataccggccgtttctgacataccggccgtttctgacatttctgacatttccgactcggaccgatg

SEQ ID NO: 16159 - DNA, 203 bp, Homo sapiens
  source 1..203: mol_type = other DNA
ggcgcgccagtcctgcgtcgaaggtctgacatttctgacatttctgacataccggccgtttctgacatttctgacatttctgacataccggccgtttctgacatttctgacatttctgacataccggccgtttctgacataccggccgtttctgacatttctgacatttctgacatttctgacatttccgactcggaccgatg

SEQ ID NO: 16160 - DNA, 203 bp, Homo sapiens
  source 1..203: mol_type = other DNA
ggcgcgccagtcctagctcgaagttctgacatttctgacatttctgacataccggccgtttctgacatttctgacatttctgacataccggccgtttctgacatttctgacatttctgacataccggccgtttctgacatttctgacatttctgacataccggccgtttctgacataccggccgtttccgactcggaccgatg

SEQ ID NO: 16161 - DNA, 203 bp, Homo sapiens
  source 1..203: mol_type = other DNA
ggcgcgccagtcctctcgaaggtttctgacatttctgacatttctgacataccggccgtttctgacatttctgacatttctgacataccggccgtttctgacatttctgacatttctgacataccggccgtttctgacatttctgacatttctgacatttctgacatttctgacataccggccgtttccgactcggaccgatg

SEQ ID NO: 16162 - DNA, 203 bp, Homo sapiens
  source 1..203: mol_type = other DNA
ggcgcgccagtcctccagtcgaagtctgacatttctgacatttctgacataccggccgtttctgacatttctgacatttctgacataccggccgtttctgacatttctgacatttctgacataccggccgtttctgacatttctgacatttctgacatttctgacatttctgacatttctgacatttccgactcggaccgatg

SEQ ID NO: 16163 - DNA, 203 bp, Homo sapiens
  source 1..203: mol_type = other DNA
ggcgcgccagtcctcaatcgaaagtctgacatttctgacatttctgacataccggccgtttctgacatttctgacatttctgacatttctgacatttctgacataccggccgtttctgacataccggccgtttctgacatttctgacatttctgacataccggccgtttctgacatttctgacatttccgactcggaccgatg

SEQ ID NO: 16164 - DNA, 203 bp, Homo sapiens
  source 1..203: mol_type = other DNA
ggcgcgccagtcctgtcgaaaatctctgacatttctgacatttctgacataccggccgtttctgacatttctgacatttctgacatttctgacatttctgacataccggccgtttctgacataccggccgtttctgacatttctgacatttctgacatttctgacatttctgacataccggccgtttccgactcggaccgatg

SEQ ID NO: 16165 - DNA, 203 bp, Homo sapiens
  source 1..203: mol_type = other DNA
ggcgcgccagtccttcgaaaagcgtctgacatttctgacatttctgacataccggccgtttctgacatttctgacatttctgacatttctgacatttctgacataccggccgtttctgacataccggccgtttctgacatttctgacatttctgacatttctgacatttctgacatttctgacatttccgactcggaccgatg

SEQ ID NO: 16166 - DNA, 203 bp, Homo sapiens
  source 1..203: mol_type = other DNA
ggcgcgccagtccttatcgaaatgtctgacatttctgacatttctgacataccggccgtttctgacatttctgacatttctgacatttctgacatttctgacataccggccgtttctgacatttctgacatttctgacataccggccgtttctgacataccggccgtttctgacatttctgacatttccgactcggaccgatg

SEQ ID NO: 16167 - DNA, 203 bp, Homo sapiens
  source 1..203: mol_type = other DNA
ggcgcgccagtcctaatttcgatctctgacatttctgacatttctgacataccggccgtttctgacatttctgacatttctgacatttctgacatttctgacataccggccgtttctgacatttctgacatttctgacatttctgacatttctgacataccggccgtttctgacatttctgacatttccgactcggaccgatg

SEQ ID NO: 16168 - DNA, 203 bp, Homo sapiens
  source 1..203: mol_type = other DNA
ggcgcgccagtcctatttcgattttctgacatttctgacatttctgacataccggccgtttctgacatttctgacatttctgacatttctgacatttctgacataccggccgtttctgacatttctgacatttctgacatttctgacatttctgacatttctgacatttctgacatttctgacatttccgactcggaccgatg

SEQ ID NO: 16169 - DNA, 203 bp, Homo sapiens
  source 1..203: mol_type = other DNA
ggcgcgccagtcctgtacattctgtctgacatttctgacatttctgacataccggccgtttctgacatttctgacatttctgacatttctgacatttctgacatttctgacatttctgacataccggccgtttctgacataccggccgtttctgacatttctgacatttctgacataccggccgtttccgactcggaccgatg

SEQ ID NO: 16170 - DNA, 203 bp, Homo sapiens
  source 1..203: mol_type = other DNA
ggcgcgccagtcctgcgccgtcactctgacatttctgacatttctgacataccggccgtttctgacatttctgacatttctgacatttctgacatttctgacatttctgacatttctgacataccggccgtttctgacatttctgacatttctgacataccggccgtttctgacatttctgacatttccgactcggaccgatg

SEQ ID NO: 16171 - DNA, 203 bp, Homo sapiens
  source 1..203: mol_type = other DNA
ggcgcgccagtcctcggcgctctgtctgacatttctgacatttctgacatcacggaatcgagaaacatcacggaatcgagaaacatcacggaatcgagaaacatcacggaatcgagaaacatcacggaatcgagaaacatcacggaatcgagaaacatttctgacatttctgacatttctgacatttccgactcggaccgatg

SEQ ID NO: 16172 - DNA, 203 bp, Homo sapiens
  source 1..203: mol_type = other DNA
ggcgcgccagtcctcagtcgcgagtctgacatttctgacatttctgacatcacggaatcgagaaacatcacggaatcgagaaacatcacggaatcgagaaacatttctgacatttctgacatcacggaatcgagaaacatcacggaatcgagaaacatttctgacatttctgacatttctgacatttccgactcggaccgatg

SEQ ID NO: 16173 - DNA, 203 bp, Homo sapiens
  source 1..203: mol_type = other DNA
ggcgcgccagtccttcgcgacggctctgacatttctgacatttctgacatcacggaatcgagaaacatcacggaatcgagaaacatttctgacatttctgacatcacggaatcgagaaacatttctgacatttctgacatcacggaatcgagaaacatcacggaatcgagaaacatttctgacatttccgactcggaccgatg

SEQ ID NO: 16174 - DNA, 203 bp, Homo sapiens
  source 1..203: mol_type = other DNA
ggcgcgccagtccttcgtgtaatctctgacatttctgacatttctgacatcacggaatcgagaaacatcacggaatcgagaaacatttctgacatttctgacatttctgacatttctgacatttctgacatttctgacatcacggaatcgagaaacatttctgacatttctgacatttctgacatttccgactcggaccgatg

SEQ ID NO: 16175 - DNA, 203 bp, Homo sapiens
  source 1..203: mol_type = other DNA
ggcgcgccagtccttatccgaccatctgacatttctgacatttctgacatcacggaatcgagaaacatcacggaatcgagaaacatttctgacatttctgacatttctgacatttctgacatttctgacatttctgacatttctgacatttctgacatttctgacatttctgacatttctgacatttccgactcggaccgatg

SEQ ID NO: 16176 - DNA, 203 bp, Homo sapiens
  source 1..203: mol_type = other DNA
ggcgcgccagtcctcgcggatacttctgacatttctgacatttctgacatcacggaatcgagaaacatttctgacatttctgacatcacggaatcgagaaacatcacggaatcgagaaacatcacggaatcgagaaacatttctgacatttctgacatcacggaatcgagaaacatttctgacatttccgactcggaccgatg

SEQ ID NO: 16177 - DNA, 203 bp, Homo sapiens
  source 1..203: mol_type = other DNA
ggcgcgccagtccttatcggatactctgacatttctgacatttctgacatcacggaatcgagaaacatttctgacatttctgacatcacggaatcgagaaacatcacggaatcgagaaacatttctgacatttctgacatcacggaatcgagaaacatttctgacatttctgacatttctgacatttccgactcggaccgatg

SEQ ID NO: 16178 - DNA, 203 bp, Homo sapiens
  source 1..203: mol_type = other DNA
ggcgcgccagtcctatccgcaagctctgacatttctgacatttctgacatcacggaatcgagaaacatttctgacatttctgacatcacggaatcgagaaacatcacggaatcgagaaacatttctgacatttctgacatttctgacatttctgacatcacggaatcgagaaacatttctgacatttccgactcggaccgatg

SEQ ID NO: 16179 - DNA, 203 bp, Homo sapiens
  source 1..203: mol_type = other DNA
ggcgcgccagtcctccggattgagtctgacatttctgacatttctgacatcacggaatcgagaaacatttctgacatttctgacatttctgacatttctgacatcacggaatcgagaaacatcacggaatcgagaaacatttctgacatttctgacatttctgacatttctgacatttctgacatttccgactcggaccgatg

SEQ ID NO: 16180 - DNA, 203 bp, Homo sapiens
  source 1..203: mol_type = other DNA
ggcgcgccagtcctcggatctgtatctgacatttctgacatttctgacatcacggaatcgagaaacatttctgacatttctgacatttctgacatttctgacatcacggaatcgagaaacatttctgacatttctgacatttctgacatttctgacatcacggaatcgagaaacatttctgacatttccgactcggaccgatg

SEQ ID NO: 16181 - DNA, 203 bp, Homo sapiens
  source 1..203: mol_type = other DNA
ggcgcgccagtcctaaatccgggatctgacatttctgacatttctgacatcacggaatcgagaaacatttctgacatttctgacatttctgacatttctgacatcacggaatcgagaaacatttctgacatttctgacatttctgacatttctgacatttctgacatttctgacatttctgacatttccgactcggaccgatg

SEQ ID NO: 16182 - DNA, 203 bp, Homo sapiens
  source 1..203: mol_type = other DNA
ggcgcgccagtcctatccggtggatctgacatttctgacatttctgacatcacggaatcgagaaacatttctgacatttctgacatttctgacatttctgacatttctgacatttctgacatttctgacatttctgacatcacggaatcgagaaacatttctgacatttctgacatttctgacatttccgactcggaccgatg

SEQ ID NO: 16183 - DNA, 203 bp, Homo sapiens
  source 1..203: mol_type = other DNA
ggcgcgccagtccttcaggcggattctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16184 - DNA, 203 bp, Homo sapiens
  source 1..203: mol_type = other DNA
ggcgcgccagtcctcaatccgtcgtctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16185 - DNA, 203 bp, Homo sapiens
  source 1..203: mol_type = other DNA
ggcgcgccagtccttatccgattgtctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16186 - DNA, 203 bp, Homo sapiens
  source 1..203: mol_type = other DNA
ggcgcgccagtcctatccgttgcctctgacatttctgacatttctgacatccggcgggtttctgacatccggcgggtttctgacatccggcgggtttctgacatccggcgggtttctgacatccggcgggtttctgacatccggcgggtttctgacatccggcgggtttctgacatttctgacatttccgactcggaccgatg

SEQ ID NO: 16187 - DNA, 203 bp, Homo sapiens
  source 1..203: mol_type = other DNA
ggcgcgccagtcctacaaatccggtctgacatttctgacatttctgacatccggcgggtttctgacatccggcgggtttctgacatccggcgggtttctgacatccggcgggtttctgacatccggcgggtttctgacatccggcgggtttctgacatttctgacatttctgacatccggcgggtttccgactcggaccgatg

SEQ ID NO: 16188 - DNA, 203 bp, Homo sapiens
  source 1..203: mol_type = other DNA
ggcgcgccagtcctgatccgtatttctgacatttctgacatttctgacatccggcgggtttctgacatccggcgggtttctgacatccggcgggtttctgacatccggcgggtttctgacatccggcgggtttctgacatccggcgggtttctgacatttctgacatttctgacatttctgacatttccgactcggaccgatg

SEQ ID NO: 16189 - DNA, 203 bp, Homo sapiens
  source 1..203: mol_type = other DNA
ggcgcgccagtcctgccggatacatctgacatttctgacatttctgacatccggcgggtttctgacatccggcgggtttctgacatccggcgggtttctgacatccggcgggtttctgacatccggcgggtttctgacatttctgacatttctgacatccggcgggtttctgacatccggcgggtttccgactcggaccgatg

SEQ ID NO: 16190 - DNA, 203 bp, Homo sapiens
  source 1..203: mol_type = other DNA
ggcgcgccagtcctaacggtctgttctgacatttctgacatttctgacatccggcgggtttctgacatccggcgggtttctgacatccggcgggtttctgacatccggcgggtttctgacatttctgacatttctgacatttctgacatttctgacatccggcgggtttctgacatttctgacatttccgactcggaccgatg

SEQ ID NO: 16191 - DNA, 203 bp, Homo sapiens
  source 1..203: mol_type = other DNA
ggcgcgccagtcctagcttctggttctgacatttctgacatttctgacatccggcgggtttctgacatccggcgggtttctgacatccggcgggtttctgacatccggcgggtttctgacatttctgacatttctgacatttctgacatttctgacatttctgacatttctgacatccggcgggtttccgactcggaccgatg

SEQ ID NO: 16192 - DNA, 203 bp, Homo sapiens
  source 1..203: mol_type = other DNA
ggcgcgccagtcctaggtcaagtttctgacatttctgacatttctgacatccggcgggtttctgacatccggcgggtttctgacatccggcgggtttctgacatttctgacatttctgacatccggcgggtttctgacatttctgacatttctgacatttctgacatttctgacatccggcgggtttccgactcggaccgatg

SEQ ID NO: 16193 - DNA, 203 bp, Homo sapiens
  source 1..203: mol_type = other DNA
ggcgcgccagtccttgctcaggattctgacatttctgacatttctgacatccggcgggtttctgacatccggcgggtttctgacatccggcgggtttctgacatttctgacatttctgacatttctgacatttctgacatttctgacatttctgacatccggcgggtttctgacatttctgacatttccgactcggaccgatg

SEQ ID NO: 16194 - DNA, 203 bp, Homo sapiens
  source 1..203: mol_type = other DNA
ggcgcgccagtccttgtctgcaaatctgacatttctgacatttctgacatccggcgggtttctgacatccggcgggtttctgacatccggcgggtttctgacatttctgacatttctgacatttctgacatttctgacatttctgacatttctgacatttctgacatttctgacatccggcgggtttccgactcggaccgatg

SEQ ID NO: 16195 - DNA, 203 bp, Homo sapiens
  source 1..203: mol_type = other DNA
ggcgcgccagtccttaggtcaccatctgacatttctgacatttctgacatccggcgggtttctgacatccggcgggtttctgacatccggcgggtttctgacatttctgacatttctgacatttctgacatttctgacatttctgacatttctgacatttctgacatttctgacatttctgacatttccgactcggaccgatg

SEQ ID NO: 16196 - DNA, 203 bp, Homo sapiens
  source 1..203: mol_type = other DNA
ggcgcgccagtccttgtaccgtcatctgacatttctgacatttctgacatccggcgggtttctgacatccggcgggtttctgacatttctgacatttctgacatccggcgggtttctgacatccggcgggtttctgacatccggcgggtttctgacatccggcgggtttctgacatccggcgggtttccgactcggaccgatg

SEQ ID NO: 16197 - DNA, 203 bp, Homo sapiens
  source 1..203: mol_type = other DNA
ggcgcgccagtcctttgagcttgttctgacatttctgacatttctgacatccggcgggtttctgacatccggcgggtttctgacatttctgacatttctgacatccggcgggtttctgacatccggcgggtttctgacatccggcgggtttctgacatccggcgggtttctgacatttctgacatttccgactcggaccgatg

SEQ ID NO: 16198 - DNA, 203 bp, Homo sapiens
  source 1..203: mol_type = other DNA
ggcgcgccagtcctaagagcttgatctgacatttctgacatttctgacatccggcgggtttctgacatccggcgggtttctgacatttctgacatttctgacatccggcgggtttctgacatccggcgggtttctgacatccggcgggtttctgacatttctgacatttctgacatccggcgggtttccgactcggaccgatg

SEQ ID NO: 16199 - DNA, 203 bp, Homo sapiens
  source 1..203: mol_type = other DNA
ggcgcgccagtcctaagcctgagatctgacatttctgacatttctgacatccggcgggtttctgacatccggcgggtttctgacatttctgacatttctgacatccggcgggtttctgacatccggcgggtttctgacatccggcgggtttctgacatttctgacatttctgacatttctgacatttccgactcggaccgatg

SEQ ID NO: 16200 - DNA, 203 bp, Homo sapiens
  source 1..203: mol_type = other DNA
ggcgcgccagtccttcaccgtctgtctgacatttctgacatttctgacatccggcgggtttctgacatccggcgggtttctgacatttctgacatttctgacatccggcgggtttctgacatccggcgggtttctgacatttctgacatttctgacatccggcgggtttctgacatttctgacatttccgactcggaccgatg

SEQ ID NO: 16201 - DNA, 203 bp, Homo sapiens
  source 1..203: mol_type = other DNA
ggcgcgccagtcctatcagtctagtctgacatttctgacatttctgacatccggcgggtttctgacatccggcgggtttctgacatttctgacatttctgacatccggcgggtttctgacatccggcgggtttctgacatttctgacatttctgacatttctgacatttctgacatttctgacatttccgactcggaccgatg

SEQ ID NO: 16202 - DNA, 203 bp, Homo sapiens
  source 1..203: mol_type = other DNA
ggcgcgccagtcctagctgacctgtctgacatttctgacatttctgacatccggcgggtttctgacatccggcgggtttctgacatttctgacatttctgacatccggcgggtttctgacatttctgacatttctgacatttctgacatttctgacatccggcgggtttctgacatccggcgggtttccgactcggaccgatg

SEQ ID NO: 16203 - DNA, 203 bp, Homo sapiens
  source 1..203: mol_type = other DNA
ggcgcgccagtccttgacggtttgtctgacatttctgacatttctgacatccggcgggtttctgacatccggcgggtttctgacatttctgacatttctgacatccggcgggtttctgacatttctgacatttctgacatttctgacatttctgacatttctgacatttctgacatccggcgggtttccgactcggaccgatg

SEQ ID NO: 16204 - DNA, 203 bp, Homo sapiens
  source 1..203: mol_type = other DNA
ggcgcgccagtcctacactagctgtctgacatttctgacatttctgacatccggcgggtttctgacatccggcgggtttctgacatttctgacatttctgacatttctgacatttctgacatccggcgggtttctgacatccggcgggtttctgacatccggcgggtttctgacatttctgacatttccgactcggaccgatg

SEQ ID NO: 16205 - DNA, 203 bp, Homo sapiens
  source 1..203: mol_type = other DNA
ggcgcgccagtcctcttcgtctgatctgacatttctgacatttctgacatccggcgggtttctgacatccggcgggtttctgacatttctgacatttctgacatttctgacatttctgacatccggcgggtttctgacatttctgacatttctgacatccggcgggtttctgacatttctgacatttccgactcggaccgatg

SEQ ID NO: 16206 - DNA, 203 bp, Homo sapiens
  source 1..203: mol_type = other DNA
ggcgcgccagtcctcataccgtcttctgacatttctgacatttctgacatccggcgggtttctgacatccggcgggtttctgacatttctgacatttctgacatttctgacatttctgacatccggcgggtttctgacatttctgacatttctgacatttctgacatttctgacatccggcgggtttccgactcggaccgatg

SEQ ID NO: 16207 - DNA, 203 bp, Homo sapiens
  source 1..203: mol_type = other DNA
ggcgcgccagtcctcttgactggttctgacatttctgacatttctgacatccggcgggtttctgacatccggcgggtttctgacatttctgacatttctgacatttctgacatttctgacatttctgacatttctgacatccggcgggtttctgacatccggcgggtttctgacatttctgacatttccgactcggaccgatg

SEQ ID NO: 16208 - DNA, 203 bp, Homo sapiens
  source 1..203: mol_type = other DNA
ggcgcgccagtcctcttcaagacttctgacatttctgacatttctgacatccggcgggtttctgacatccggcgggtttctgacatttctgacatttctgacatttctgacatttctgacatttctgacatttctgacatttctgacatttctgacatttctgacatttctgacatccggcgggtttccgactcggaccgatg

SEQ ID NO: 16209 - DNA, 203 bp, Homo sapiens
  source 1..203: mol_type = other DNA
ggcgcgccagtccttattcaagcttctgacatttctgacatttctgacatccggcgggtttctgacatttctgacatttctgacatccggcgggtttctgacatccggcgggtttctgacatccggcgggtttctgacatttctgacatttctgacatccggcgggtttctgacatttctgacatttccgactcggaccgatg

SEQ ID NO: 16210 - DNA, 203 bp, Homo sapiens
  source 1..203: mol_type = other DNA
ggcgcgccagtccttgagtttacatctgacatttctgacatttctgacatccggcgggtttctgacatttctgacatttctgacatccggcgggtttctgacatccggcgggtttctgacatccggcgggtttctgacatttctgacatttctgacatttctgacatttctgacatccggcgggtttccgactcggaccgatg

SEQ ID NO: 16211 - DNA, 203 bp, Homo sapiens
  source 1..203: mol_type = other DNA
ggcgcgccagtcctagtgagaatatctgacatttctgacatttctgacatccggcgggtttctgacatttctgacatttctgacatccggcgggtttctgacatccggcgggtttctgacatttctgacatttctgacatccggcgggtttctgacatccggcgggtttctgacatccggcgggtttccgactcggaccgatg

SEQ ID NO: 16212 - DNA, 203 bp, Homo sapiens
  source 1..203: mol_type = other DNA
ggcgcgccagtcctttgtagactatctgacatttctgacatttctgacatccggcgggtttctgacatttctgacatttctgacatccggcgggtttctgacatccggcgggtttctgacatttctgacatttctgacatccggcgggtttctgacatttctgacatttctgacatttctgacatttccgactcggaccgatg

SEQ ID NO: 16213 - DNA, 203 bp, Homo sapiens
  source 1..203: mol_type = other DNA
ggcgcgccagtccttaaagaccattctgacatttctgacatttctgacatccggcgggtttctgacatttctgacatttctgacatccggcgggtttctgacatccggcgggtttctgacatttctgacatttctgacatttctgacatttctgacatccggcgggtttctgacatttctgacatttccgactcggaccgatg

SEQ ID NO: 16214 - DNA, 203 bp, Homo sapiens
  source 1..203: mol_type = other DNA
ggcgcgccagtcctagcctaagattctgacatttctgacatttctgacatccggcgggtttctgacatttctgacatttctgacatccggcgggtttctgacatttctgacatttctgacatccggcgggtttctgacatccggcgggtttctgacatccggcgggtttctgacatccggcgggtttccgactcggaccgatg

SEQ ID NO: 16215 - DNA, 203 bp, Homo sapiens
  source 1..203: mol_type = other DNA
ggcgcgccagtcctctactgtctgtctgacatttctgacatttctgacatccggcgggtttctgacatttctgacatttctgacatccggcgggtttctgacatttctgacatttctgacatccggcgggtttctgacatttctgacatttctgacatttctgacatttctgacatccggcgggtttccgactcggaccgatg

SEQ ID NO: 16216 - DNA, 203 bp, Homo sapiens
  source 1..203: mol_type = other DNA
ggcgcgccagtcctctcacaagattctgacatttctgacatttctgacatccggcgggtttctgacatttctgacatttctgacatccggcgggtttctgacatttctgacatttctgacatccggcgggtttctgacatttctgacatttctgacatttctgacatttctgacatttctgacatttccgactcggaccgatg

SEQ ID NO: 16217 - DNA, 203 bp, Homo sapiens
  source 1..203: mol_type = other DNA
ggcgcgccagtcctaattctctgatctgacatttctgacatttctgacatccggcgggtttctgacatttctgacatttctgacatccggcgggtttctgacatttctgacatttctgacatttctgacatttctgacatccggcgggtttctgacatccggcgggtttctgacatccggcgggtttccgactcggaccgatg

SEQ ID NO: 16218 - DNA, 203 bp, Homo sapiens
  source 1..203: mol_type = other DNA
ggcgcgccagtcctacgactagtgtctgacatttctgacatttctgacatccggcgggtttctgacatttctgacatttctgacatccggcgggtttctgacatttctgacatttctgacatttctgacatttctgacatccggcgggtttctgacatttctgacatttctgacatttctgacatttccgactcggaccgatg

SEQ ID NO: 16219 - DNA, 203 bp, Homo sapiens
  source 1..203: mol_type = other DNA
ggcgcgccagtcctacgacaaggttctgacatttctgacatttctgacatccggcgggtttctgacatttctgacatttctgacatccggcgggtttctgacatttctgacatttctgacatttctgacatttctgacatttctgacatttctgacatccggcgggtttctgacatccggcgggtttccgactcggaccgatg

SEQ ID NO: 16220 - DNA, 203 bp, Homo sapiens
  source 1..203: mol_type = other DNA
ggcgcgccagtccttagccttcgttctgacatttctgacatttctgacatccggcgggtttctgacatttctgacatttctgacatccggcgggtttctgacatttctgacatttctgacatttctgacatttctgacatttctgacatttctgacatccggcgggtttctgacatttctgacatttccgactcggaccgatg

SEQ ID NO: 16221 - DNA, 203 bp, Homo sapiens
  source 1..203: mol_type = other DNA
ggcgcgccagtccttgcactggtgtctgacatttctgacatttctgacatccggcgggtttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16222 - DNA, 203 bp, Homo sapiens
  source 1..203: mol_type = other DNA
ggcgcgccagtcctcttcttgcgatctgacatttctgacatttctgacatccggcgggtttctgacatttctgacatttctgacatttctgacatttctgacatccggcgggtttctgacatccggcgggtttctgacatttctgacatttctgacatttctgacatttctgacatccggcgggtttccgactcggaccgatg

SEQ ID NO: 16223 - DNA, 203 bp, Homo sapiens
  source 1..203: mol_type = other DNA
ggcgcgccagtcctcacaacttgatctgacatttctgacatttctgacatccggcgggtttctgacatttctgacatttctgacatttctgacatttctgacatccggcgggtttctgacatttctgacatttctgacatccggcgggtttctgacatccggcgggtttctgacatccggcgggtttccgactcggaccgatg

SEQ ID NO: 16224 - DNA, 203 bp, Homo sapiens
  source 1..203: mol_type = other DNA
ggcgcgccagtcctttacaaggattctgacatttctgacatttctgacatccggcgggtttctgacatttctgacatttctgacatttctgacatttctgacatccggcgggtttctgacatttctgacatttctgacatccggcgggtttctgacatttctgacatttctgacatccggcgggtttccgactcggaccgatg

SEQ ID NO: 16225 - DNA, 203 bp, Homo sapiens
  source 1..203: mol_type = other DNA
ggcgcgccagtccttagtttgcaatctgacatttctgacatttctgacatccggcgggtttctgacatttctgacatttctgacatttctgacatttctgacatccggcgggtttctgacatttctgacatttctgacatccggcgggtttctgacatttctgacatttctgacatttctgacatttccgactcggaccgatg

SEQ ID NO: 16226 - DNA, 203 bp, Homo sapiens
  source 1..203: mol_type = other DNA
ggcgcgccagtccttcaagtgtagtctgacatttctgacatttctgacatccggcgggtttctgacatttctgacatttctgacatttctgacatttctgacatccggcgggtttctgacatttctgacatttctgacatttctgacatttctgacatccggcgggtttctgacatttctgacatttccgactcggaccgatg

SEQ ID NO: 16227 - DNA, 203 bp, Homo sapiens
  source 1..203: mol_type = other DNA
ggcgcgccagtcctagaatcagagtctgacatttctgacatttctgacatccggcgggtttctgacatttctgacatttctgacatttctgacatttctgacatccggcgggtttctgacatttctgacatttctgacatttctgacatttctgacatttctgacatttctgacatttctgacatttccgactcggaccgatg

SEQ ID NO: 16228 - DNA, 203 bp, Homo sapiens
  source 1..203: mol_type = other DNA
ggcgcgccagtcctcacttgcacttctgacatttctgacatttctgacatccggcgggtttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16229 - DNA, 203 bp, Homo sapiens
  source 1..203: mol_type = other DNA
ggcgcgccagtccttcagtcgtcatctgacatttctgacatttctgacatccggcgggtttctgacatttctgacatttctgacatttctgacatttctgacatttctgacatttctgacatccggcgggtttctgacatttctgacatttctgacatttctgacatttctgacatccggcgggtttccgactcggaccgatg

SEQ ID NO: 16230 - DNA, 203 bp, Homo sapiens
  source 1..203: mol_type = other DNA
ggcgcgccagtcctaacgaaagagtctgacatttctgacatttctgacatccggcgggtttctgacatttctgacatttctgacatttctgacatttctgacatttctgacatttctgacatttctgacatttctgacatccggcgggtttctgacatttctgacatttctgacatccggcgggtttccgactcggaccgatg

SEQ ID NO: 16231 - DNA, 203 bp, Homo sapiens
  source 1..203: mol_type = other DNA
ggcgcgccagtcctaacagacagttctgacatttctgacatttctgacatccggcgggtttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16232 - DNA, 203 bp, Homo sapiens
  source 1..203: mol_type = other DNA
ggcgcgccagtcctaatcttgcaatctgacatttctgacatttctgacatccggcgggtttctgacatttctgacatttctgacatttctgacatttctgacatttctgacatttctgacatttctgacatttctgacatttctgacatttctgacatccggcgggtttctgacatttctgacatttccgactcggaccgatg

SEQ ID NO: 16233 - DNA, 203 bp, Homo sapiens
  source 1..203: mol_type = other DNA
ggcgcgccagtccttgtaaaccgttctgacatttctgacatttctgacatccggcgggtttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16234 - DNA, 203 bp, Homo sapiens
  source 1..203: mol_type = other DNA
ggcgcgccagtcctaactgatccttctgacatttctgacatttctgacatcgtcaattcctttaacatcgtcaattcctttaacatcgtcaattcctttaacatcgtcaattcctttaacatcgtcaattcctttaacatcgtcaattcctttaacatcgtcaattcctttaacatttctgacatttccgactcggaccgatg

SEQ ID NO: 16235 - DNA, 203 bp, Homo sapiens
  source 1..203: mol_type = other DNA
ggcgcgccagtccttgatcagttttctgacatttctgacatttctgacatcgtcaattcctttaacatcgtcaattcctttaacatcgtcaattcctttaacatcgtcaattcctttaacatcgtcaattcctttaacatcgtcaattcctttaacatttctgacatttctgacatttctgacatttccgactcggaccgatg

SEQ ID NO: 16236 - DNA, 203 bp, Homo sapiens
  source 1..203: mol_type = other DNA
ggcgcgccagtcctttctggtacatctgacatttctgacatttctgacatcgtcaattcctttaacatcgtcaattcctttaacatcgtcaattcctttaacatcgtcaattcctttaacatcgtcaattcctttaacatttctgacatttctgacatcgtcaattcctttaacatttctgacatttccgactcggaccgatg

SEQ ID NO: 16237 - DNA, 203 bp, Homo sapiens
  source 1..203: mol_type = other DNA
ggcgcgccagtcctcttagctctatctgacatttctgacatttctgacatcgtcaattcctttaacatcgtcaattcctttaacatcgtcaattcctttaacatcgtcaattcctttaacatttctgacatttctgacatcgtcaattcctttaacatcgtcaattcctttaacatttctgacatttccgactcggaccgatg

SEQ ID NO: 16238 - DNA, 203 bp, Homo sapiens
  source 1..203: mol_type = other DNA
ggcgcgccagtcctctaagattcttctgacatttctgacatttctgacatcgtcaattcctttaacatcgtcaattcctttaacatcgtcaattcctttaacatcgtcaattcctttaacatttctgacatttctgacatttctgacatttctgacatttctgacatttctgacatttctgacatttccgactcggaccgatg

SEQ ID NO: 16239 - DNA, 203 bp, Homo sapiens
  source 1..203: mol_type = other DNA
ggcgcgccagtcctttaacagctttctgacatttctgacatttctgacatcgtcaattcctttaacatcgtcaattcctttaacatcgtcaattcctttaacatttctgacatttctgacatcgtcaattcctttaacatcgtcaattcctttaacatcgtcaattcctttaacatttctgacatttccgactcggaccgatg

SEQ ID NO: 16240 - DNA, 203 bp, Homo sapiens
  source 1..203: mol_type = other DNA
ggcgcgccagtcctatggtagccatctgacatttctgacatttctgacatcgtcaattcctttaacatcgtcaattcctttaacatcgtcaattcctttaacatttctgacatttctgacatcgtcaattcctttaacatcgtcaattcctttaacatttctgacatttctgacatttctgacatttccgactcggaccgatg

SEQ ID NO: 16241 - DNA, 203 bp, Homo sapiens
  source 1..203: mol_type = other DNA
ggcgcgccagtcctaccaaccttttctgacatttctgacatttctgacatcgtcaattcctttaacatcgtcaattcctttaacatcgtcaattcctttaacatttctgacatttctgacatcgtcaattcctttaacatttctgacatttctgacatcgtcaattcctttaacatttctgacatttccgactcggaccgatg

SEQ ID NO: 16242 - DNA, 203 bp, Homo sapiens
  source 1..203: mol_type = other DNA
ggcgcgccagtcctatggttaagatctgacatttctgacatttctgacatcgtcaattcctttaacatcgtcaattcctttaacatcgtcaattcctttaacatttctgacatttctgacatttctgacatttctgacatcgtcaattcctttaacatcgtcaattcctttaacatttctgacatttccgactcggaccgatg

SEQ ID NO: 16243 - DNA, 203 bp, Homo sapiens
  source 1..203: mol_type = other DNA
ggcgcgccagtccttgcttgactatctgacatttctgacatttctgacatcgtcaattcctttaacatcgtcaattcctttaacatcgtcaattcctttaacatttctgacatttctgacatttctgacatttctgacatttctgacatttctgacatttctgacatttctgacatttctgacatttccgactcggaccgatg

SEQ ID NO: 16244 - DNA, 203 bp, Homo sapiens
  source 1..203: mol_type = other DNA
ggcgcgccagtccttgctcagatatctgacatttctgacatttctgacatcgtcaattcctttaacatcgtcaattcctttaacatttctgacatttctgacatcgtcaattcctttaacatcgtcaattcctttaacatcgtcaattcctttaacatcgtcaattcctttaacatttctgacatttccgactcggaccgatg

SEQ ID NO: 16245 - DNA, 203 bp, Homo sapiens
  source 1..203: mol_type = other DNA
ggcgcgccagtcctaaagaggttatctgacatttctgacatttctgacatcgtcaattcctttaacatcgtcaattcctttaacatttctgacatttctgacatcgtcaattcctttaacatcgtcaattcctttaacatttctgacatttctgacatttctgacatttctgacatttctgacatttccgactcggaccgatg

SEQ ID NO: 16246 - DNA, 203 bp, Homo sapiens
  source 1..203: mol_type = other DNA
ggcgcgccagtccttagtcagacttctgacatttctgacatttctgacatcgtcaattcctttaacatcgtcaattcctttaacatttctgacatttctgacatcgtcaattcctttaacatttctgacatttctgacatcgtcaattcctttaacatcgtcaattcctttaacatttctgacatttccgactcggaccgatg

SEQ ID NO: 16247 - DNA, 203 bp, Homo sapiens
  source 1..203: mol_type = other DNA
ggcgcgccagtcctagtgacctcttctgacatttctgacatttctgacatcgtcaattcctttaacatcgtcaattcctttaacatttctgacatttctgacatcgtcaattcctttaacatttctgacatttctgacatttctgacatttctgacatcgtcaattcctttaacatttctgacatttccgactcggaccgatg

SEQ ID NO: 16248 - DNA, 203 bp, Homo sapiens
  source 1..203: mol_type = other DNA
ggcgcgccagtccttgcttaagcatctgacatttctgacatttctgacatcgtcaattcctttaacatcgtcaattcctttaacatttctgacatttctgacatttctgacatttctgacatcgtcaattcctttaacatcgtcaattcctttaacatcgtcaattcctttaacatttctgacatttccgactcggaccgatg

SEQ ID NO: 16249 - DNA, 203 bp, Homo sapiens
  source 1..203: mol_type = other DNA
ggcgcgccagtccttgagaggtcatctgacatttctgacatttctgacatcgtcaattcctttaacatcgtcaattcctttaacatttctgacatttctgacatttctgacatttctgacatcgtcaattcctttaacatcgtcaattcctttaacatttctgacatttctgacatttctgacatttccgactcggaccgatg

SEQ ID NO: 16250 - DNA, 203 bp, Homo sapiens
  source 1..203: mol_type = other DNA
ggcgcgccagtcctaaccttcttgtctgacatttctgacatttctgacatcgtcaattcctttaacatcgtcaattcctttaacatttctgacatttctgacatttctgacatttctgacatcgtcaattcctttaacatttctgacatttctgacatcgtcaattcctttaacatttctgacatttccgactcggaccgatg

SEQ ID NO: 16251 - DNA, 203 bp, Homo sapiens
  source 1..203: mol_type = other DNA
ggcgcgccagtccttacagagtagtctgacatttctgacatttctgacatcgtcaattcctttaacatcgtcaattcctttaacatttctgacatttctgacatttctgacatttctgacatttctgacatttctgacatcgtcaattcctttaacatcgtcaattcctttaacatttctgacatttccgactcggaccgatg

SEQ ID NO: 16252 - DNA, 203 bp, Homo sapiens
  source 1..203: mol_type = other DNA
ggcgcgccagtcctaaggtgagtgtctgacatttctgacatttctgacatcgtcaattcctttaacatcgtcaattcctttaacatttctgacatttctgacatttctgacatttctgacatttctgacatttctgacatttctgacatttctgacatcgtcaattcctttaacatttctgacatttccgactcggaccgatg

SEQ ID NO: 16253 - DNA, 203 bp, Homo sapiens
  source 1..203: mol_type = other DNA
ggcgcgccagtcctatcttagctttctgacatttctgacatttctgacatcgtcaattcctttaacatttctgacatttctgacatcgtcaattcctttaacatcgtcaattcctttaacatcgtcaattcctttaacatttctgacatttctgacatcgtcaattcctttaacatttctgacatttccgactcggaccgatg

SEQ ID NO: 16254 - DNA, 203 bp, Homo sapiens
  source 1..203: mol_type = other DNA
ggcgcgccagtcctcactagcttatctgacatttctgacatttctgacatcgtcaattcctttaacatttctgacatttctgacatcgtcaattcctttaacatcgtcaattcctttaacatttctgacatttctgacatcgtcaattcctttaacatcgtcaattcctttaacatttctgacatttccgactcggaccgatg

SEQ ID NO: 16255 - DNA, 203 bp, Homo sapiens
  source 1..203: mol_type = other DNA
ggcgcgccagtccttagcttgctgtctgacatttctgacatttctgacatcgtcaattcctttaacatttctgacatttctgacatcgtcaattcctttaacatcgtcaattcctttaacatttctgacatttctgacatcgtcaattcctttaacatttctgacatttctgacatttctgacatttccgactcggaccgatg

SEQ ID NO: 16256 - DNA, 203 bp, Homo sapiens
  source 1..203: mol_type = other DNA
ggcgcgccagtcctcaggactcgttctgacatttctgacatttctgacatcgtcaattcctttaacatttctgacatttctgacatcgtcaattcctttaacatttctgacatttctgacatcgtcaattcctttaacatcgtcaattcctttaacatcgtcaattcctttaacatttctgacatttccgactcggaccgatg

SEQ ID NO: 16257 - DNA, 203 bp, Homo sapiens
  source 1..203: mol_type = other DNA
ggcgcgccagtccttgcagtagcttctgacatttctgacatttctgacatcgtcaattcctttaacatttctgacatttctgacatcgtcaattcctttaacatttctgacatttctgacatcgtcaattcctttaacatttctgacatttctgacatcgtcaattcctttaacatttctgacatttccgactcggaccgatg

SEQ ID NO: 16258 - DNA, 203 bp, Homo sapiens
  source 1..203: mol_type = other DNA
ggcgcgccagtcctagactgtgcttctgacatttctgacatttctgacatcgtcaattcctttaacatttctgacatttctgacatcgtcaattcctttaacatttctgacatttctgacatcgtcaattcctttaacatttctgacatttctgacatttctgacatttctgacatttctgacatttccgactcggaccgatg

SEQ ID NO: 16259 - DNA, 203 bp, Homo sapiens
  source 1..203: mol_type = other DNA
ggcgcgccagtcctaaaactctcatctgacatttctgacatttctgacatcgtcaattcctttaacatttctgacatttctgacatcgtcaattcctttaacatttctgacatttctgacatttctgacatttctgacatcgtcaattcctttaacatttctgacatttctgacatttctgacatttccgactcggaccgatg

SEQ ID NO: 16260 - DNA, 203 bp, Homo sapiens
  source 1..203: mol_type = other DNA
ggcgcgccagtcctaagtaggacttctgacatttctgacatttctgacatcgtcaattcctttaacatttctgacatttctgacatcgtcaattcctttaacatttctgacatttctgacatttctgacatttctgacatttctgacatttctgacatcgtcaattcctttaacatttctgacatttccgactcggaccgatg

SEQ ID NO: 16261 - DNA, 203 bp, Homo sapiens
  source 1..203: mol_type = other DNA
ggcgcgccagtcctatgaggactgtctgacatttctgacatttctgacatcgtcaattcctttaacatttctgacatttctgacatttctgacatttctgacatcgtcaattcctttaacatttctgacatttctgacatcgtcaattcctttaacatttctgacatttctgacatttctgacatttccgactcggaccgatg

SEQ ID NO: 16262 - DNA, 203 bp, Homo sapiens
  source 1..203: mol_type = other DNA
ggcgcgccagtcctcaacactctgtctgacatttctgacatttctgacatcgtcaattcctttaacatttctgacatttctgacatttctgacatttctgacatcgtcaattcctttaacatttctgacatttctgacatttctgacatttctgacatcgtcaattcctttaacatttctgacatttccgactcggaccgatg

SEQ ID NO: 16263 - DNA, 203 bp, Homo sapiens
  source 1..203: mol_type = other DNA
ggcgcgccagtccttaactggacttctgacatttctgacatttctgacatcgtcaattcctttaacatttctgacatttctgacatttctgacatttctgacatcgtcaattcctttaacatttctgacatttctgacatttctgacatttctgacatttctgacatttctgacatttctgacatttccgactcggaccgatg

SEQ ID NO: 16264 - DNA, 203 bp, Homo sapiens
  source 1..203: mol_type = other DNA
ggcgcgccagtcctagcagtccattctgacatttctgacatttctgacatcgtcaattcctttaacatttctgacatttctgacatttctgacatttctgacatttctgacatttctgacatttctgacatttctgacatcgtcaattcctttaacatcgtcaattcctttaacatttctgacatttccgactcggaccgatg

SEQ ID NO: 16265 - DNA, 203 bp, Homo sapiens
  source 1..203: mol_type = other DNA
ggcgcgccagtcctacatactgtgtctgacatttctgacatttctgacatgcaggctccactcctggtggtgcccttccgtcaattcctttaagtttcagctttgcaaccatactccccccggaacccaaagactttggtttcccggaagctgcccggcgggtcatgggaataacgccctgacatttccgactcggaccgatg

SEQ ID NO: 16266 - DNA, 203 bp, Homo sapiens
  source 1..203: mol_type = other DNA
ggcgcgccagtcctacatgatcattctgacatttctgacatttctgacattaccggccgttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16267 - DNA, 203 bp, Homo sapiens
  source 1..203: mol_type = other DNA
ggcgcgccagtcctaaagctaaagtctgacatttctgacatttctgacattaccggccgttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16268 - DNA, 203 bp, Homo sapiens
  source 1..203: mol_type = other DNA
ggcgcgccagtcctaccagaactttctgacatttctgacatttctgacattactcccatttctgacattactcccatttctgacattactcccatttctgacattactcccatttctgacattactcccatttctgacattactcccatttctgacattactcccatttctgacattactcccatttccgactcggaccgatg

SEQ ID NO: 16269 - DNA, 203 bp, Homo sapiens
  source 1..203: mol_type = other DNA
ggcgcgccagtccttaaggttgattctgacatttctgacatttctgacattactcccatttctgacattactcccatttctgacattactcccatttctgacattactcccatttctgacattactcccatttctgacattactcccatttctgacatttctgacatttctgacatttctgacatttccgactcggaccgatg

SEQ ID NO: 16270 - DNA, 203 bp, Homo sapiens
  source 1..203: mol_type = other DNA
ggcgcgccagtccttatgctcatatctgacatttctgacatttctgacattactcccatttctgacattactcccatttctgacattactcccatttctgacattactcccatttctgacattactcccatttctgacatttctgacatttctgacattactcccatttctgacatttctgacatttccgactcggaccgatg

SEQ ID NO: 16271 - DNA, 203 bp, Homo sapiens
  source 1..203: mol_type = other DNA
ggcgcgccagtccttatgagcaaatctgacatttctgacatttctgacattactcccatttctgacattactcccatttctgacattactcccatttctgacattactcccatttctgacattactcccatttctgacatttctgacatttctgacatttctgacatttctgacattactcccatttccgactcggaccgatg

SEQ ID NO: 16272 - DNA, 203 bp, Homo sapiens
  source 1..203: mol_type = other DNA
ggcgcgccagtcctttaagtgccatctgacatttctgacatttctgacattactcccatttctgacattactcccatttctgacattactcccatttctgacattactcccatttctgacatttctgacatttctgacattactcccatttctgacattactcccatttctgacattactcccatttccgactcggaccgatg

SEQ ID NO: 16273 - DNA, 203 bp, Homo sapiens
  source 1..203: mol_type = other DNA
ggcgcgccagtcctatacagtttatctgacatttctgacatttctgacattactcccatttctgacattactcccatttctgacattactcccatttctgacattactcccatttctgacatttctgacatttctgacattactcccatttctgacattactcccatttctgacatttctgacatttccgactcggaccgatg

SEQ ID NO: 16274 - DNA, 203 bp, Homo sapiens
  source 1..203: mol_type = other DNA
ggcgcgccagtcctttaaagtgtatctgacatttctgacatttctgacattactcccatttctgacattactcccatttctgacattactcccatttctgacattactcccatttctgacatttctgacatttctgacattactcccatttctgacatttctgacatttctgacattactcccatttccgactcggaccgatg

SEQ ID NO: 16275 - DNA, 203 bp, Homo sapiens
  source 1..203: mol_type = other DNA
ggcgcgccagtccttatgaatctatctgacatttctgacatttctgacattactcccatttctgacattactcccatttctgacattactcccatttctgacattactcccatttctgacatttctgacatttctgacattactcccatttctgacatttctgacatttctgacatttctgacatttccgactcggaccgatg

SEQ ID NO: 16276 - DNA, 203 bp, Homo sapiens
  source 1..203: mol_type = other DNA
ggcgcgccagtcctcctttcgtcttctgacatttctgacatttctgacattactcccatttctgacattactcccatttctgacattactcccatttctgacatttctgacatttctgacattactcccatttctgacattactcccatttctgacatttctgacatttctgacattactcccatttccgactcggaccgatg

SEQ ID NO: 16277 - DNA, 203 bp, Homo sapiens
  source 1..203: mol_type = other DNA
ggcgcgccagtcctccttgagaaatctgacatttctgacatttctgacattactcccatttctgacattactcccatttctgacattactcccatttctgacatttctgacatttctgacattactcccatttctgacattactcccatttctgacatttctgacatttctgacatttctgacatttccgactcggaccgatg

SEQ ID NO: 16278 - DNA, 203 bp, Homo sapiens
  source 1..203: mol_type = other DNA
ggcgcgccagtcctagcaagtaggtctgacatttctgacatttctgacattactcccatttctgacattactcccatttctgacattactcccatttctgacatttctgacatttctgacattactcccatttctgacatttctgacatttctgacattactcccatttctgacattactcccatttccgactcggaccgatg

SEQ ID NO: 16279 - DNA, 203 bp, Homo sapiens
  source 1..203: mol_type = other DNA
ggcgcgccagtcctaacgacaaggtctgacatttctgacatttctgacattactcccatttctgacattactcccatttctgacattactcccatttctgacatttctgacatttctgacattactcccatttctgacatttctgacatttctgacattactcccatttctgacatttctgacatttccgactcggaccgatg

SEQ ID NO: 16280 - DNA, 203 bp, Homo sapiens
  source 1..203: mol_type = other DNA
ggcgcgccagtcctacctactaggtctgacatttctgacatttctgacattactcccatttctgacattactcccatttctgacattactcccatttctgacatttctgacatttctgacattactcccatttctgacatttctgacatttctgacatttctgacatttctgacatttctgacatttccgactcggaccgatg

SEQ ID NO: 16281 - DNA, 203 bp, Homo sapiens
  source 1..203: mol_type = other DNA
ggcgcgccagtccttaaggttaggtctgacatttctgacatttctgacattactcccatttctgacattactcccatttctgacattactcccatttctgacatttctgacatttctgacatttctgacatttctgacattactcccatttctgacattactcccatttctgacatttctgacatttccgactcggaccgatg

SEQ ID NO: 16282 - DNA, 203 bp, Homo sapiens
  source 1..203: mol_type = other DNA
ggcgcgccagtcctacactctgaatctgacatttctgacatttctgacattactcccatttctgacattactcccatttctgacattactcccatttctgacatttctgacatttctgacatttctgacatttctgacatttctgacatttctgacattactcccatttctgacattactcccatttccgactcggaccgatg

SEQ ID NO: 16283 - DNA, 203 bp, Homo sapiens
  source 1..203: mol_type = other DNA
ggcgcgccagtccttccagtgcattctgacatttctgacatttctgacattactcccatttctgacattactcccatttctgacattactcccatttctgacatttctgacatttctgacatttctgacatttctgacatttctgacatttctgacatttctgacatttctgacatttctgacatttccgactcggaccgatg

SEQ ID NO: 16284 - DNA, 203 bp, Homo sapiens
  source 1..203: mol_type = other DNA
ggcgcgccagtcctacctcaagtgtctgacatttctgacatttctgacattactcccatttctgacattactcccatttctgacatttctgacatttctgacattactcccatttctgacattactcccatttctgacattactcccatttctgacattactcccatttctgacattactcccatttccgactcggaccgatg

SEQ ID NO: 16285 - DNA, 203 bp, Homo sapiens
  source 1..203: mol_type = other DNA
ggcgcgccagtcctaaggtcctgttctgacatttctgacatttctgacattactcccatttctgacattactcccatttctgacatttctgacatttctgacattactcccatttctgacattactcccatttctgacattactcccatttctgacattactcccatttctgacatttctgacatttccgactcggaccgatg

SEQ ID NO: 16286 - DNA, 203 bp, Homo sapiens
  source 1..203: mol_type = other DNA
ggcgcgccagtccttgtaaaggcttctgacatttctgacatttctgacattactcccatttctgacattactcccatttctgacatttctgacatttctgacattactcccatttctgacattactcccatttctgacatttctgacatttctgacattactcccatttctgacattactcccatttccgactcggaccgatg

SEQ ID NO: 16287 - DNA, 203 bp, Homo sapiens
  source 1..203: mol_type = other DNA
ggcgcgccagtcctagtctttcattctgacatttctgacatttctgacattactcccatttctgacattactcccatttctgacatttctgacatttctgacattactcccatttctgacattactcccatttctgacatttctgacatttctgacattactcccatttctgacatttctgacatttccgactcggaccgatg

SEQ ID NO: 16288 - DNA, 203 bp, Homo sapiens
  source 1..203: mol_type = other DNA
ggcgcgccagtcctaaacactgcttctgacatttctgacatttctgacattactcccatttctgacattactcccatttctgacatttctgacatttctgacattactcccatttctgacattactcccatttctgacatttctgacatttctgacatttctgacatttctgacattactcccatttccgactcggaccgatg

SEQ ID NO: 16289 - DNA, 203 bp, Homo sapiens
  source 1..203: mol_type = other DNA
ggcgcgccagtcctctgtaaggattctgacatttctgacatttctgacattactcccatttctgacattactcccatttctgacatttctgacatttctgacattactcccatttctgacattactcccatttctgacatttctgacatttctgacatttctgacatttctgacatttctgacatttccgactcggaccgatg

SEQ ID NO: 16290 - DNA, 203 bp, Homo sapiens
  source 1..203: mol_type = other DNA
ggcgcgccagtcctctgtctgtattctgacatttctgacatttctgacattactcccatttctgacattactcccatttctgacatttctgacatttctgacattactcccatttctgacatttctgacatttctgacattactcccatttctgacattactcccatttctgacattactcccatttccgactcggaccgatg

SEQ ID NO: 16291 - DNA, 203 bp, Homo sapiens
  source 1..203: mol_type = other DNA
ggcgcgccagtcctctgacggtgatctgacatttctgacatttctgacattactcccatttctgacattactcccatttctgacatttctgacatttctgacattactcccatttctgacatttctgacatttctgacattactcccatttctgacatttctgacatttctgacattactcccatttccgactcggaccgatg

SEQ ID NO: 16292 - DNA, 203 bp, Homo sapiens
  source 1..203: mol_type = other DNA
ggcgcgccagtcctaggtcttcagtctgacatttctgacatttctgacattactcccatttctgacattactcccatttctgacatttctgacatttctgacatttctgacatttctgacattactcccatttctgacattactcccatttctgacattactcccatttctgacatttctgacatttccgactcggaccgatg

SEQ ID NO: 16293 - DNA, 203 bp, Homo sapiens
  source 1..203: mol_type = other DNA
ggcgcgccagtcctctttcttcagtctgacatttctgacatttctgacattactcccatttctgacattactcccatttctgacatttctgacatttctgacatttctgacatttctgacattactcccatttctgacattactcccatttctgacatttctgacatttctgacatttctgacatttccgactcggaccgatg

SEQ ID NO: 16294 - DNA, 203 bp, Homo sapiens
  source 1..203: mol_type = other DNA
ggcgcgccagtcctaatcggtcagtctgacatttctgacatttctgacattactcccatttctgacattactcccatttctgacatttctgacatttctgacatttctgacatttctgacattactcccatttctgacatttctgacatttctgacattactcccatttctgacattactcccatttccgactcggaccgatg

SEQ ID NO: 16295 - DNA, 203 bp, Homo sapiens
  source 1..203: mol_type = other DNA
ggcgcgccagtccttgtccaagaatctgacatttctgacatttctgacattactcccatttctgacattactcccatttctgacatttctgacatttctgacatttctgacatttctgacattactcccatttctgacatttctgacatttctgacattactcccatttctgacatttctgacatttccgactcggaccgatg

SEQ ID NO: 16296 - DNA, 203 bp, Homo sapiens
  source 1..203: mol_type = other DNA
ggcgcgccagtcctagtcaactgatctgacatttctgacatttctgacattactcccatttctgacattactcccatttctgacatttctgacatttctgacatttctgacatttctgacattactcccatttctgacatttctgacatttctgacatttctgacatttctgacattactcccatttccgactcggaccgatg

SEQ ID NO: 16297 - DNA, 203 bp, Homo sapiens
  source 1..203: mol_type = other DNA
ggcgcgccagtcctagtgaagccatctgacatttctgacatttctgacattactcccatttctgacattactcccatttctgacatttctgacatttctgacatttctgacatttctgacatttctgacatttctgacattactcccatttctgacatttctgacatttctgacattactcccatttccgactcggaccgatg

SEQ ID NO: 16298 - DNA, 203 bp, Homo sapiens
  source 1..203: mol_type = other DNA
ggcgcgccagtccttacagttaagtctgacatttctgacatttctgacattactcccatttctgacattactcccatttctgacatttctgacatttctgacatttctgacatttctgacatttctgacatttctgacatttctgacatttctgacattactcccatttctgacattactcccatttccgactcggaccgatg

SEQ ID NO: 16299 - DNA, 203 bp, Homo sapiens
  source 1..203: mol_type = other DNA
ggcgcgccagtcctatccttgccatctgacatttctgacatttctgacattactcccatttctgacatttctgacatttctgacattactcccatttctgacattactcccatttctgacattactcccatttctgacattactcccatttctgacattactcccatttctgacattactcccatttccgactcggaccgatg

SEQ ID NO: 16300 - DNA, 203 bp, Homo sapiens
  source 1..203: mol_type = other DNA
ggcgcgccagtcctatcaaaggattctgacatttctgacatttctgacattactcccatttctgacatttctgacatttctgacattactcccatttctgacattactcccatttctgacattactcccatttctgacattactcccatttctgacattactcccatttctgacatttctgacatttccgactcggaccgatg

SEQ ID NO: 16301 - DNA, 203 bp, Homo sapiens
  source 1..203: mol_type = other DNA
ggcgcgccagtcctctagtgagtttctgacatttctgacatttctgacattactcccatttctgacatttctgacatttctgacattactcccatttctgacattactcccatttctgacattactcccatttctgacattactcccatttctgacatttctgacatttctgacattactcccatttccgactcggaccgatg

SEQ ID NO: 16302 - DNA, 203 bp, Homo sapiens
  source 1..203: mol_type = other DNA
ggcgcgccagtcctcagcagagcatctgacatttctgacatttctgacattactcccatttctgacatttctgacatttctgacattactcccatttctgacattactcccatttctgacattactcccatttctgacatttctgacatttctgacattactcccatttctgacattactcccatttccgactcggaccgatg

SEQ ID NO: 16303 - DNA, 203 bp, Homo sapiens
  source 1..203: mol_type = other DNA
ggcgcgccagtcctccagtgagaatctgacatttctgacatttctgacattactcccatttctgacatttctgacatttctgacattactcccatttctgacattactcccatttctgacatttctgacatttctgacattactcccatttctgacattactcccatttctgacattactcccatttccgactcggaccgatg

SEQ ID NO: 16304 - DNA, 203 bp, Homo sapiens
  source 1..203: mol_type = other DNA
ggcgcgccagtcctagatacactatctgacatttctgacatttctgacattactcccatttctgacatttctgacatttctgacattactcccatttctgacattactcccatttctgacatttctgacatttctgacattactcccatttctgacatttctgacatttctgacattactcccatttccgactcggaccgatg

SEQ ID NO: 16305 - DNA, 203 bp, Homo sapiens
  source 1..203: mol_type = other DNA
ggcgcgccagtcctatcacaaaggtctgacatttctgacatttctgacattactcccatttctgacatttctgacatttctgacattactcccatttctgacattactcccatttctgacatttctgacatttctgacatttctgacatttctgacattactcccatttctgacatttctgacatttccgactcggaccgatg

SEQ ID NO: 16306 - DNA, 203 bp, Homo sapiens
  source 1..203: mol_type = other DNA
ggcgcgccagtcctacctgttcgttctgacatttctgacatttctgacattactcccatttctgacatttctgacatttctgacattactcccatttctgacatttctgacatttctgacattactcccatttctgacattactcccatttctgacattactcccatttctgacatttctgacatttccgactcggaccgatg

SEQ ID NO: 16307 - DNA, 203 bp, Homo sapiens
  source 1..203: mol_type = other DNA
ggcgcgccagtcctatccactgtttctgacatttctgacatttctgacattactcccatttctgacatttctgacatttctgacattactcccatttctgacatttctgacatttctgacattactcccatttctgacatttctgacatttctgacattactcccatttctgacattactcccatttccgactcggaccgatg

SEQ ID NO: 16308 - DNA, 203 bp, Homo sapiens
  source 1..203: mol_type = other DNA
ggcgcgccagtcctcctttacaggtctgacatttctgacatttctgacattactcccatttctgacatttctgacatttctgacattactcccatttctgacatttctgacatttctgacattactcccatttctgacatttctgacatttctgacatttctgacatttctgacattactcccatttccgactcggaccgatg

SEQ ID NO: 16309 - DNA, 203 bp, Homo sapiens
  source 1..203: mol_type = other DNA
ggcgcgccagtcctcctgatcatttctgacatttctgacatttctgacattactcccatttctgacatttctgacatttctgacattactcccatttctgacatttctgacatttctgacatttctgacatttctgacattactcccatttctgacattactcccatttctgacattactcccatttccgactcggaccgatg

SEQ ID NO: 16310 - DNA, 203 bp, Homo sapiens
  source 1..203: mol_type = other DNA
ggcgcgccagtcctcctttctgattctgacatttctgacatttctgacattactcccatttctgacatttctgacatttctgacattactcccatttctgacatttctgacatttctgacatttctgacatttctgacatttctgacatttctgacattactcccatttctgacattactcccatttccgactcggaccgatg

SEQ ID NO: 16311 - DNA, 203 bp, Homo sapiens
  source 1..203: mol_type = other DNA
ggcgcgccagtcctctcactctgatctgacatttctgacatttctgacattactcccatttctgacatttctgacatttctgacattactcccatttctgacatttctgacatttctgacatttctgacatttctgacatttctgacatttctgacatttctgacatttctgacattactcccatttccgactcggaccgatg

SEQ ID NO: 16312 - DNA, 203 bp, Homo sapiens
  source 1..203: mol_type = other DNA
ggcgcgccagtcctatcagagatttctgacatttctgacatttctgacattactcccatttctgacatttctgacatttctgacattactcccatttctgacatttctgacatttctgacatttctgacatttctgacatttctgacatttctgacatttctgacatttctgacatttctgacatttccgactcggaccgatg

SEQ ID NO: 16313 - DNA, 203 bp, Homo sapiens
  source 1..203: mol_type = other DNA
ggcgcgccagtcctatgaccagattctgacatttctgacatttctgacattactcccatttctgacatttctgacatttctgacatttctgacatttctgacattactcccatttctgacattactcccatttctgacattactcccatttctgacattactcccatttctgacattactcccatttccgactcggaccgatg

SEQ ID NO: 16314 - DNA, 203 bp, Homo sapiens
  source 1..203: mol_type = other DNA
ggcgcgccagtcctcaagattctatctgacatttctgacatttctgacattactcccatttctgacatttctgacatttctgacatttctgacatttctgacattactcccatttctgacattactcccatttctgacattactcccatttctgacattactcccatttctgacatttctgacatttccgactcggaccgatg

SEQ ID NO: 16315 - DNA, 203 bp, Homo sapiens
  source 1..203: mol_type = other DNA
ggcgcgccagtcctaacgcttacttctgacatttctgacatttctgacattactcccatttctgacatttctgacatttctgacatttctgacatttctgacattactcccatttctgacattactcccatttctgacatttctgacatttctgacattactcccatttctgacatttctgacatttccgactcggaccgatg

SEQ ID NO: 16316 - DNA, 203 bp, Homo sapiens
  source 1..203: mol_type = other DNA
ggcgcgccagtcctccaaaagatttctgacatttctgacatttctgacattactcccatttctgacatttctgacatttctgacatttctgacatttctgacattactcccatttctgacatttctgacatttctgacattactcccatttctgacattactcccatttctgacattactcccatttccgactcggaccgatg

SEQ ID NO: 16317 - DNA, 203 bp, Homo sapiens
  source 1..203: mol_type = other DNA
ggcgcgccagtcctttaagttttgtctgacatttctgacatttctgacattactcccatttctgacatttctgacatttctgacatttctgacatttctgacattactcccatttctgacatttctgacatttctgacattactcccatttctgacatttctgacatttctgacattactcccatttccgactcggaccgatg

SEQ ID NO: 16318 - DNA, 203 bp, Homo sapiens
  source 1..203: mol_type = other DNA
ggcgcgccagtccttgcttactgttctgacatttctgacatttctgacattactcccatttctgacatttctgacatttctgacatttctgacatttctgacattactcccatttctgacatttctgacatttctgacatttctgacatttctgacatttctgacatttctgacattactcccatttccgactcggaccgatg

SEQ ID NO: 16319 - DNA, 203 bp, Homo sapiens
  source 1..203: mol_type = other DNA
ggcgcgccagtccttggtaggatatctgacatttctgacatttctgacattactcccatttctgacatttctgacatttctgacatttctgacatttctgacattactcccatttctgacatttctgacatttctgacatttctgacatttctgacatttctgacatttctgacatttctgacatttccgactcggaccgatg

SEQ ID NO: 16320 - DNA, 203 bp, Homo sapiens
  source 1..203: mol_type = other DNA
ggcgcgccagtccttctttgagcttctgacatttctgacatttctgacattactcccatttctgacatttctgacatttctgacatttctgacatttctgacatttctgacatttctgacattactcccatttctgacattactcccatttctgacattactcccatttctgacattactcccatttccgactcggaccgatg

SEQ ID NO: 16321 - DNA, 203 bp, Homo sapiens
  source 1..203: mol_type = other DNA
ggcgcgccagtcctctcaaaactatctgacatttctgacatttctgacattactcccatttctgacatttctgacatttctgacatttctgacatttctgacatttctgacatttctgacattactcccatttctgacattactcccatttctgacatttctgacatttctgacattactcccatttccgactcggaccgatg

SEQ ID NO: 16322 - DNA, 203 bp, Homo sapiens
  source 1..203: mol_type = other DNA
ggcgcgccagtcctaatacagcgatctgacatttctgacatttctgacattactcccatttctgacatttctgacatttctgacatttctgacatttctgacatttctgacatttctgacattactcccatttctgacattactcccatttctgacatttctgacatttctgacatttctgacatttccgactcggaccgatg

SEQ ID NO: 16323 - DNA, 203 bp, Homo sapiens
  source 1..203: mol_type = other DNA
ggcgcgccagtccttcatggtttttctgacatttctgacatttctgacattactcccatttctgacatttctgacatttctgacatttctgacatttctgacatttctgacatttctgacattactcccatttctgacatttctgacatttctgacattactcccatttctgacattactcccatttccgactcggaccgatg

SEQ ID NO: 16324 - DNA, 203 bp, Homo sapiens
  source 1..203: mol_type = other DNA
ggcgcgccagtcctctgagaacaatctgacatttctgacatttctgacattactcccatttctgacatttctgacatttctgacatttctgacatttctgacatttctgacatttctgacatttctgacatttctgacatttctgacatttctgacatttctgacatttctgacattactcccatttccgactcggaccgatg

SEQ ID NO: 16325 - DNA, 203 bp, Homo sapiens
  source 1..203: mol_type = other DNA
ggcgcgccagtccttgttactggatctgacatttctgacatttctgacattactcccatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16326 - DNA, 203 bp, Homo sapiens
  source 1..203: mol_type = other DNA
ggcgcgccagtcctcttgcacaaatctgacatttctgacatttctgacattaggagcgagcgaccaaaggaaccataactgatttaatgagccattcgcagtttcactgtaccggccgtgcgtactcagacatgcatggcttaatctttgagacaagcatatgctactggcaggatctctgacatttccgactcggaccgatg

SEQ ID NO: 16327 - DNA, 203 bp, Homo sapiens
  source 1..203: mol_type = other DNA
ggcgcgccagtccttccatgagagtctgacatttctgacatttctgacattccggcgggttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16328 - DNA, 203 bp, Homo sapiens
  source 1..203: mol_type = other DNA
ggcgcgccagtcctagtccatggatctgacatttctgacatttctgacattccggcgggttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16329 - DNA, 203 bp, Homo sapiens
  source 1..203: mol_type = other DNA
ggcgcgccagtcctcaagtaactgtctgacatttctgacatttctgacattcgtcaattcctttacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 16330 - DNA, 203 bp, Homo sapiens
  source 1..203: mol_type = other DNA
ggcgcgccagtcctacgcttactttctgacatttctgacatttctgacattcttggcaaatctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16331 - DNA, 203 bp, Homo sapiens
  source 1..203: mol_type = other DNA
ggcgcgccagtcctaaccgttaggtctgacatttctgacatttctgacatttacgacggtatctgatcgtcttcgaacctccgactttcgttcttgattaatgaaaacattcttggcaaatgctttcgctctggtccgtcttgcgccggtccaagaatttcacctctagcggcgcattctgacatttccgactcggaccgatg

SEQ ID NO: 16332 - DNA, 203 bp, Homo sapiens
  source 1..203: mol_type = other DNA
ggcgcgccagtcctcactcagtcttctgacatttctgacatttctgacatttaggctccactcctggtggtgcccttccgtcaattcctttaagtttcagctttgcaaccatactccccccggaacccaaagactttggtttcccggaagctgcccggcgggtcatgggaataacgttctgacatttccgactcggaccgatg

SEQ ID NO: 16333 - DNA, 203 bp, Homo sapiens
  source 1..203: mol_type = other DNA
ggcgcgccagtcctactcagtgcatctgacatttctgacatttctgacatttcaccggccgttgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16334 - DNA, 203 bp, Homo sapiens
  source 1..203: mol_type = other DNA
ggcgcgccagtcctaaactgagattctgacatttctgacatttctgacatttcaccggccgttgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16335 - DNA, 203 bp, Homo sapiens
  source 1..203: mol_type = other DNA
ggcgcgccagtcctaacctcagtttctgacatttctgacatttctgacatttcaccggccgttgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16336 - DNA, 203 bp, Homo sapiens
  source 1..203: mol_type = other DNA
ggcgcgccagtcctctttgaggtctctgacatttctgacatttctgacatttcccggcgggttgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16337 - DNA, 203 bp, Homo sapiens
  source 1..203: mol_type = other DNA
ggcgcgccagtcctgaaaggtccttctgacatttctgacatttctgacatttcccggcgggttgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 16338 - DNA, 203 bp, Homo sapiens
  source 1..203: mol_type = other DNA
ggcgcgccagtcctaacgagcgtctctgacatttctgacatttctgacatttcccggcgggttgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16339 - DNA, 203 bp, Homo sapiens
  source 1..203: mol_type = other DNA
ggcgcgccagtcctgagaccgacttctgacatttctgacatttctgacatttcggaattaaccagacaaatcgctccaccaactaagaacggccatgcaccaccacccacggaatcgagaaagagctatcaatctgtcaatcctgtccgtgtccgggccgggtgaggtttcccgtgttctgacatttccgactcggaccgatg

SEQ ID NO: 16340 - DNA, 203 bp, Homo sapiens
  source 1..203: mol_type = other DNA
ggcgcgccagtcctgaccggtcattctgacatttctgacatttctgacatttctgaattaaccagacaaatcgctccaccaactaagaacggccatgcaccaccacccacggaatcgagaaagagctatcaatctgtcaatcctgtccgtgtccgggccgggtgaggtttccccatttctgacatttccgactcggaccgatg

SEQ ID NO: 16341 - DNA, 203 bp, Homo sapiens
  source 1..203: mol_type = other DNA
ggcgcgccagtcctgaaccttgcttctgacatttctgacatttctgacatttctgacaaccggccgttttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16342 - DNA, 203 bp, Homo sapiens
  source 1..203: mol_type = other DNA
ggcgcgccagtcctgagctgtatctctgacatttctgacatttctgacatttctgacacgtcaattcctttagacatttctgacatttctgacatttctgacatttctgacatttctgacatttctgacatttctgacatttctgacatttctgacatttctgacatttctgacattttcttggcaaacgactcggaccgatg

SEQ ID NO: 16343 - DNA, 203 bp, Homo sapiens
  source 1..203: mol_type = other DNA
ggcgcgccagtcctgagttaccgttctgacatttctgacatttctgacatttctgacatactcctggtggtgcccttccgtcaattcctttaagtttcagctttgcaaccatactccccccggaacccaaagactttggtttcccggaagctgcccggcgggtcatgggctgacatttctgacatttccgactcggaccgatg

SEQ ID NO: 16344 - DNA, 203 bp, Homo sapiens
  source 1..203: mol_type = other DNA
ggcgcgccagtcctacgacctctctctgacatttctgacatttctgacatttctgacatgcgaccaaaggaaccataactgatttaatgagccattcgcagtttcactgtaccggccgtgcgtactcagacatgcatggcttaatctttgagacaagcatatgctactgctgacatttctgacatttccgactcggaccgatg

SEQ ID NO: 16345 - DNA, 203 bp, Homo sapiens
  source 1..203: mol_type = other DNA
ggcgcgccagtcctgacctctgcttctgacatttctgacatttctgacatttctgacattaccagacaaatcgctccaccaactaagaacggccatgcaccaccacccacggaatcgagaaagagctatcaatctgtcaatcctgtccgtgtccgggccgggtgaggttctgacatttctgacatttccgactcggaccgatg

SEQ ID NO: 16346 - DNA, 203 bp, Homo sapiens
  source 1..203: mol_type = other DNA
ggcgcgccagtcctgactcagagatctgacatttctgacatttctgacatttctgacattaccggccgttctgacatttctgacatttctgacatttctgacatttctgacatttctgacatttctgacatttctgacatttctgacatttctgacatttctgacatttctgacatttctgacatttccgactcggaccgatg

SEQ ID NO: 16347 - DNA, 203 bp, Homo sapiens
  source 1..203: mol_type = other DNA
ggcgcgccagtcctgacggtcatttctgacatttctgacatttctgacatttctgacattaccggccgttctgacatttctgacatttctgacatttctgacatttctgacatttctgacatttctgacatttctgacatttctgacatttctgacatttctgacatttctgacatttctgtactccccgactcggaccgatg

SEQ ID NO: 16348 - DNA, 203 bp, Homo sapiens
  source 1..203: mol_type = other DNA
ggcgcgccagtcctgagcagctcatctgacatttctgacatttctgacatttctgacattcacggaatcgagaacatttctgacatttctgacatttctgacatttctgacatttctgacatttctgacatttctgacatttctgacatttctgacatttctgacatttctgacatttcccggcgggtcgactcggaccgatg

SEQ ID NO: 16349 - DNA, 203 bp, Homo sapiens
  source 1..203: mol_type = other DNA
ggcgcgccagtcctacggtcatgatctgacatttctgacatttctgacatttctgacattccggcgggttctgacatttctgacatttctgacatttctgacatttctgacatttctgacatttctgacatttctgacatttctgacatttctgacatttctgacatttctgacatttctgtactccccgactcggaccgatg

SEQ ID NO: 16350 - DNA, 203 bp, Homo sapiens
  source 1..203: mol_type = other DNA
ggcgcgccagtccttggattctgttctgacatttctgacatttctgacatttctgacattccggcgggttctgacatttctgacatttctgacatttctgacatttctgacatttctgacatttctgacatttctgacatttctgacatttctgacatttctgacatttctgaccacggaatcgagaacgactcggaccgatg

SEQ ID NO: 16351 - DNA, 203 bp, Homo sapiens
  source 1..203: mol_type = other DNA
ggcgcgccagtcctcagaagagtctctgacatttctgacatttctgacatttctgacattcgtcaattcctttacatttctgacatttctgacatttctgacatttctgacatttctgacatttctgacatttctgacatttctgacatttctgacatttctgacatttctgacatttcccggcgggtcgactcggaccgatg

SEQ ID NO: 16352 - DNA, 203 bp, Homo sapiens
  source 1..203: mol_type = other DNA
ggcgcgccagtcctttgagtgagttctgacatttctgacatttctgacatttctgacattcttggcaaatctgacatttctgacatttctgacatttctgacatttctgacatttctgacatttctgacatttctgacatttctgacatttctgacatttctgacatttctgacatttctgacatttccgactcggaccgatg

SEQ ID NO: 16353 - DNA, 203 bp, Homo sapiens
  source 1..203: mol_type = other DNA
ggcgcgccagtcctgaacagtctctctgacatttctgacatttctgacatttctgacattcttggcaaatctgacatttctgacatttctgacatttctgacatttctgacatttctgacatttctgacatttctgacatttctgacatttctgacatttctgacatttctgaccgtcaattcctttacgactcggaccgatg

SEQ ID NO: 16354 - DNA, 203 bp, Homo sapiens
  source 1..203: mol_type = other DNA
ggcgcgccagtcctagagtagtcatctgacatttctgacatttctgacatttctgacatttactccctttctgacatttctgacatttctgacatttctgacatttctgacatttctgacatttctgacatttctgacatttctgacatttctgacatttctgacatttctgacatttcaccggccgtcgactcggaccgatg

SEQ ID NO: 16355 - DNA, 203 bp, Homo sapiens
  source 1..203: mol_type = other DNA
ggcgcgccagtcctttaactagtttctgacatttctgacatttctgacatttctgacatttccgtcaattcctttatttctgacatttctgacatttctgacatttctgacatttctgacatttctgacatttctgacatttctgacatttctgacatttctgacatttctgacatttctgtactccccgactcggaccgatg

SEQ ID NO: 16356 - DNA, 203 bp, Homo sapiens
  source 1..203: mol_type = other DNA
ggcgcgccagtccttgactactcatctgacatttctgacatttctgacatttctgacatttctagacaaatcgctccaccaactaagaacggccatgcaccaccacccacggaatcgagaaagagctatcaatctgtcaatcctgtccgtgtccgggccgggtgaatttctgacatttctgacatttccgactcggaccgatg

SEQ ID NO: 16357 - DNA, 203 bp, Homo sapiens
  source 1..203: mol_type = other DNA
ggcgcgccagtcctttcaagaagttctgacatttctgacatttctgacatttctgacatttctccaaaggaaccataactgatttaatgagccattcgcagtttcactgtaccggccgtgcgtactcagacatgcatggcttaatctttgagacaagcatatgctatttctgacatttctgacatttccgactcggaccgatg

SEQ ID NO: 16358 - DNA, 203 bp, Homo sapiens
  source 1..203: mol_type = other DNA
ggcgcgccagtcctctacttaacatctgacatttctgacatttctgacatttctgacatttctccggcgggtgacatttctgacatttctgacatttctgacatttctgacatttctgacatttctgacatttctgacatttctgacatttctgacatttctgacatttctgacattttcttggcaaacgactcggaccgatg

SEQ ID NO: 16359 - DNA, 203 bp, Homo sapiens
  source 1..203: mol_type = other DNA
ggcgcgccagtccttgagtagagttctgacatttctgacatttctgacatttctgacatttctgaaccggccgtcatttctgacatttctgacatttctgacatttctgacatttctgacatttctgacatttctgacatttctgacatttctgacatttctgacatttctgacatttcccggcgggtcgactcggaccgatg

SEQ ID NO: 16360 - DNA, 203 bp, Homo sapiens
  source 1..203: mol_type = other DNA
ggcgcgccagtcctcctactactttctgacatttctgacatttctgacatttctgacatttctgaagtcaaattaagccgcaggctccactcctggtggtgcccttccgtcaattcctttaagtttcagctttgcaaccatactccccccggaacccaaagacacatttctgacatttctgacatttccgactcggaccgatg

SEQ ID NO: 16361 - DNA, 203 bp, Homo sapiens
  source 1..203: mol_type = other DNA
ggcgcgccagtcctctctgaagtttctgacatttctgacatttctgacatttctgacatttctgacaaccggccgttttctgacatttctgacatttctgacatttctgacatttctgacatttctgacatttctgacatttctgacatttctgacatttctgacatttctgaccacggaatcgagaacgactcggaccgatg

SEQ ID NO: 16362 - DNA, 203 bp, Homo sapiens
  source 1..203: mol_type = other DNA
ggcgcgccagtcctaacttctctatctgacatttctgacatttctgacatttctgacatttctgacacacggaatcgagaagacatttctgacatttctgacatttctgacatttctgacatttctgacatttctgacatttctgacatttctgacatttctgacatttctgacatttcaccggccgtcgactcggaccgatg

SEQ ID NO: 16363 - DNA, 203 bp, Homo sapiens
  source 1..203: mol_type = other DNA
ggcgcgccagtcctaggtctgttgtctgacatttctgacatttctgacatttctgacatttctgacaccggcgggttttctgacatttctgacatttctgacatttctgacatttctgacatttctgacatttctgacatttctgacatttctgacatttctgacatttctgaccgtcaattcctttacgactcggaccgatg

SEQ ID NO: 16364 - DNA, 203 bp, Homo sapiens
  source 1..203: mol_type = other DNA
ggcgcgccagtcctccaacaggcttctgacatttctgacatttctgacatttctgacatttctgacacggaatcgagaactgacatttctgacatttctgacatttctgacatttctgacatttctgacatttctgacatttctgacatttctgacatttctgacatttctgacattttcttggcaaacgactcggaccgatg

SEQ ID NO: 16365 - DNA, 203 bp, Homo sapiens
  source 1..203: mol_type = other DNA
ggcgcgccagtccttagttaagaatctgacatttctgacatttctgacatttctgacatttctgacacgtcaattcctttagacatttctgacatttctgacatttctgacatttctgacatttctgacatttctgacatttctgacatttctgacatttctgacatttctgacatttcccggcgggtcgactcggaccgatg

SEQ ID NO: 16366 - DNA, 203 bp, Homo sapiens
  source 1..203: mol_type = other DNA
ggcgcgccagtccttagatacaagtctgacatttctgacatttctgacatttctgacatttctgacataccggccgtttctgacataccggccgtttctgacataccggccgtttctgacataccggccgtttctgacataccggccgtttctgacataccggccgtttctgacatttctgacatttccgactcggaccgatg

SEQ ID NO: 16367 - DNA, 203 bp, Homo sapiens
  source 1..203: mol_type = other DNA
ggcgcgccagtcctacaaagtacttctgacatttctgacatttctgacatttctgacatttctgacataccggccgtttctgacataccggccgtttctgacataccggccgtttctgacataccggccgtttctgacatttctgacatttctgacataccggccgtttctgacataccggccgtttccgactcggaccgatg

SEQ ID NO: 16368 - DNA, 203 bp, Homo sapiens
  source 1..203: mol_type = other DNA
ggcgcgccagtcctaaagtaccattctgacatttctgacatttctgacatttctgacatttctgacataccggccgtttctgacataccggccgtttctgacataccggccgtttctgacatttctgacatttctgacataccggccgtttctgacatttctgacatttctgacataccggccgtttccgactcggaccgatg

SEQ ID NO: 16369 - DNA, 203 bp, Homo sapiens
  source 1..203: mol_type = other DNA
ggcgcgccagtcctactgctttggtctgacatttctgacatttctgacatttctgacatttctgacataccggccgtttctgacataccggccgtttctgacatttctgacatttctgacataccggccgtttctgacataccggccgtttctgacataccggccgtttctgacatttctgacatttccgactcggaccgatg

SEQ ID NO: 16370 - DNA, 203 bp, Homo sapiens
  source 1..203: mol_type = other DNA
ggcgcgccagtcctaacctttggttctgacatttctgacatttctgacatttctgacatttctgacataccggccgtttctgacataccggccgtttctgacatttctgacatttctgacataccggccgtttctgacataccggccgtttctgacatttctgacatttctgacataccggccgtttccgactcggaccgatg

SEQ ID NO: 16371 - DNA, 203 bp, Homo sapiens
  source 1..203: mol_type = other DNA
ggcgcgccagtcctcaactacaggtctgacatttctgacatttctgacatttctgacatttctgacataccggccgtttctgacataccggccgtttctgacatttctgacatttctgacataccggccgtttctgacatttctgacatttctgacataccggccgtttctgacatttctgacatttccgactcggaccgatg

SEQ ID NO: 16372 - DNA, 203 bp, Homo sapiens
  source 1..203: mol_type = other DNA
ggcgcgccagtcctgagctactcttctgacatttctgacatttctgacatttctgacatttctgacataccggccgtttctgacataccggccgtttctgacatttctgacatttctgacataccggccgtttctgacatttctgacatttctgacatttctgacatttctgacataccggccgtttccgactcggaccgatg

SEQ ID NO: 16373 - DNA, 203 bp, Homo sapiens
  source 1..203: mol_type = other DNA
ggcgcgccagtcctagtccaggtttctgacatttctgacatttctgacatttctgacatttctgacataccggccgtttctgacataccggccgtttctgacatttctgacatttctgacataccggccgtttctgacatttctgacatttctgacatttctgacatttctgacatttctgacatttccgactcggaccgatg

SEQ ID NO: 16374 - DNA, 203 bp, Homo sapiens
  source 1..203: mol_type = other DNA
ggcgcgccagtcctaaaagtacattctgacatttctgacatttctgacatttctgacatttctgacataccggccgtttctgacataccggccgtttctgacatttctgacatttctgacatttctgacatttctgacatttctgacatttctgacataccggccgtttctgacataccggccgtttccgactcggaccgatg

SEQ ID NO: 16375 - DNA, 203 bp, Homo sapiens
  source 1..203: mol_type = other DNA
ggcgcgccagtcctacgactgttctctgacatttctgacatttctgacatttctgacatttctgacataccggccgtttctgacataccggccgtttctgacatttctgacatttctgacatttctgacatttctgacatttctgacatttctgacataccggccgtttctgacatttctgacatttccgactcggaccgatg

SEQ ID NO: 16376 - DNA, 203 bp, Homo sapiens
  source 1..203: mol_type = other DNA
ggcgcgccagtcctgaatctggtgtctgacatttctgacatttctgacatttctgacatttctgacataccggccgtttctgacataccggccgtttctgacatttctgacatttctgacatttctgacatttctgacatttctgacatttctgacatttctgacatttctgacataccggccgtttccgactcggaccgatg

SEQ ID NO: 16377 - DNA, 203 bp, Homo sapiens
  source 1..203: mol_type = other DNA
ggcgcgccagtcctcacagtggtttctgacatttctgacatttctgacatttctgacatttctgacataccggccgtttctgacatttctgacatttctgacataccggccgtttctgacataccggccgtttctgacataccggccgtttctgacatttctgacatttctgacataccggccgtttccgactcggaccgatg

SEQ ID NO: 16378 - DNA, 203 bp, Homo sapiens
  source 1..203: mol_type = other DNA
ggcgcgccagtcctagtggtgctgtctgacatttctgacatttctgacatttctgacatttctgacataccggccgtttctgacatttctgacatttctgacataccggccgtttctgacataccggccgtttctgacatttctgacatttctgacataccggccgtttctgacataccggccgtttccgactcggaccgatg

SEQ ID NO: 16379 - DNA, 203 bp, Homo sapiens
  source 1..203: mol_type = other DNA
ggcgcgccagtccttgaccacttctctgacatttctgacatttctgacatttctgacatttctgacataccggccgtttctgacatttctgacatttctgacataccggccgtttctgacataccggccgtttctgacatttctgacatttctgacataccggccgtttctgacatttctgacatttccgactcggaccgatg

SEQ ID NO: 16380 - DNA, 203 bp, Homo sapiens
  source 1..203: mol_type = other DNA
ggcgcgccagtcctcaagagtggttctgacatttctgacatttctgacatttctgacatttctgacataccggccgtttctgacatttctgacatttctgacataccggccgtttctgacataccggccgtttctgacatttctgacatttctgacatttctgacatttctgacataccggccgtttccgactcggaccgatg

SEQ ID NO: 16381 - DNA, 203 bp, Homo sapiens
  source 1..203: mol_type = other DNA
ggcgcgccagtccttcaagttctttctgacatttctgacatttctgacatttctgacatttctgacataccggccgtttctgacatttctgacatttctgacataccggccgtttctgacatttctgacatttctgacataccggccgtttctgacatttctgacatttctgacataccggccgtttccgactcggaccgatg

SEQ ID NO: 16382 - DNA, 203 bp, Homo sapiens
  source 1..203: mol_type = other DNA
ggcgcgccagtcctttgtaccagttctgacatttctgacatttctgacatttctgacatttctgacataccggccgtttctgacatttctgacatttctgacataccggccgtttctgacatttctgacatttctgacataccggccgtttctgacatttctgacatttctgacatttctgacatttccgactcggaccgatg

SEQ ID NO: 16383 - DNA, 203 bp, Homo sapiens
  source 1..203: mol_type = other DNA
ggcgcgccagtcctttggtgactgtctgacatttctgacatttctgacatttctgacatttctgacataccggccgtttctgacatttctgacatttctgacataccggccgtttctgacatttctgacatttctgacatttctgacatttctgacataccggccgtttctgacatttctgacatttccgactcggaccgatg

SEQ ID NO: 16384 - DNA, 203 bp, Homo sapiens
  source 1..203: mol_type = other DNA
ggcgcgccagtcctagagctctggtctgacatttctgacatttctgacatttctgacatttctgacataccggccgtttctgacatttctgacatttctgacataccggccgtttctgacatttctgacatttctgacatttctgacatttctgacatttctgacatttctgacataccggccgtttccgactcggaccgatg

SEQ ID NO: 16385 - DNA, 203 bp, Homo sapiens
  source 1..203: mol_type = other DNA
ggcgcgccagtcctatgagtacgttctgacatttctgacatttctgacatttctgacatttctgacataccggccgtttctgacatttctgacatttctgacatttctgacatttctgacataccggccgtttctgacataccggccgtttctgacataccggccgtttctgacatttctgacatttccgactcggaccgatg

SEQ ID NO: 16386 - DNA, 203 bp, Homo sapiens
  source 1..203: mol_type = other DNA
ggcgcgccagtcctacgtactcgttctgacatttctgacatttctgacatttctgacatttctgacataccggccgtttctgacatttctgacatttctgacatttctgacatttctgacataccggccgtttctgacatttctgacatttctgacataccggccgtttctgacataccggccgtttccgactcggaccgatg

SEQ ID NO: 16387 - DNA, 203 bp, Homo sapiens
  source 1..203: mol_type = other DNA
ggcgcgccagtcctttcaaccggttctgacatttctgacatttctgacatttctgacatttctgacataccggccgtttctgacatttctgacatttctgacatttctgacatttctgacataccggccgtttctgacatttctgacatttctgacataccggccgtttctgacatttctgacatttccgactcggaccgatg

SEQ ID NO: 16388 - DNA, 203 bp, Homo sapiens
  source 1..203: mol_type = other DNA
ggcgcgccagtcctccatgaagattctgacatttctgacatttctgacatttctgacatttctgacataccggccgtttctgacatttctgacatttctgacatttctgacatttctgacatttctgacatttctgacataccggccgtttctgacataccggccgtttctgacataccggccgtttccgactcggaccgatg

SEQ ID NO: 16389 - DNA, 203 bp, Homo sapiens
  source 1..203: mol_type = other DNA
ggcgcgccagtccttgaatcttcatctgacatttctgacatttctgacatttctgacatttctgacataccggccgtttctgacatttctgacatttctgacatttctgacatttctgacatttctgacatttctgacataccggccgtttctgacatttctgacatttctgacataccggccgtttccgactcggaccgatg

SEQ ID NO: 16390 - DNA, 203 bp, Homo sapiens
  source 1..203: mol_type = other DNA
ggcgcgccagtcctttgaaagacttctgacatttctgacatttctgacatttctgacatttctgacataccggccgtttctgacatttctgacatttctgacatttctgacatttctgacatttctgacatttctgacataccggccgtttctgacatttctgacatttctgacatttctgacatttccgactcggaccgatg

SEQ ID NO: 16391 - DNA, 203 bp, Homo sapiens
  source 1..203: mol_type = other DNA
ggcgcgccagtcctttagcctaaatctgacatttctgacatttctgacatttctgacatttctgacataccggccgtttctgacatttctgacatttctgacatttctgacatttctgacatttctgacatttctgacatttctgacatttctgacataccggccgtttctgacataccggccgtttccgactcggaccgatg

SEQ ID NO: 16392 - DNA, 203 bp, Homo sapiens
  source 1..203: mol_type = other DNA
ggcgcgccagtcctacgtagacagtctgacatttctgacatttctgacatttctgacatttctgacataccggccgtttctgacatttctgacatttctgacatttctgacatttctgacatttctgacatttctgacatttctgacatttctgacataccggccgtttctgacatttctgacatttccgactcggaccgatg

SEQ ID NO: 16393 - DNA, 203 bp, Homo sapiens
  source 1..203: mol_type = other DNA
ggcgcgccagtcctactgaccgagtctgacatttctgacatttctgacatttctgacatttctgacatactccccatttctgacatttctgacatttctgacatttctgacatttctgacatttctgacatttctgacatttctgacatttctgacatttctgacatttctgacatttcccggcgggtcgactcggaccgatg

SEQ ID NO: 16394 - DNA, 203 bp, Homo sapiens
  source 1..203: mol_type = other DNA
ggcgcgccagtcctaagctagagttctgacatttctgacatttctgacatttctgacatttctgacatactccccccggaacccaaagactttggtttcccggaagctgcccggcgggtcatgggaataacgccgccgcatcgccggtcggcatcgtttattgacatttctgacatttctgacatttccgactcggaccgatg

SEQ ID NO: 16395 - DNA, 203 bp, Homo sapiens
  source 1..203: mol_type = other DNA
ggcgcgccagtccttggcctgatttctgacatttctgacatttctgacatttctgacatttctgacatcacggaatcgagaaacatcacggaatcgagaaacatcacggaatcgagaaacatcacggaatcgagaaacatttctgacatttctgacatttctgacatttctgacatttctgacatttccgactcggaccgatg

SEQ ID NO: 16396 - DNA, 203 bp, Homo sapiens
  source 1..203: mol_type = other DNA
ggcgcgccagtccttaaaccactatctgacatttctgacatttctgacatttctgacatttctgacatcacggaatcgagaaacatcacggaatcgagaaacatttctgacatttctgacatttctgacatttctgacatcacggaatcgagaaacatttctgacatttctgacatttctgacatttccgactcggaccgatg

SEQ ID NO: 16397 - DNA, 203 bp, Homo sapiens
  source 1..203: mol_type = other DNA
ggcgcgccagtcctactagtggtttctgacatttctgacatttctgacatttctgacatttctgacatcacggaatcgagaaacatcacggaatcgagaaacatttctgacatttctgacatttctgacatttctgacatttctgacatttctgacatcacggaatcgagaaacatttctgacatttccgactcggaccgatg

SEQ ID NO: 16398 - DNA, 203 bp, Homo sapiens
  source 1..203: mol_type = other DNA
ggcgcgccagtcctcctcagcatatctgacatttctgacatttctgacatttctgacatttctgacatcacggaatcgagaaacatttctgacatttctgacatcacggaatcgagaaacatttctgacatttctgacatcacggaatcgagaaacatttctgacatttctgacatttctgacatttccgactcggaccgatg

SEQ ID NO: 16399 - DNA, 203 bp, Homo sapiens
  source 1..203: mol_type = other DNA
ggcgcgccagtcctcaaaggtgtttctgacatttctgacatttctgacatttctgacatttctgacatcacggaatcgagaaacatttctgacatttctgacatttctgacatttctgacatttctgacatttctgacatcacggaatcgagaaacatcacggaatcgagaaacatttctgacatttccgactcggaccgatg

SEQ ID NO: 16400 - DNA, 203 bp, Homo sapiens
  source 1..203: mol_type = other DNA
ggcgcgccagtcctctacaccatgtctgacatttctgacatttctgacatttctgacatttctgacatcacggaatcgagaaacatttctgacatttctgacatttctgacatttctgacatttctgacatttctgacatcacggaatcgagaaacatttctgacatttctgacatttctgacatttccgactcggaccgatg

SEQ ID NO: 16401 - DNA, 203 bp, Homo sapiens
  source 1..203: mol_type = other DNA
ggcgcgccagtcctattcttcatgtctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16402 - DNA, 203 bp, Homo sapiens
  source 1..203: mol_type = other DNA
ggcgcgccagtcctcttactgatctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16403 - DNA, 203 bp, Homo sapiens
  source 1..203: mol_type = other DNA
ggcgcgccagtcctaagagaactctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16404 - DNA, 203 bp, Homo sapiens
  source 1..203: mol_type = other DNA
ggcgcgccagtccttcaactactctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16405 - DNA, 203 bp, Homo sapiens
  source 1..203: mol_type = other DNA
ggcgcgccagtcctcacttgtatctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16406 - DNA, 203 bp, Homo sapiens
  source 1..203: mol_type = other DNA
ggcgcgccagtccttatgaaggtctctgacatttctgacatttctgacatttctgacatttctgacatccggcgggtttctgacatccggcgggtttctgacatccggcgggtttctgacatccggcgggtttctgacatccggcgggtttctgacatccggcgggtttctgacatccggcgggtttccgactcggaccgatg

SEQ ID NO: 16407 - DNA, 203 bp, Homo sapiens
  source 1..203: mol_type = other DNA
ggcgcgccagtcctgagattctgatctgacatttctgacatttctgacatttctgacatttctgacatccggcgggtttctgacatccggcgggtttctgacatccggcgggtttctgacatccggcgggtttctgacatttctgacatttctgacatccggcgggtttctgacatttctgacatttccgactcggaccgatg

SEQ ID NO: 16408 - DNA, 203 bp, Homo sapiens
  source 1..203: mol_type = other DNA
ggcgcgccagtcctttacactgtctctgacatttctgacatttctgacatttctgacatttctgacatccggcgggtttctgacatccggcgggtttctgacatccggcgggtttctgacatccggcgggtttctgacatttctgacatttctgacatttctgacatttctgacatttctgacatttccgactcggaccgatg

SEQ ID NO: 16409 - DNA, 203 bp, Homo sapiens
  source 1..203: mol_type = other DNA
ggcgcgccagtccttgagttgttctctgacatttctgacatttctgacatttctgacatttctgacatccggcgggtttctgacatccggcgggtttctgacatccggcgggtttctgacatttctgacatttctgacatttctgacatttctgacatttctgacatttctgacatccggcgggtttccgactcggaccgatg

SEQ ID NO: 16410 - DNA, 203 bp, Homo sapiens
  source 1..203: mol_type = other DNA
ggcgcgccagtcctgacagtatgatctgacatttctgacatttctgacatttctgacatttctgacatccggcgggtttctgacatccggcgggtttctgacatccggcgggtttctgacatttctgacatttctgacatttctgacatttctgacatttctgacatttctgacatttctgacatttccgactcggaccgatg

SEQ ID NO: 16411 - DNA, 203 bp, Homo sapiens
  source 1..203: mol_type = other DNA
ggcgcgccagtccttaaaggtctctctgacatttctgacatttctgacatttctgacatttctgacatccggcgggtttctgacatccggcgggtttctgacatttctgacatttctgacatccggcgggtttctgacatccggcgggtttctgacatccggcgggtttctgacatttctgacatttccgactcggaccgatg

SEQ ID NO: 16412 - DNA, 203 bp, Homo sapiens
  source 1..203: mol_type = other DNA
ggcgcgccagtcctgacttgtaagtctgacatttctgacatttctgacatttctgacatttctgacatccggcgggtttctgacatccggcgggtttctgacatttctgacatttctgacatccggcgggtttctgacatccggcgggtttctgacatttctgacatttctgacatccggcgggtttccgactcggaccgatg

SEQ ID NO: 16413 - DNA, 203 bp, Homo sapiens
  source 1..203: mol_type = other DNA
ggcgcgccagtcctgactttgacttctgacatttctgacatttctgacatttctgacatttctgacatccggcgggtttctgacatccggcgggtttctgacatttctgacatttctgacatccggcgggtttctgacatccggcgggtttctgacatttctgacatttctgacatttctgacatttccgactcggaccgatg

SEQ ID NO: 16414 - DNA, 203 bp, Homo sapiens
  source 1..203: mol_type = other DNA
ggcgcgccagtcctaactacgttctctgacatttctgacatttctgacatttctgacatttctgacatccggcgggtttctgacatccggcgggtttctgacatttctgacatttctgacatccggcgggtttctgacatttctgacatttctgacatccggcgggtttctgacatccggcgggtttccgactcggaccgatg

SEQ ID NO: 16415 - DNA, 203 bp, Homo sapiens
  source 1..203: mol_type = other DNA
ggcgcgccagtcctgacgtactaatctgacatttctgacatttctgacatttctgacatttctgacatccggcgggtttctgacatccggcgggtttctgacatttctgacatttctgacatccggcgggtttctgacatttctgacatttctgacatccggcgggtttctgacatttctgacatttccgactcggaccgatg

SEQ ID NO: 16416 - DNA, 203 bp, Homo sapiens
  source 1..203: mol_type = other DNA
ggcgcgccagtcctgaccaacttatctgacatttctgacatttctgacatttctgacatttctgacatccggcgggtttctgacatccggcgggtttctgacatttctgacatttctgacatccggcgggtttctgacatttctgacatttctgacatttctgacatttctgacatccggcgggtttccgactcggaccgatg

SEQ ID NO: 16417 - DNA, 203 bp, Homo sapiens
  source 1..203: mol_type = other DNA
ggcgcgccagtcctgaggtagttttctgacatttctgacatttctgacatttctgacatttctgacatccggcgggtttctgacatccggcgggtttctgacatttctgacatttctgacatttctgacatttctgacatccggcgggtttctgacatttctgacatttctgacatccggcgggtttccgactcggaccgatg

SEQ ID NO: 16418 - DNA, 203 bp, Homo sapiens
  source 1..203: mol_type = other DNA
ggcgcgccagtcctgacgttgtattctgacatttctgacatttctgacatttctgacatttctgacatccggcgggtttctgacatccggcgggtttctgacatttctgacatttctgacatttctgacatttctgacatccggcgggtttctgacatttctgacatttctgacatttctgacatttccgactcggaccgatg

SEQ ID NO: 16419 - DNA, 203 bp, Homo sapiens
  source 1..203: mol_type = other DNA
ggcgcgccagtcctcttcacctcttctgacatttctgacatttctgacatttctgacatttctgacatccggcgggtttctgacatccggcgggtttctgacatttctgacatttctgacatttctgacatttctgacatttctgacatttctgacatttctgacatttctgacatccggcgggtttccgactcggaccgatg

SEQ ID NO: 16420 - DNA, 203 bp, Homo sapiens
  source 1..203: mol_type = other DNA
ggcgcgccagtccttttgagtcgttctgacatttctgacatttctgacatttctgacatttctgacatccggcgggtttctgacatttctgacatttctgacatccggcgggtttctgacatccggcgggtttctgacatccggcgggtttctgacatccggcgggtttctgacatccggcgggtttccgactcggaccgatg

SEQ ID NO: 16421 - DNA, 203 bp, Homo sapiens
  source 1..203: mol_type = other DNA
ggcgcgccagtcctaacaggtgagtctgacatttctgacatttctgacatttctgacatttctgacatccggcgggtttctgacatttctgacatttctgacatccggcgggtttctgacatccggcgggtttctgacatttctgacatttctgacatttctgacatttctgacatccggcgggtttccgactcggaccgatg

SEQ ID NO: 16422 - DNA, 203 bp, Homo sapiens
  source 1..203: mol_type = other DNA
ggcgcgccagtcctctgttagaggtctgacatttctgacatttctgacatttctgacatttctgacatccggcgggtttctgacatttctgacatttctgacatccggcgggtttctgacatccggcgggtttctgacatttctgacatttctgacatttctgacatttctgacatttctgacatttccgactcggaccgatg

SEQ ID NO: 16423 - DNA, 203 bp, Homo sapiens
  source 1..203: mol_type = other DNA
ggcgcgccagtcctctctgtgcagtctgacatttctgacatttctgacatttctgacatttctgacatccggcgggtttctgacatttctgacatttctgacatccggcgggtttctgacatttctgacatttctgacatccggcgggtttctgacatccggcgggtttctgacatttctgacatttccgactcggaccgatg

SEQ ID NO: 16424 - DNA, 203 bp, Homo sapiens
  source 1..203: mol_type = other DNA
ggcgcgccagtcctttcagaacgttctgacatttctgacatttctgacatttctgacatttctgacatccggcgggtttctgacatttctgacatttctgacatttctgacatttctgacatccggcgggtttctgacatttctgacatttctgacatccggcgggtttctgacatccggcgggtttccgactcggaccgatg

SEQ ID NO: 16425 - DNA, 203 bp, Homo sapiens
  source 1..203: mol_type = other DNA
ggcgcgccagtcctgaatctcacttctgacatttctgacatttctgacatttctgacatttctgacatccggcgggtttctgacatttctgacatttctgacatttctgacatttctgacatttctgacatttctgacatccggcgggtttctgacatccggcgggtttctgacatccggcgggtttccgactcggaccgatg

SEQ ID NO: 16426 - DNA, 203 bp, Homo sapiens
  source 1..203: mol_type = other DNA
ggcgcgccagtccttcaaggcgtttctgacatttctgacatttctgacatttctgacatttctgacatccggcgggtttctgacatttctgacatttctgacatttctgacatttctgacatttctgacatttctgacatccggcgggtttctgacatttctgacatttctgacatccggcgggtttccgactcggaccgatg

SEQ ID NO: 16427 - DNA, 203 bp, Homo sapiens
  source 1..203: mol_type = other DNA
ggcgcgccagtcctcaagaacatttctgacatttctgacatttctgacatttctgacatttctgacatccggcgggtttctgacatttctgacatttctgacatttctgacatttctgacatttctgacatttctgacatttctgacatttctgacatccggcgggtttctgacatccggcgggtttccgactcggaccgatg

SEQ ID NO: 16428 - DNA, 203 bp, Homo sapiens
  source 1..203: mol_type = other DNA
ggcgcgccagtcctgacgttgaggtctgacatttctgacatttctgacatttctgacatttctgacatccggcgggtttctgacatttctgacatttctgacatttctgacatttctgacatttctgacatttctgacatttctgacatttctgacatccggcgggtttctgacatttctgacatttccgactcggaccgatg

SEQ ID NO: 16429 - DNA, 203 bp, Homo sapiens
  source 1..203: mol_type = other DNA
ggcgcgccagtccttggcctttgatctgacatttctgacatttctgacatttctgacatttctgacatcgtcaattcctttaacatcgtcaattcctttaacatcgtcaattcctttaacatcgtcaattcctttaacatttctgacatttctgacatcgtcaattcctttaacatttctgacatttccgactcggaccgatg

SEQ ID NO: 16430 - DNA, 203 bp, Homo sapiens
  source 1..203: mol_type = other DNA
ggcgcgccagtcctctcaaggccatctgacatttctgacatttctgacatttctgacatttctgacatcgtcaattcctttaacatcgtcaattcctttaacatcgtcaattcctttaacatcgtcaattcctttaacatttctgacatttctgacatttctgacatttctgacatttctgacatttccgactcggaccgatg

SEQ ID NO: 16431 - DNA, 203 bp, Homo sapiens
  source 1..203: mol_type = other DNA
ggcgcgccagtccttccaccgacttctgacatttctgacatttctgacatttctgacatttctgacatcgtcaattcctttaacatcgtcaattcctttaacatcgtcaattcctttaacatttctgacatttctgacatttctgacatttctgacatttctgacatttctgacatttctgacatttccgactcggaccgatg

SEQ ID NO: 16432 - DNA, 203 bp, Homo sapiens
  source 1..203: mol_type = other DNA
ggcgcgccagtcctatggactctatctgacatttctgacatttctgacatttctgacatttctgacatcgtcaattcctttaacatcgtcaattcctttaacatttctgacatttctgacatcgtcaattcctttaacatttctgacatttctgacatttctgacatttctgacatttctgacatttccgactcggaccgatg

SEQ ID NO: 16433 - DNA, 203 bp, Homo sapiens
  source 1..203: mol_type = other DNA
ggcgcgccagtcctttaggactaatctgacatttctgacatttctgacatttctgacatttctgacatcgtcaattcctttaacatcgtcaattcctttaacatttctgacatttctgacatttctgacatttctgacatttctgacatttctgacatttctgacatttctgacatttctgacatttccgactcggaccgatg

SEQ ID NO: 16434 - DNA, 203 bp, Homo sapiens
  source 1..203: mol_type = other DNA
ggcgcgccagtcctacgtttctggtctgacatttctgacatttctgacatttctgacatttctgacatcgtcaattcctttaacatttctgacatttctgacatcgtcaattcctttaacatcgtcaattcctttaacatcgtcaattcctttaacatttctgacatttctgacatttctgacatttccgactcggaccgatg

SEQ ID NO: 16435 - DNA, 203 bp, Homo sapiens
  source 1..203: mol_type = other DNA
ggcgcgccagtcctcagtttctgctctgacatttctgacatttctgacatttctgacatttctgacatcgtcaattcctttaacatttctgacatttctgacatcgtcaattcctttaacatcgtcaattcctttaacatttctgacatttctgacatcgtcaattcctttaacatttctgacatttccgactcggaccgatg

SEQ ID NO: 16436 - DNA, 203 bp, Homo sapiens
  source 1..203: mol_type = other DNA
ggcgcgccagtcctacgatacagctctgacatttctgacatttctgacatttctgacatttctgacatcgtcaattcctttaacatttctgacatttctgacatcgtcaattcctttaacatttctgacatttctgacatcgtcaattcctttaacatcgtcaattcctttaacatttctgacatttccgactcggaccgatg

SEQ ID NO: 16437 - DNA, 203 bp, Homo sapiens
  source 1..203: mol_type = other DNA
ggcgcgccagtcctctctaactgctctgacatttctgacatttctgacatttctgacatttctgacatcgtcaattcctttaacatttctgacatttctgacatcgtcaattcctttaacatttctgacatttctgacatttctgacatttctgacatcgtcaattcctttaacatttctgacatttccgactcggaccgatg

SEQ ID NO: 16438 - DNA, 203 bp, Homo sapiens
  source 1..203: mol_type = other DNA
ggcgcgccagtcctatgaaaaggctctgacatttctgacatttctgacatttctgacatttctgacatcgtcaattcctttaacatttctgacatttctgacatttctgacatttctgacatcgtcaattcctttaacatcgtcaattcctttaacatttctgacatttctgacatttctgacatttccgactcggaccgatg

SEQ ID NO: 16439 - DNA, 203 bp, Homo sapiens
  source 1..203: mol_type = other DNA
ggcgcgccagtcctacctgtaggctctgacatttctgacatttctgacatttctgacatttctgacatcgtcaattcctttaacatttctgacatttctgacatttctgacatttctgacatcgtcaattcctttaacatttctgacatttctgacatttctgacatttctgacatttctgacatttccgactcggaccgatg

SEQ ID NO: 16440 - DNA, 203 bp, Homo sapiens
  source 1..203: mol_type = other DNA
ggcgcgccagtcctctaagagtgctctgacatttctgacatttctgacatttctgacatttctgacatcgtcaattcctttaacatttctgacatttctgacatttctgacatttctgacatttctgacatttctgacatttctgacatttctgacatcgtcaattcctttaacatttctgacatttccgactcggaccgatg

SEQ ID NO: 16441 - DNA, 203 bp, Homo sapiens
  source 1..203: mol_type = other DNA
ggcgcgccagtcctgagactgagctctgacatttctgacatttctgacatttctgacatttctgacattactcccatttctgacattactcccatttctgacattactcccatttctgacattactcccatttctgacatttctgacatttctgacattactcccatttctgacattactcccatttccgactcggaccgatg

SEQ ID NO: 16442 - DNA, 203 bp, Homo sapiens
  source 1..203: mol_type = other DNA
ggcgcgccagtcctcttcagaagctctgacatttctgacatttctgacatttctgacatttctgacattactcccatttctgacattactcccatttctgacattactcccatttctgacattactcccatttctgacatttctgacatttctgacattactcccatttctgacatttctgacatttccgactcggaccgatg

SEQ ID NO: 16443 - DNA, 203 bp, Homo sapiens
  source 1..203: mol_type = other DNA
ggcgcgccagtccttgacgaaagctctgacatttctgacatttctgacatttctgacatttctgacattactcccatttctgacattactcccatttctgacattactcccatttctgacattactcccatttctgacatttctgacatttctgacatttctgacatttctgacattactcccatttccgactcggaccgatg

SEQ ID NO: 16444 - DNA, 203 bp, Homo sapiens
  source 1..203: mol_type = other DNA
ggcgcgccagtcctagaccggtgctctgacatttctgacatttctgacatttctgacatttctgacattactcccatttctgacattactcccatttctgacattactcccatttctgacattactcccatttctgacatttctgacatttctgacatttctgacatttctgacatttctgacatttccgactcggaccgatg

SEQ ID NO: 16445 - DNA, 203 bp, Homo sapiens
  source 1..203: mol_type = other DNA
ggcgcgccagtccttagtttgagctctgacatttctgacatttctgacatttctgacatttctgacattactcccatttctgacattactcccatttctgacattactcccatttctgacatttctgacatttctgacattactcccatttctgacattactcccatttctgacatttctgacatttccgactcggaccgatg

SEQ ID NO: 16446 - DNA, 203 bp, Homo sapiens
  source 1..203: mol_type = other DNA
ggcgcgccagtcctatgcactagctctgacatttctgacatttctgacatttctgacatttctgacattactcccatttctgacattactcccatttctgacattactcccatttctgacatttctgacatttctgacatttctgacatttctgacattactcccatttctgacattactcccatttccgactcggaccgatg

SEQ ID NO: 16447 - DNA, 203 bp, Homo sapiens
  source 1..203: mol_type = other DNA
ggcgcgccagtcctgaacacctgctctgacatttctgacatttctgacatttctgacatttctgacattactcccatttctgacattactcccatttctgacattactcccatttctgacatttctgacatttctgacatttctgacatttctgacatttctgacatttctgacattactcccatttccgactcggaccgatg

SEQ ID NO: 16448 - DNA, 203 bp, Homo sapiens
  source 1..203: mol_type = other DNA
ggcgcgccagtcctgactctcagctctgacatttctgacatttctgacatttctgacatttctgacattactcccatttctgacattactcccatttctgacattactcccatttctgacatttctgacatttctgacatttctgacatttctgacatttctgacatttctgacatttctgacatttccgactcggaccgatg

SEQ ID NO: 16449 - DNA, 203 bp, Homo sapiens
  source 1..203: mol_type = other DNA
ggcgcgccagtcctacacagaggctctgacatttctgacatttctgacatttctgacatttctgacattactcccatttctgacattactcccatttctgacatttctgacatttctgacatttctgacatttctgacattactcccatttctgacattactcccatttctgacatttctgacatttccgactcggaccgatg

SEQ ID NO: 16450 - DNA, 203 bp, Homo sapiens
  source 1..203: mol_type = other DNA
ggcgcgccagtcctgctgagagtatctgacatttctgacatttctgacatttctgacatttctgacattactcccatttctgacattactcccatttctgacatttctgacatttctgacatttctgacatttctgacattactcccatttctgacatttctgacatttctgacatttctgacatttccgactcggaccgatg

SEQ ID NO: 16451 - DNA, 203 bp, Homo sapiens
  source 1..203: mol_type = other DNA
ggcgcgccagtcctgctagtctgttctgacatttctgacatttctgacatttctgacatttctgacattactcccatttctgacattactcccatttctgacatttctgacatttctgacatttctgacatttctgacatttctgacatttctgacatttctgacatttctgacattactcccatttccgactcggaccgatg

SEQ ID NO: 16452 - DNA, 203 bp, Homo sapiens
  source 1..203: mol_type = other DNA
ggcgcgccagtcctgcagtacagctctgacatttctgacatttctgacatttctgacatttctgacattactcccatttctgacatttctgacatttctgacattactcccatttctgacattactcccatttctgacattactcccatttctgacattactcccatttctgacatttctgacatttccgactcggaccgatg

SEQ ID NO: 16453 - DNA, 203 bp, Homo sapiens
  source 1..203: mol_type = other DNA
ggcgcgccagtcctgcaaccgtcatctgacatttctgacatttctgacatttctgacatttctgacattactcccatttctgacatttctgacatttctgacattactcccatttctgacattactcccatttctgacattactcccatttctgacatttctgacatttctgacattactcccatttccgactcggaccgatg

SEQ ID NO: 16454 - DNA, 203 bp, Homo sapiens
  source 1..203: mol_type = other DNA
ggcgcgccagtcctgcttgagctttctgacatttctgacatttctgacatttctgacatttctgacattactcccatttctgacatttctgacatttctgacattactcccatttctgacattactcccatttctgacatttctgacatttctgacattactcccatttctgacatttctgacatttccgactcggaccgatg

SEQ ID NO: 16455 - DNA, 203 bp, Homo sapiens
  source 1..203: mol_type = other DNA
ggcgcgccagtcctgcctcttaagtctgacatttctgacatttctgacatttctgacatttctgacattactcccatttctgacatttctgacatttctgacattactcccatttctgacattactcccatttctgacatttctgacatttctgacatttctgacatttctgacattactcccatttccgactcggaccgatg

SEQ ID NO: 16456 - DNA, 203 bp, Homo sapiens
  source 1..203: mol_type = other DNA
ggcgcgccagtcctgctaagacgatctgacatttctgacatttctgacatttctgacatttctgacattactcccatttctgacatttctgacatttctgacattactcccatttctgacatttctgacatttctgacattactcccatttctgacatttctgacatttctgacatttctgacatttccgactcggaccgatg

SEQ ID NO: 16457 - DNA, 203 bp, Homo sapiens
  source 1..203: mol_type = other DNA
ggcgcgccagtcctgcaacgtttctctgacatttctgacatttctgacatttctgacatttctgacattactcccatttctgacatttctgacatttctgacattactcccatttctgacatttctgacatttctgacatttctgacatttctgacattactcccatttctgacattactcccatttccgactcggaccgatg

SEQ ID NO: 16458 - DNA, 203 bp, Homo sapiens
  source 1..203: mol_type = other DNA
ggcgcgccagtcctgctcgtcaggtctgacatttctgacatttctgacatttctgacatttctgacattactcccatttctgacatttctgacatttctgacattactcccatttctgacatttctgacatttctgacatttctgacatttctgacatttctgacatttctgacattactcccatttccgactcggaccgatg

SEQ ID NO: 16459 - DNA, 203 bp, Homo sapiens
  source 1..203: mol_type = other DNA
ggcgcgccagtcctgcctgaccaatctgacatttctgacatttctgacatttctgacatttctgacattactcccatttctgacatttctgacatttctgacatttctgacatttctgacattactcccatttctgacattactcccatttctgacattactcccatttctgacatttctgacatttccgactcggaccgatg

SEQ ID NO: 16460 - DNA, 203 bp, Homo sapiens
  source 1..203: mol_type = other DNA
ggcgcgccagtcctgcaaaggccttctgacatttctgacatttctgacatttctgacatttctgacattactcccatttctgacatttctgacatttctgacatttctgacatttctgacattactcccatttctgacattactcccatttctgacatttctgacatttctgacatttctgacatttccgactcggaccgatg

SEQ ID NO: 16461 - DNA, 203 bp, Homo sapiens
  source 1..203: mol_type = other DNA
ggcgcgccagtcctgccttcagcttctgacatttctgacatttctgacatttctgacatttctgacattactcccatttctgacatttctgacatttctgacatttctgacatttctgacattactcccatttctgacatttctgacatttctgacatttctgacatttctgacatttctgacatttccgactcggaccgatg

SEQ ID NO: 16462 - DNA, 203 bp, Homo sapiens
  source 1..203: mol_type = other DNA
ggcgcgccagtcctgctgaatggttctgacatttctgacatttctgacatttctgacatttctgacattactcccatttctgacatttctgacatttctgacatttctgacatttctgacatttctgacatttctgacattactcccatttctgacattactcccatttctgacattactcccatttccgactcggaccgatg

SEQ ID NO: 16463 - DNA, 203 bp, Homo sapiens
  source 1..203: mol_type = other DNA
ggcgcgccagtcctgctactctagtctgacatttctgacatttctgacatttctgacatttctgacattactcccatttctgacatttctgacatttctgacatttctgacatttctgacatttctgacatttctgacattactcccatttctgacatttctgacatttctgacattactcccatttccgactcggaccgatg

SEQ ID NO: 16464 - DNA, 203 bp, Homo sapiens
  source 1..203: mol_type = other DNA
ggcgcgccagtcctgctaacctcttctgacatttctgacatttctgacatttctgacatttctgacattactcccatttctgacatttctgacatttctgacatttctgacatttctgacatttctgacatttctgacatttctgacatttctgacattactcccatttctgacatttctgacatttccgactcggaccgatg

SEQ ID NO: 16465 - DNA, 203 bp, Homo sapiens
  source 1..203: mol_type = other DNA
ggcgcgccagtcctgccttactgctctgacatttctgacatttctgacatttctgacatttctgacattactcccatttctgacatttctgacatttctgacatttctgacatttctgacatttctgacatttctgacatttctgacatttctgacatttctgacatttctgacattactcccatttccgactcggaccgatg

SEQ ID NO: 16466 - DNA, 203 bp, Homo sapiens
  source 1..203: mol_type = other DNA
ggcgcgccagtcctgctcaagttgtctgacatttctgacatttctgacatttctgacatttctgacattactcccatttctgacatttctgacatttctgacatttctgacatttctgacatttctgacatttctgacatttctgacatttctgacatttctgacatttctgacatttctgacatttccgactcggaccgatg

SEQ ID NO: 16467 - DNA, 203 bp, Homo sapiens
  source 1..203: mol_type = other DNA
ggcgcgccagtcctgctctgcaagtctgacatttctgacatttctgacatttctgacatttctgacattcacggaatcgagaacatttctgacatttctgacatttctgacatttctgacatttctgacatttctgacatttctgacatttctgacatttctgacatttctgacatttctgacatttccgactcggaccgatg

SEQ ID NO: 16468 - DNA, 203 bp, Homo sapiens
  source 1..203: mol_type = other DNA
ggcgcgccagtcctgctaaaggattctgacatttctgacatttctgacatttctgacatttctgacattcacggaatcgagaacatttctgacatttctgacatttctgacatttctgacatttctgacatttctgacatttctgacatttctgacatttctgacatttctgaccgtcaattcctttacgactcggaccgatg

SEQ ID NO: 16469 - DNA, 203 bp, Homo sapiens
  source 1..203: mol_type = other DNA
ggcgcgccagtcctgctcttaagatctgacatttctgacatttctgacatttctgacatttctgacattctccccccggaacccaaagactttggtttcccggaagctgcccggcgggtcatgggaataacgccgccgcatcgccggtcggcatcgttttctgacatttctgacatttctgacatttccgactcggaccgatg

SEQ ID NO: 16470 - DNA, 203 bp, Homo sapiens
  source 1..203: mol_type = other DNA
ggcgcgccagtcctgcagtatgcatctgacatttctgacatttctgacatttctgacatttctgacattgaaccataactgatttaatgagccattcgcagtttcactgtaccggccgtgcgtactcagacatgcatggcttaatctttgagacaagcatctgacatttctgacatttctgacatttccgactcggaccgatg

SEQ ID NO: 16471 - DNA, 203 bp, Homo sapiens
  source 1..203: mol_type = other DNA
ggcgcgccagtcctctgaatgaaatctgacatttctgacatttctgacatttctgacatttctgacatttaccggccgtctgacatttctgacatttctgacatttctgacatttctgacatttctgacatttctgacatttctgacatttctgacatttctgacatttctgacattttcttggcaaacgactcggaccgatg

SEQ ID NO: 16472 - DNA, 203 bp, Homo sapiens
  source 1..203: mol_type = other DNA
ggcgcgccagtcctgagaatcgtatctgacatttctgacatttctgacatttctgacatttctgacatttactccctttctgacatttctgacatttctgacatttctgacatttctgacatttctgacatttctgacatttctgacatttctgacatttctgacatttctgacatttctgtactccccgactcggaccgatg

SEQ ID NO: 16473 - DNA, 203 bp, Homo sapiens
  source 1..203: mol_type = other DNA
ggcgcgccagtcctgagtgaactgtctgacatttctgacatttctgacatttctgacatttctgacatttcaccataactgatttaatgagccattcgcagtttcactgtaccggccgtgcgtactcagacatgcatggcttaatctttgagacaagtttctgacatttctgacatttctgacatttccgactcggaccgatg

SEQ ID NO: 16474 - DNA, 203 bp, Homo sapiens
  source 1..203: mol_type = other DNA
ggcgcgccagtcctaacagttctttctgacatttctgacatttctgacatttctgacatttctgacatttcattaagccgcaggctccactcctggtggtgcccttccgtcaattcctttaagtttcagctttgcaaccatactccccccggaaccctttctgacatttctgacatttctgacatttccgactcggaccgatg

SEQ ID NO: 16475 - DNA, 203 bp, Homo sapiens
  source 1..203: mol_type = other DNA
ggcgcgccagtcctacaagtgctctctgacatttctgacatttctgacatttctgacatttctgacatttcgcccttccgtcaattcctttaagtttcagctttgcaaccatactccccccggaacccaaagactttggtttcccggaagctgcccgtttctgacatttctgacatttctgacatttccgactcggaccgatg

SEQ ID NO: 16476 - DNA, 203 bp, Homo sapiens
  source 1..203: mol_type = other DNA
ggcgcgccagtccttcaacgtaggtctgacatttctgacatttctgacatttctgacatttctgacatttctcccttccgtcaattcctttaagtttcagctttgcaaccatactccccccggaacccaaagactttggtttcccggaagctgcccatttctgacatttctgacatttctgacatttccgactcggaccgatg

SEQ ID NO: 16477 - DNA, 203 bp, Homo sapiens
  source 1..203: mol_type = other DNA
ggcgcgccagtcctttgacctttatctgacatttctgacatttctgacatttctgacatttctgacatttctccggcgggtgacatttctgacatttctgacatttctgacatttctgacatttctgacatttctgacatttctgacatttctgacatttctgacatttctgacatttcccggcgggtcgactcggaccgatg

SEQ ID NO: 16478 - DNA, 203 bp, Homo sapiens
  source 1..203: mol_type = other DNA
ggcgcgccagtcctaagctaacactctgacatttctgacatttctgacatttctgacatttctgacatttctcgtcaattcctttattctgacatttctgacatttctgacatttctgacatttctgacatttctgacatttctgacatttctgacatttctgacatttctgacattttcttggcaaacgactcggaccgatg

SEQ ID NO: 16479 - DNA, 203 bp, Homo sapiens
  source 1..203: mol_type = other DNA
ggcgcgccagtcctgtagtgctaatctgacatttctgacatttctgacatttctgacatttctgacatttctgaaccggccgtcatttctgacatttctgacatttctgacatttctgacatttctgacatttctgacatttctgacatttctgacatttctgacatttctgaccacggaatcgagaacgactcggaccgatg

SEQ ID NO: 16480 - DNA, 203 bp, Homo sapiens
  source 1..203: mol_type = other DNA
ggcgcgccagtcctgtaaagtggttctgacatttctgacatttctgacatttctgacatttctgacatttctgacacaccaactaagaacggccatgcaccaccacccacggaatcgagaaagagctatcaatctgtcaatcctgtccgtgttgacatttctgacatttctgacatttctgacatttccgactcggaccgatg

SEQ ID NO: 16481 - DNA, 203 bp, Homo sapiens
  source 1..203: mol_type = other DNA
ggcgcgccagtcctctgtgtacactctgacatttctgacatttctgacatttctgacatttctgacatttctgacacacggaatcgagaagacatttctgacatttctgacatttctgacatttctgacatttctgacatttctgacatttctgacatttctgacatttctgacatttctgacatttccgactcggaccgatg

SEQ ID NO: 16482 - DNA, 203 bp, Homo sapiens
  source 1..203: mol_type = other DNA
ggcgcgccagtcctgtgaatgttgtctgacatttctgacatttctgacatttctgacatttctgacatttctgacacacggaatcgagaagacatttctgacatttctgacatttctgacatttctgacatttctgacatttctgacatttctgacatttctgacatttctgacatttctgtactccccgactcggaccgatg

SEQ ID NO: 16483 - DNA, 203 bp, Homo sapiens
  source 1..203: mol_type = other DNA
ggcgcgccagtcctgtctgagaaatctgacatttctgacatttctgacatttctgacatttctgacatttctgacacggaatcgagaactgacatttctgacatttctgacatttctgacatttctgacatttctgacatttctgacatttctgacatttctgacatttctgacatttcaccggccgtcgactcggaccgatg

SEQ ID NO: 16484 - DNA, 203 bp, Homo sapiens
  source 1..203: mol_type = other DNA
ggcgcgccagtcctgaccgagaactctgacatttctgacatttctgacatttctgacatttctgacatttctgacacggaatcgagaactgacatttctgacatttctgacatttctgacatttctgacatttctgacatttctgacatttctgacatttctgacatttctgacatttcccggcgggtcgactcggaccgatg

SEQ ID NO: 16485 - DNA, 203 bp, Homo sapiens
  source 1..203: mol_type = other DNA
ggcgcgccagtcctgtctcatgactctgacatttctgacatttctgacatttctgacatttctgacatttctgacacgtcaattcctttagacatttctgacatttctgacatttctgacatttctgacatttctgacatttctgacatttctgacatttctgacatttctgaccgtcaattcctttacgactcggaccgatg

SEQ ID NO: 16486 - DNA, 203 bp, Homo sapiens
  source 1..203: mol_type = other DNA
ggcgcgccagtcctctaagaagactctgacatttctgacatttctgacatttctgacatttctgacatttctgacagccgcaggctccactcctggtggtgcccttccgtcaattcctttaagtttcagctttgcaaccatactccccccggagacatttctgacatttctgacatttctgacatttccgactcggaccgatg

SEQ ID NO: 16487 - DNA, 203 bp, Homo sapiens
  source 1..203: mol_type = other DNA
ggcgcgccagtcctgtaacggtattctgacatttctgacatttctgacatttctgacatttctgacatttctgacataccggccgtttctgacatttctgacatttctgacatttctgacatttctgacatttctgacatttctgacatttctgacatttctgacatttctgacattttcttggcaaacgactcggaccgatg

SEQ ID NO: 16488 - DNA, 203 bp, Homo sapiens
  source 1..203: mol_type = other DNA
ggcgcgccagtcctgtccagaggctctgacatttctgacatttctgacatttctgacatttctgacatttctgacatactccccatttctgacatttctgacatttctgacatttctgacatttctgacatttctgacatttctgacatttctgacatttctgacatttctgacatttctgtactccccgactcggaccgatg

SEQ ID NO: 16489 - DNA, 203 bp, Homo sapiens
  source 1..203: mol_type = other DNA
ggcgcgccagtcctgtagttagcttctgacatttctgacatttctgacatttctgacatttctgacatttctgacatactgatttaatgagccattcgcagtttcactgtaccggccgtgcgtactcagacatgcatggcttaatctttgactgacatttctgacatttctgacatttctgacatttccgactcggaccgatg

SEQ ID NO: 16490 - DNA, 203 bp, Homo sapiens
  source 1..203: mol_type = other DNA
ggcgcgccagtcctgtggttgacttctgacatttctgacatttctgacatttctgacatttctgacatttctgacatccgcaggctccactcctggtggtgcccttccgtcaattcctttaagtttcagctttgcaaccatactccccccgctgacatttctgacatttctgacatttctgacatttccgactcggaccgatg

SEQ ID NO: 16491 - DNA, 203 bp, Homo sapiens
  source 1..203: mol_type = other DNA
ggcgcgccagtcctctgacaaaactctgacatttctgacatttctgacatttctgacatttctgacatttctgacatttaacccaaagactttggtttcccggaagctgcccggcgggtcatgggaataacgccgccgcatcgccggtcttctgacatttctgacatttctgacatttctgacatttccgactcggaccgatg

SEQ ID NO: 16492 - DNA, 203 bp, Homo sapiens
  source 1..203: mol_type = other DNA
ggcgcgccagtcctcagtaactactctgacatttctgacatttctgacatttctgacatttctgacatttctgacatttaccggccgtctgacatttctgacatttctgacatttctgacatttctgacatttctgacatttctgacatttctgacatttctgacatttctgacatttcaccggccgtcgactcggaccgatg

SEQ ID NO: 16493 - DNA, 203 bp, Homo sapiens
  source 1..203: mol_type = other DNA
ggcgcgccagtcctgtgaactgtctctgacatttctgacatttctgacatttctgacatttctgacatttctgacatttcccgactttcgttcttgattaatgaaaacattcttggcaaatgctttcgctctggtccgtcttgcgccgtttctgacatttctgacatttctgacatttctgacatttccgactcggaccgatg

SEQ ID NO: 16494 - DNA, 203 bp, Homo sapiens
  source 1..203: mol_type = other DNA
ggcgcgccagtcctgttcaagaactctgacatttctgacatttctgacatttctgacatttctgacatttctgacatttcgatttaatgagccattcgcagtttcactgtaccggccgtgcgtactcagacatgcatggcttaatctttttctgacatttctgacatttctgacatttctgacatttccgactcggaccgatg

SEQ ID NO: 16495 - DNA, 203 bp, Homo sapiens
  source 1..203: mol_type = other DNA
ggcgcgccagtcctctaacgttactctgacatttctgacatttctgacatttctgacatttctgacatttctgacatttctaggctccactcctggtggtgcccttccgtcaattcctttaagtttcagctttgcaaccatactcccatttctgacatttctgacatttctgacatttctgacatttccgactcggaccgatg

SEQ ID NO: 16496 - DNA, 203 bp, Homo sapiens
  source 1..203: mol_type = other DNA
ggcgcgccagtcctgtgagagccttctgacatttctgacatttctgacatttctgacatttctgacatttctgacatttctcccaaagactttggtttcccggaagctgcccggcgggtcatgggaataacgccgccgcatcgccggatttctgacatttctgacatttctgacatttctgacatttccgactcggaccgatg

SEQ ID NO: 16497 - DNA, 203 bp, Homo sapiens
  source 1..203: mol_type = other DNA
ggcgcgccagtcctgtatggttgctctgacatttctgacatttctgacatttctgacatttctgacatttctgacatttctccggcgggtgacatttctgacatttctgacatttctgacatttctgacatttctgacatttctgacatttctgacatttctgacatttctgacatttctgacatttccgactcggaccgatg

SEQ ID NO: 16498 - DNA, 203 bp, Homo sapiens
  source 1..203: mol_type = other DNA
ggcgcgccagtcctcagtccaaactctgacatttctgacatttctgacatttctgacatttctgacatttctgacatttctccggcgggtgacatttctgacatttctgacatttctgacatttctgacatttctgacatttctgacatttctgacatttctgacatttctgacatttctgtactccccgactcggaccgatg

SEQ ID NO: 16499 - DNA, 203 bp, Homo sapiens
  source 1..203: mol_type = other DNA
ggcgcgccagtcctcctcggtcactctgacatttctgacatttctgacatttctgacatttctgacatttctgacatttctccggcgggtgacatttctgacatttctgacatttctgacatttctgacatttctgacatttctgacatttctgacatttctgacatttctgaccgtcaattcctttacgactcggaccgatg

SEQ ID NO: 16500 - DNA, 203 bp, Homo sapiens
  source 1..203: mol_type = other DNA
ggcgcgccagtcctgagtagatactctgacatttctgacatttctgacatttctgacatttctgacatttctgacatttctgaactttcgttcttgattaatgaaaacattcttggcaaatgctttcgctctggtccgtcttgcgacatttctgacatttctgacatttctgacatttctgacatttccgactcggaccgatg

SEQ ID NO: 16501 - DNA, 203 bp, Homo sapiens
  source 1..203: mol_type = other DNA
ggcgcgccagtcctgttcaccatttctgacatttctgacatttctgacatttctgacatttctgacatttctgacatttctgacaaagactttggtttcccggaagctgcccggcgggtcatgggaataacgccgccgcatcgccacatttctgacatttctgacatttctgacatttctgacatttccgactcggaccgatg

SEQ ID NO: 16502 - DNA, 203 bp, Homo sapiens
  source 1..203: mol_type = other DNA
ggcgcgccagtcctcctctgctactctgacatttctgacatttctgacatttctgacatttctgacatttctgacatttctgacaaagactttggtttcccggaagctgcccggcgggtcatgggaataacgccgccgcatcgcgacatttctgacatttctgacatttctgacatttctgacatttccgactcggaccgatg

SEQ ID NO: 16503 - DNA, 203 bp, Homo sapiens
  source 1..203: mol_type = other DNA
ggcgcgccagtcctgtgaccggtttctgacatttctgacatttctgacatttctgacatttctgacatttctgacatttctgacaaagactttggtttcccggaagctgcccggcgggtcatgggaataacgccgccgcatcgtgacatttctgacatttctgacatttctgacatttctgacatttccgactcggaccgatg

SEQ ID NO: 16504 - DNA, 203 bp, Homo sapiens
  source 1..203: mol_type = other DNA
ggcgcgccagtcctactagtagactctgacatttctgacatttctgacatttctgacatttctgacatttctgacatttctgacaaatgagccattcgcagtttcactgtaccggccgtgcgtactcagacatgcatggcttatgacatttctgacatttctgacatttctgacatttctgacatttccgactcggaccgatg

SEQ ID NO: 16505 - DNA, 203 bp, Homo sapiens
  source 1..203: mol_type = other DNA
ggcgcgccagtcctgactctgtactctgacatttctgacatttctgacatttctgacatttctgacatttctgacatttctgacaagaacggccatgcaccaccacccacggaatcgagaaagagctatcaatctgtcaatcctgacatttctgacatttctgacatttctgacatttctgacatttccgactcggaccgatg

SEQ ID NO: 16506 - DNA, 203 bp, Homo sapiens
  source 1..203: mol_type = other DNA
ggcgcgccagtcctgctgaacaactctgacatttctgacatttctgacatttctgacatttctgacatttctgacatttctgacaccggccgtatttctgacatttctgacatttctgacatttctgacatttctgacatttctgacatttctgacatttctgacatttctgacattttcttggcaaacgactcggaccgatg

SEQ ID NO: 16507 - DNA, 203 bp, Homo sapiens
  source 1..203: mol_type = other DNA
ggcgcgccagtcctgagtggtcactctgacatttctgacatttctgacatttctgacatttctgacatttctgacatttctgacacggaatcgagaactgacatttctgacatttctgacatttctgacatttctgacatttctgacatttctgacatttctgacatttctgacatttctgacatttccgactcggaccgatg

SEQ ID NO: 16508 - DNA, 203 bp, Homo sapiens
  source 1..203: mol_type = other DNA
ggcgcgccagtcctgtcaacgtactctgacatttctgacatttctgacatttctgacatttctgacatttctgacatttctgacacggaatcgagaactgacatttctgacatttctgacatttctgacatttctgacatttctgacatttctgacatttctgacatttctgaccacggaatcgagaacgactcggaccgatg

SEQ ID NO: 16509 - DNA, 203 bp, Homo sapiens
  source 1..203: mol_type = other DNA
ggcgcgccagtccttgctgagcactctgacatttctgacatttctgacatttctgacatttctgacatttctgacatttctgacataacggaatcgagaaacataacggaatcgagaaacataacggaatcgagaaacataacggaatcgagaaacataacggaatcgagaaacatttctgacatttccgactcggaccgatg

SEQ ID NO: 16510 - DNA, 203 bp, Homo sapiens
  source 1..203: mol_type = other DNA
ggcgcgccagtcctgtgagtactctctgacatttctgacatttctgacatttctgacatttctgacatttctgacatttctgacataaggcgggtttctgacataaggcgggtttctgacataaggcgggtttctgacataaggcgggtttctgacataaggcgggtttctgacatttctgacatttccgactcggaccgatg

SEQ ID NO: 16511 - DNA, 203 bp, Homo sapiens
  source 1..203: mol_type = other DNA
ggcgcgccagtccttgaatcctactctgacatttctgacatttctgacatttctgacatttctgacatttctgacatttctgacatacccgccgtttctgacatacccgccgtttctgacatacccgccgtttctgacatacccgccgtttctgacatacccgccgtttctgacatttctgacatttccgactcggaccgatg

SEQ ID NO: 16512 - DNA, 203 bp, Homo sapiens
  source 1..203: mol_type = other DNA
ggcgcgccagtcctagtggtcaactctgacatttctgacatttctgacatttctgacatttctgacatttctgacatttctgacataccgatcgtttctgacataccgatcgtttctgacataccgatcgtttctgacataccgatcgtttctgacataccgatcgtttctgacatttctgacatttccgactcggaccgatg

SEQ ID NO: 16513 - DNA, 203 bp, Homo sapiens
  source 1..203: mol_type = other DNA
ggcgcgccagtcctcagaagttactctgacatttctgacatttctgacatttctgacatttctgacatttctgacatttctgacataccgcacgtttctgacataccgcacgtttctgacataccgcacgtttctgacataccgcacgtttctgacataccgcacgtttctgacatttctgacatttccgactcggaccgatg

SEQ ID NO: 16514 - DNA, 203 bp, Homo sapiens
  source 1..203: mol_type = other DNA
ggcgcgccagtcctgttaacagactctgacatttctgacatttctgacatttctgacatttctgacatttctgacatttctgacataccgcgcgtttctgacataccgcgcgtttctgacataccgcgcgtttctgacataccgcgcgtttctgacataccgcgcgtttctgacatttctgacatttccgactcggaccgatg

SEQ ID NO: 16515 - DNA, 203 bp, Homo sapiens
  source 1..203: mol_type = other DNA
ggcgcgccagtccttgagcaccactctgacatttctgacatttctgacatttctgacatttctgacatttctgacatttctgacataccgctcgtttctgacataccgctcgtttctgacataccgctcgtttctgacataccgctcgtttctgacataccgctcgtttctgacatttctgacatttccgactcggaccgatg

SEQ ID NO: 16516 - DNA, 203 bp, Homo sapiens
  source 1..203: mol_type = other DNA
ggcgcgccagtccttgcaagtaactctgacatttctgacatttctgacatttctgacatttctgacatttctgacatttctgacataccggaatcgagaaacataccggaatcgagaaacataccggaatcgagaaacataccggaatcgagaaacataccggaatcgagaaacatttctgacatttccgactcggaccgatg

SEQ ID NO: 16517 - DNA, 203 bp, Homo sapiens
  source 1..203: mol_type = other DNA
ggcgcgccagtcctgtcagtagattctgacatttctgacatttctgacatttctgacatttctgacatttctgacatttctgacataccggccaattctgacataccggccaattctgacataccggccaattctgacataccggccaattctgacataccggccaattctgacatttctgacatttccgactcggaccgatg

SEQ ID NO: 16518 - DNA, 203 bp, Homo sapiens
  source 1..203: mol_type = other DNA
ggcgcgccagtcctctaagttcactctgacatttctgacatttctgacatttctgacatttctgacatttctgacatttctgacataccggccagttctgacataccggccagttctgacataccggccagttctgacataccggccagttctgacataccggccagttctgacatttctgacatttccgactcggaccgatg

SEQ ID NO: 16519 - DNA, 203 bp, Homo sapiens
  source 1..203: mol_type = other DNA
ggcgcgccagtcctattctgttcatctgacatttctgacatttctgacatttctgacatttctgacatttctgacatttctgacataccggccccttctgacataccggccccttctgacataccggccccttctgacataccggccccttctgacataccggccccttctgacatttctgacatttccgactcggaccgatg

SEQ ID NO: 16520 - DNA, 203 bp, Homo sapiens
  source 1..203: mol_type = other DNA
ggcgcgccagtcctcaacgaatactctgacatttctgacatttctgacatttctgacatttctgacatttctgacatttctgacataccggccgcttctgacataccggccgcttctgacataccggccgcttctgacataccggccgcttctgacataccggccgcttctgacatttctgacatttccgactcggaccgatg

SEQ ID NO: 16521 - DNA, 203 bp, Homo sapiens
  source 1..203: mol_type = other DNA
ggcgcgccagtcctatgaatcgaatctgacatttctgacatttctgacatttctgacatttctgacatttctgacatttctgacataccggccgtttctgacataccggccgtttctgacataccggccgtttctgacataccggccgtttctgacatttctgacatttctgacataccggccgtttccgactcggaccgatg

SEQ ID NO: 16522 - DNA, 203 bp, Homo sapiens
  source 1..203: mol_type = other DNA
ggcgcgccagtcctgtttgaactctctgacatttctgacatttctgacatttctgacatttctgacatttctgacatttctgacataccggccgtttctgacataccggccgtttctgacataccggccgtttctgacatttctgacatttctgacatttctgacatttctgacataccggccgtttccgactcggaccgatg

SEQ ID NO: 16523 - DNA, 203 bp, Homo sapiens
  source 1..203: mol_type = other DNA
ggcgcgccagtcctctcaccatgttctgacatttctgacatttctgacatttctgacatttctgacatttctgacatttctgacataccggccgtttctgacataccggccgtttctgacataccggccgtttctgacatttctgacatttctgacatttctgacatttctgacatttctgacatttccgactcggaccgatg

SEQ ID NO: 16524 - DNA, 203 bp, Homo sapiens
  source 1..203: mol_type = other DNA
ggcgcgccagtcctttaggctcactctgacatttctgacatttctgacatttctgacatttctgacatttctgacatttctgacataccggccgtttctgacataccggccgtttctgacatttctgacatttctgacataccggccgtttctgacataccggccgtttctgacatttctgacatttccgactcggaccgatg

SEQ ID NO: 16525 - DNA, 203 bp, Homo sapiens
  source 1..203: mol_type = other DNA
ggcgcgccagtcctcatgctctggtctgacatttctgacatttctgacatttctgacatttctgacatttctgacatttctgacataccggccgtttctgacataccggccgtttctgacatttctgacatttctgacatttctgacatttctgacataccggccgtttctgacatttctgacatttccgactcggaccgatg

SEQ ID NO: 16526 - DNA, 203 bp, Homo sapiens
  source 1..203: mol_type = other DNA
ggcgcgccagtcctcacagcatggtctgacatttctgacatttctgacatttctgacatttctgacatttctgacatttctgacataccggccgtttctgacataccggccgtttctgacatttctgacatttctgacatttctgacatttctgacatttctgacatttctgacatttctgacatttccgactcggaccgatg

SEQ ID NO: 16527 - DNA, 203 bp, Homo sapiens
  source 1..203: mol_type = other DNA
ggcgcgccagtccttgaagacgactctgacatttctgacatttctgacatttctgacatttctgacatttctgacatttctgacataccggccgtttctgacatttctgacatttctgacataccggccgtttctgacataccggccgtttctgacataccggccgtttctgacataccggccgtttccgactcggaccgatg

SEQ ID NO: 16528 - DNA, 203 bp, Homo sapiens
  source 1..203: mol_type = other DNA
ggcgcgccagtcctgatcacaagttctgacatttctgacatttctgacatttctgacatttctgacatttctgacatttctgacataccggccgtttctgacatttctgacatttctgacataccggccgtttctgacataccggccgtttctgacataccggccgtttctgacatttctgacatttccgactcggaccgatg

SEQ ID NO: 16529 - DNA, 203 bp, Homo sapiens
  source 1..203: mol_type = other DNA
ggcgcgccagtcctatcatggtgctctgacatttctgacatttctgacatttctgacatttctgacatttctgacatttctgacataccggccgtttctgacatttctgacatttctgacataccggccgtttctgacataccggccgtttctgacatttctgacatttctgacatttctgacatttccgactcggaccgatg

SEQ ID NO: 16530 - DNA, 203 bp, Homo sapiens
  source 1..203: mol_type = other DNA
ggcgcgccagtccttcagcaagcatctgacatttctgacatttctgacatttctgacatttctgacatttctgacatttctgacataccggccgtttctgacatttctgacatttctgacataccggccgtttctgacatttctgacatttctgacataccggccgtttctgacataccggccgtttccgactcggaccgatg

SEQ ID NO: 16531 - DNA, 203 bp, Homo sapiens
  source 1..203: mol_type = other DNA
ggcgcgccagtcctagagtcctagtctgacatttctgacatttctgacatttctgacatttctgacatttctgacatttctgacataccggccgtttctgacatttctgacatttctgacataccggccgtttctgacatttctgacatttctgacatttctgacatttctgacatttctgacatttccgactcggaccgatg

SEQ ID NO: 16532 - DNA, 203 bp, Homo sapiens
  source 1..203: mol_type = other DNA
ggcgcgccagtcctcagagtcctatctgacatttctgacatttctgacatttctgacatttctgacatttctgacatttctgacataccggccgtttctgacatttctgacatttctgacatttctgacatttctgacataccggccgtttctgacataccggccgtttctgacataccggccgtttccgactcggaccgatg

SEQ ID NO: 16533 - DNA, 203 bp, Homo sapiens
  source 1..203: mol_type = other DNA
ggcgcgccagtcctccaaagtgcatctgacatttctgacatttctgacatttctgacatttctgacatttctgacatttctgacataccggccgtttctgacatttctgacatttctgacatttctgacatttctgacataccggccgtttctgacataccggccgtttctgacatttctgacatttccgactcggaccgatg

SEQ ID NO: 16534 - DNA, 203 bp, Homo sapiens
  source 1..203: mol_type = other DNA
ggcgcgccagtcctgtgcacttcttctgacatttctgacatttctgacatttctgacatttctgacatttctgacatttctgacataccggccgtttctgacatttctgacatttctgacatttctgacatttctgacataccggccgtttctgacatttctgacatttctgacataccggccgtttccgactcggaccgatg

SEQ ID NO: 16535 - DNA, 203 bp, Homo sapiens
  source 1..203: mol_type = other DNA
ggcgcgccagtcctaccgtcagtgtctgacatttctgacatttctgacatttctgacatttctgacatttctgacatttctgacataccggccgtttctgacatttctgacatttctgacatttctgacatttctgacatttctgacatttctgacataccggccgtttctgacataccggccgtttccgactcggaccgatg

SEQ ID NO: 16536 - DNA, 203 bp, Homo sapiens
  source 1..203: mol_type = other DNA
ggcgcgccagtcctaccgttcatatctgacatttctgacatttctgacatttctgacatttctgacatttctgacatttctgacataccggcctcttctgacataccggcctcttctgacataccggcctcttctgacataccggcctcttctgacataccggcctcttctgacatttctgacatttccgactcggaccgatg

SEQ ID NO: 16537 - DNA, 203 bp, Homo sapiens
  source 1..203: mol_type = other DNA
ggcgcgccagtcctagcaccgttctctgacatttctgacatttctgacatttctgacatttctgacatttctgacatttctgacataccggcctgttctgacataccggcctgttctgacataccggcctgttctgacataccggcctgttctgacataccggcctgttctgacatttctgacatttccgactcggaccgatg

SEQ ID NO: 16538 - DNA, 203 bp, Homo sapiens
  source 1..203: mol_type = other DNA
ggcgcgccagtcctgctgtgaccatctgacatttctgacatttctgacatttctgacatttctgacatttctgacatttctgacataccggcggtttctgacataccggcggtttctgacataccggcggtttctgacataccggcggtttctgacataccggcggtttctgacatttctgacatttccgactcggaccgatg

SEQ ID NO: 16539 - DNA, 203 bp, Homo sapiens
  source 1..203: mol_type = other DNA
ggcgcgccagtccttgtgaccgactctgacatttctgacatttctgacatttctgacatttctgacatttctgacatttctgacataccggcgttttctgacataccggcgttttctgacataccggcgttttctgacataccggcgttttctgacataccggcgttttctgacatttctgacatttccgactcggaccgatg

SEQ ID NO: 16540 - DNA, 203 bp, Homo sapiens
  source 1..203: mol_type = other DNA
ggcgcgccagtcctgaggtcacactctgacatttctgacatttctgacatttctgacatttctgacatttctgacatttctgacataccggctctttctgacataccggctctttctgacataccggctctttctgacataccggctctttctgacataccggctctttctgacatttctgacatttccgactcggaccgatg

SEQ ID NO: 16541 - DNA, 203 bp, Homo sapiens
  source 1..203: mol_type = other DNA
ggcgcgccagtcctcatgttcgtttctgacatttctgacatttctgacatttctgacatttctgacatttctgacatttctgacataccggctgtttctgacataccggctgtttctgacataccggctgtttctgacataccggctgtttctgacataccggctgtttctgacatttctgacatttccgactcggaccgatg

SEQ ID NO: 16542 - DNA, 203 bp, Homo sapiens
  source 1..203: mol_type = other DNA
ggcgcgccagtcctaatgagcctttctgacatttctgacatttctgacatttctgacatttctgacatttctgacatttctgacataccgtgcgtttctgacataccgtgcgtttctgacataccgtgcgtttctgacataccgtgcgtttctgacataccgtgcgtttctgacatttctgacatttccgactcggaccgatg

SEQ ID NO: 16543 - DNA, 203 bp, Homo sapiens
  source 1..203: mol_type = other DNA
ggcgcgccagtccttacgttcttatctgacatttctgacatttctgacatttctgacatttctgacatttctgacatttctgacatacgcgccgtttctgacatacgcgccgtttctgacatacgcgccgtttctgacatacgcgccgtttctgacatacgcgccgtttctgacatttctgacatttccgactcggaccgatg

SEQ ID NO: 16544 - DNA, 203 bp, Homo sapiens
  source 1..203: mol_type = other DNA
ggcgcgccagtcctagctaacgtatctgacatttctgacatttctgacatttctgacatttctgacatttctgacatttctgacatacggccggtttctgacatacggccggtttctgacatacggccggtttctgacatacggccggtttctgacatacggccggtttctgacatttctgacatttccgactcggaccgatg

SEQ ID NO: 16545 - DNA, 203 bp, Homo sapiens
  source 1..203: mol_type = other DNA
ggcgcgccagtcctttggactgaatctgacatttctgacatttctgacatttctgacatttctgacatttctgacatttctgacatacgtgccgtttctgacatacgtgccgtttctgacatacgtgccgtttctgacatacgtgccgtttctgacatacgtgccgtttctgacatttctgacatttccgactcggaccgatg

SEQ ID NO: 16546 - DNA, 203 bp, Homo sapiens
  source 1..203: mol_type = other DNA
ggcgcgccagtcctttcagtgtactctgacatttctgacatttctgacatttctgacatttctgacatttctgacatttctgacatactcgccgtttctgacatactcgccgtttctgacatactcgccgtttctgacatactcgccgtttctgacatactcgccgtttctgacatttctgacatttccgactcggaccgatg

SEQ ID NO: 16547 - DNA, 203 bp, Homo sapiens
  source 1..203: mol_type = other DNA
ggcgcgccagtcctttactgaatttctgacatttctgacatttctgacatttctgacatttctgacatttctgacatttctgacatagcggccgtttctgacatagcggccgtttctgacatagcggccgtttctgacatagcggccgtttctgacatagcggccgtttctgacatttctgacatttccgactcggaccgatg

SEQ ID NO: 16548 - DNA, 203 bp, Homo sapiens
  source 1..203: mol_type = other DNA
ggcgcgccagtcctacccaactggtctgacatttctgacatttctgacatttctgacatttctgacatttctgacatttctgacatatctcccatttctgacatatctcccatttctgacatatctcccatttctgacatatctcccatttctgacatatctcccatttctgacatttctgacatttccgactcggaccgatg

SEQ ID NO: 16549 - DNA, 203 bp, Homo sapiens
  source 1..203: mol_type = other DNA
ggcgcgccagtcctgttgggtcagtctgacatttctgacatttctgacatttctgacatttctgacatttctgacatttctgacatatgagccattcgcagtttcactgtaccggccgtgcgtactcagacatgcatggcttctgacatttctgacatttctgacatttctgacatttctgacatttccgactcggaccgatg

SEQ ID NO: 16550 - DNA, 203 bp, Homo sapiens
  source 1..203: mol_type = other DNA
ggcgcgccagtcctaaagagagactctgacatttctgacatttctgacatttctgacatttctgacatttctgacatttctgacatcacgaaatcgagaaacatcacgaaatcgagaaacatcacgaaatcgagaaacatcacgaaatcgagaaacatcacgaaatcgagaaacatttctgacatttccgactcggaccgatg

SEQ ID NO: 16551 - DNA, 203 bp, Homo sapiens
  source 1..203: mol_type = other DNA
ggcgcgccagtcctagtcacagtttctgacatttctgacatttctgacatttctgacatttctgacatttctgacatttctgacatcacggaatcaagaaacatcacggaatcaagaaacatcacggaatcaagaaacatcacggaatcaagaaacatcacggaatcaagaaacatttctgacatttccgactcggaccgatg

SEQ ID NO: 16552 - DNA, 203 bp, Homo sapiens
  source 1..203: mol_type = other DNA
ggcgcgccagtcctaatcagagcttctgacatttctgacatttctgacatttctgacatttctgacatttctgacatttctgacatcacggaatccagaaacatcacggaatccagaaacatcacggaatccagaaacatcacggaatccagaaacatcacggaatccagaaacatttctgacatttccgactcggaccgatg

SEQ ID NO: 16553 - DNA, 203 bp, Homo sapiens
  source 1..203: mol_type = other DNA
ggcgcgccagtcctgaccaccgtgtctgacatttctgacatttctgacatttctgacatttctgacatttctgacatttctgacatcacggaatcgaaaaacatcacggaatcgaaaaacatcacggaatcgaaaaacatcacggaatcgaaaaacatcacggaatcgaaaaacatttctgacatttccgactcggaccgatg

SEQ ID NO: 16554 - DNA, 203 bp, Homo sapiens
  source 1..203: mol_type = other DNA
ggcgcgccagtcctacggtggttttctgacatttctgacatttctgacatttctgacatttctgacatttctgacatttctgacatcacggaatcgacaaacatcacggaatcgacaaacatcacggaatcgacaaacatcacggaatcgacaaacatcacggaatcgacaaacatttctgacatttccgactcggaccgatg

SEQ ID NO: 16555 - DNA, 203 bp, Homo sapiens
  source 1..203: mol_type = other DNA
ggcgcgccagtccttccaggtggttctgacatttctgacatttctgacatttctgacatttctgacatttctgacatttctgacatcacggaatcgagaaacatcacggaatcgagaaacatcacggaatcgagaaacatcacggaatcgagaaacatcacggaatcgagaaacatttctgacatttccgactcggaccgatg

SEQ ID NO: 16556 - DNA, 203 bp, Homo sapiens
  source 1..203: mol_type = other DNA
ggcgcgccagtccttttggtgaaatctgacatttctgacatttctgacatttctgacatttctgacatttctgacatttctgacatcacggaatcgagaaacatcacggaatcgagaaacatcacggaatcgagaaacatttctgacatttctgacatcacggaatcgagaaacatttctgacatttccgactcggaccgatg

SEQ ID NO: 16557 - DNA, 203 bp, Homo sapiens
  source 1..203: mol_type = other DNA
ggcgcgccagtccttaaccgtaactctgacatttctgacatttctgacatttctgacatttctgacatttctgacatttctgacatcacggaatcgagaaacatcacggaatcgagaaacatttctgacatttctgacatttctgacatttctgacatttctgacatttctgacatttctgacatttccgactcggaccgatg

SEQ ID NO: 16558 - DNA, 203 bp, Homo sapiens
  source 1..203: mol_type = other DNA
ggcgcgccagtcctaccgtagccttctgacatttctgacatttctgacatttctgacatttctgacatttctgacatttctgacatcacggaatcgagaaacatttctgacatttctgacatcacggaatcgagaaacatttctgacatttctgacatttctgacatttctgacatttctgacatttccgactcggaccgatg

SEQ ID NO: 16559 - DNA, 203 bp, Homo sapiens
  source 1..203: mol_type = other DNA
ggcgcgccagtcctctacggttaatctgacatttctgacatttctgacatttctgacatttctgacatttctgacatttctgacatcacggaatcgagaaacatttctgacatttctgacatttctgacatttctgacatttctgacatttctgacatcacggaatcgagaaacatttctgacatttccgactcggaccgatg

SEQ ID NO: 16560 - DNA, 203 bp, Homo sapiens
  source 1..203: mol_type = other DNA
ggcgcgccagtcctcaaagagacttctgacatttctgacatttctgacatttctgacatttctgacatttctgacatttctgacatcacggaatcgagaaacatttctgacatttctgacatttctgacatttctgacatttctgacatttctgacatttctgacatttctgacatttctgacatttccgactcggaccgatg

SEQ ID NO: 16561 - DNA, 203 bp, Homo sapiens
  source 1..203: mol_type = other DNA
ggcgcgccagtcctaatgcacatttctgacatttctgacatttctgacatttctgacatttctgacatttctgacatttctgacatcacggaatcgagagacatcacggaatcgagagacatcacggaatcgagagacatcacggaatcgagagacatcacggaatcgagagacatttctgacatttccgactcggaccgatg

SEQ ID NO: 16562 - DNA, 203 bp, Homo sapiens
  source 1..203: mol_type = other DNA
ggcgcgccagtcctccagaagtgttctgacatttctgacatttctgacatttctgacatttctgacatttctgacatttctgacatcacggaatcgagggacatcacggaatcgagggacatcacggaatcgagggacatcacggaatcgagggacatcacggaatcgagggacatttctgacatttccgactcggaccgatg

SEQ ID NO: 16563 - DNA, 203 bp, Homo sapiens
  source 1..203: mol_type = other DNA
ggcgcgccagtcctacttgggtcttctgacatttctgacatttctgacatttctgacatttctgacatttctgacatttctgacatcacggaatcgagtaacatcacggaatcgagtaacatcacggaatcgagtaacatcacggaatcgagtaacatcacggaatcgagtaacatttctgacatttccgactcggaccgatg

SEQ ID NO: 16564 - DNA, 203 bp, Homo sapiens
  source 1..203: mol_type = other DNA
ggcgcgccagtcctgctacccatttctgacatttctgacatttctgacatttctgacatttctgacatttctgacatttctgacatcacggaatcggaaaacatcacggaatcggaaaacatcacggaatcggaaaacatcacggaatcggaaaacatcacggaatcggaaaacatttctgacatttccgactcggaccgatg

SEQ ID NO: 16565 - DNA, 203 bp, Homo sapiens
  source 1..203: mol_type = other DNA
ggcgcgccagtccttgcaagcctttctgacatttctgacatttctgacatttctgacatttctgacatttctgacatttctgacatcacggaatcgtgaaacatcacggaatcgtgaaacatcacggaatcgtgaaacatcacggaatcgtgaaacatcacggaatcgtgaaacatttctgacatttccgactcggaccgatg

SEQ ID NO: 16566 - DNA, 203 bp, Homo sapiens
  source 1..203: mol_type = other DNA
ggcgcgccagtcctacgtttcgtttctgacatttctgacatttctgacatttctgacatttctgacatttctgacatttctgacatcacggaatgtagaaacatcacggaatgtagaaacatcacggaatgtagaaacatcacggaatgtagaaacatcacggaatgtagaaacatttctgacatttccgactcggaccgatg

SEQ ID NO: 16567 - DNA, 203 bp, Homo sapiens
  source 1..203: mol_type = other DNA
ggcgcgccagtcctttagctgcactctgacatttctgacatttctgacatttctgacatttctgacatttctgacatttctgacatcacggaattaagaaacatcacggaattaagaaacatcacggaattaagaaacatcacggaattaagaaacatcacggaattaagaaacatttctgacatttccgactcggaccgatg

SEQ ID NO: 16568 - DNA, 203 bp, Homo sapiens
  source 1..203: mol_type = other DNA
ggcgcgccagtccttatgcagttgtctgacatttctgacatttctgacatttctgacatttctgacatttctgacatttctgacatcacggcatcgagaaacatcacggcatcgagaaacatcacggcatcgagaaacatcacggcatcgagaaacatcacggcatcgagaaacatttctgacatttccgactcggaccgatg

SEQ ID NO: 16569 - DNA, 203 bp, Homo sapiens
  source 1..203: mol_type = other DNA
ggcgcgccagtcctgaaactgcattctgacatttctgacatttctgacatttctgacatttctgacatttctgacatttctgacatcacggccgtttctgacatcacggccgtttctgacatcacggccgtttctgacatcacggccgtttctgacatcacggccgtttctgacatttctgacatttccgactcggaccgatg

SEQ ID NO: 16570 - DNA, 203 bp, Homo sapiens
  source 1..203: mol_type = other DNA
ggcgcgccagtcctccaagcctgttctgacatttctgacatttctgacatttctgacatttctgacatttctgacatttctgacatcacgggatcgagaaacatcacgggatcgagaaacatcacgggatcgagaaacatcacgggatcgagaaacatcacgggatcgagaaacatttctgacatttccgactcggaccgatg

SEQ ID NO: 16571 - DNA, 203 bp, Homo sapiens
  source 1..203: mol_type = other DNA
ggcgcgccagtccttaggatcaagtctgacatttctgacatttctgacatttctgacatttctgacatttctgacatttctgacatcacgtcatcgagaaacatcacgtcatcgagaaacatcacgtcatcgagaaacatcacgtcatcgagaaacatcacgtcatcgagaaacatttctgacatttccgactcggaccgatg

SEQ ID NO: 16572 - DNA, 203 bp, Homo sapiens
  source 1..203: mol_type = other DNA
ggcgcgccagtcctttcaacgaaatctgacatttctgacatttctgacatttctgacatttctgacatttctgacatttctgacatcactcccatttctgacatcactcccatttctgacatcactcccatttctgacatcactcccatttctgacatcactcccatttctgacatttctgacatttccgactcggaccgatg

SEQ ID NO: 16573 - DNA, 203 bp, Homo sapiens
  source 1..203: mol_type = other DNA
ggcgcgccagtcctacaccgaacttctgacatttctgacatttctgacatttctgacatttctgacatttctgacatttctgacatcactgaatcgagaaacatcactgaatcgagaaacatcactgaatcgagaaacatcactgaatcgagaaacatcactgaatcgagaaacatttctgacatttccgactcggaccgatg

SEQ ID NO: 16574 - DNA, 203 bp, Homo sapiens
  source 1..203: mol_type = other DNA
ggcgcgccagtcctaactgaggcatctgacatttctgacatttctgacatttctgacatttctgacatttctgacatttctgacatcagggaatcgagaaacatcagggaatcgagaaacatcagggaatcgagaaacatcagggaatcgagaaacatcagggaatcgagaaacatttctgacatttccgactcggaccgatg

SEQ ID NO: 16575 - DNA, 203 bp, Homo sapiens
  source 1..203: mol_type = other DNA
ggcgcgccagtcctgacgaagttctctgacatttctgacatttctgacatttctgacatttctgacatttctgacatttctgacatcattgaatcgagaaacatcattgaatcgagaaacatcattgaatcgagaaacatcattgaatcgagaaacatcattgaatcgagaaacatttctgacatttccgactcggaccgatg

SEQ ID NO: 16576 - DNA, 203 bp, Homo sapiens
  source 1..203: mol_type = other DNA
ggcgcgccagtcctcaaccgagtatctgacatttctgacatttctgacatttctgacatttctgacatttctgacatttctgacatcccggccgtttctgacatcccggccgtttctgacatcccggccgtttctgacatcccggccgtttctgacatcccggccgtttctgacatttctgacatttccgactcggaccgatg

SEQ ID NO: 16577 - DNA, 203 bp, Homo sapiens
  source 1..203: mol_type = other DNA
ggcgcgccagtcctcactagtgattctgacatttctgacatttctgacatttctgacatttctgacatttctgacatttctgacatccgccgggtttctgacatccgccgggtttctgacatccgccgggtttctgacatccgccgggtttctgacatccgccgggtttctgacatttctgacatttccgactcggaccgatg

SEQ ID NO: 16578 - DNA, 203 bp, Homo sapiens
  source 1..203: mol_type = other DNA
ggcgcgccagtcctttcggtccaatctgacatttctgacatttctgacatttctgacatttctgacatttctgacatttctgacatccggatggtttctgacatccggatggtttctgacatccggatggtttctgacatccggatggtttctgacatccggatggtttctgacatttctgacatttccgactcggaccgatg

SEQ ID NO: 16579 - DNA, 203 bp, Homo sapiens
  source 1..203: mol_type = other DNA
ggcgcgccagtcctaggtctgacttctgacatttctgacatttctgacatttctgacatttctgacatttctgacatttctgacatccggcgactttctgacatccggcgactttctgacatccggcgactttctgacatccggcgactttctgacatccggcgactttctgacatttctgacatttccgactcggaccgatg

SEQ ID NO: 16580 - DNA, 203 bp, Homo sapiens
  source 1..203: mol_type = other DNA
ggcgcgccagtcctagtgcaactatctgacatttctgacatttctgacatttctgacatttctgacatttctgacatttctgacatccggcggacttctgacatccggcggacttctgacatccggcggacttctgacatccggcggacttctgacatccggcggacttctgacatttctgacatttccgactcggaccgatg

SEQ ID NO: 16581 - DNA, 203 bp, Homo sapiens
  source 1..203: mol_type = other DNA
ggcgcgccagtccttccaactagttctgacatttctgacatttctgacatttctgacatttctgacatttctgacatttctgacatccggcggccttctgacatccggcggccttctgacatccggcggccttctgacatccggcggccttctgacatccggcggccttctgacatttctgacatttccgactcggaccgatg

SEQ ID NO: 16582 - DNA, 203 bp, Homo sapiens
  source 1..203: mol_type = other DNA
ggcgcgccagtcctacatgagacatctgacatttctgacatttctgacatttctgacatttctgacatttctgacatttctgacatccggcgggcttctgacatccggcgggcttctgacatccggcgggcttctgacatccggcgggcttctgacatccggcgggcttctgacatttctgacatttccgactcggaccgatg

SEQ ID NO: 16583 - DNA, 203 bp, Homo sapiens
  source 1..203: mol_type = other DNA
ggcgcgccagtccttaacggtgtatctgacatttctgacatttctgacatttctgacatttctgacatttctgacatttctgacatccggcggggttctgacatccggcggggttctgacatccggcggggttctgacatccggcggggttctgacatccggcggggttctgacatttctgacatttccgactcggaccgatg

SEQ ID NO: 16584 - DNA, 203 bp, Homo sapiens
  source 1..203: mol_type = other DNA
ggcgcgccagtcctttcgatcgattctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16585 - DNA, 203 bp, Homo sapiens
  source 1..203: mol_type = other DNA
ggcgcgccagtcctctgttgtcactctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16586 - DNA, 203 bp, Homo sapiens
  source 1..203: mol_type = other DNA
ggcgcgccagtcctacaacagttttctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16587 - DNA, 203 bp, Homo sapiens
  source 1..203: mol_type = other DNA
ggcgcgccagtcctagcattcacatctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16588 - DNA, 203 bp, Homo sapiens
  source 1..203: mol_type = other DNA
ggcgcgccagtccttgaagttaactctgacatttctgacatttctgacatttctgacatttctgacatttctgacatttctgacatccggcgggtttctgacatccggcgggtttctgacatccggcgggtttctgacatccggcgggtttctgacatccggcgggtttctgacatccggcgggtttccgactcggaccgatg

SEQ ID NO: 16589 - DNA, 203 bp, Homo sapiens
  source 1..203: mol_type = other DNA
ggcgcgccagtcctgtgaagtttatctgacatttctgacatttctgacatttctgacatttctgacatttctgacatttctgacatccggcgggtttctgacatccggcgggtttctgacatccggcgggtttctgacatccggcgggtttctgacatttctgacatttctgacatccggcgggtttccgactcggaccgatg

SEQ ID NO: 16590 - DNA, 203 bp, Homo sapiens
  source 1..203: mol_type = other DNA
ggcgcgccagtcctgttgtagtattctgacatttctgacatttctgacatttctgacatttctgacatttctgacatttctgacatccggcgggtttctgacatccggcgggtttctgacatttctgacatttctgacatccggcgggtttctgacatccggcgggtttctgacatttctgacatttccgactcggaccgatg

SEQ ID NO: 16591 - DNA, 203 bp, Homo sapiens
  source 1..203: mol_type = other DNA
ggcgcgccagtcctgttttgtacttctgacatttctgacatttctgacatttctgacatttctgacatttctgacatttctgacatccggcgggtttctgacatccggcgggtttctgacatttctgacatttctgacatccggcgggtttctgacatttctgacatttctgacatttctgacatttccgactcggaccgatg

SEQ ID NO: 16592 - DNA, 203 bp, Homo sapiens
  source 1..203: mol_type = other DNA
ggcgcgccagtcctgcaaagaatttctgacatttctgacatttctgacatttctgacatttctgacatttctgacatttctgacatccggcgggtttctgacatttctgacatttctgacatccggcgggtttctgacatccggcgggtttctgacatttctgacatttctgacatccggcgggtttccgactcggaccgatg

SEQ ID NO: 16593 - DNA, 203 bp, Homo sapiens
  source 1..203: mol_type = other DNA
ggcgcgccagtcctatgtagaaactctgacatttctgacatttctgacatttctgacatttctgacatttctgacatttctgacatccggcgggtttctgacatttctgacatttctgacatccggcgggtttctgacatttctgacatttctgacatttctgacatttctgacatttctgacatttccgactcggaccgatg

SEQ ID NO: 16594 - DNA, 203 bp, Homo sapiens
  source 1..203: mol_type = other DNA
ggcgcgccagtcctccttgtagaatctgacatttctgacatttctgacatttctgacatttctgacatttctgacatttctgacatccggcgggtttctgacatttctgacatttctgacatttctgacatttctgacatccggcgggtttctgacatccggcgggtttctgacatccggcgggtttccgactcggaccgatg

SEQ ID NO: 16595 - DNA, 203 bp, Homo sapiens
  source 1..203: mol_type = other DNA
ggcgcgccagtcctgcatacattctctgacatttctgacatttctgacatttctgacatttctgacatttctgacatttctgacatccggcgggtttctgacatttctgacatttctgacatttctgacatttctgacatttctgacatttctgacatccggcgggtttctgacatttctgacatttccgactcggaccgatg

SEQ ID NO: 16596 - DNA, 203 bp, Homo sapiens
  source 1..203: mol_type = other DNA
ggcgcgccagtcctcatacagaaatctgacatttctgacatttctgacatttctgacatttctgacatttctgacatttctgacatccggcgggtttctgacatttctgacatttctgacatttctgacatttctgacatttctgacatttctgacatttctgacatttctgacatttcccggcgggtcgactcggaccgatg

SEQ ID NO: 16597 - DNA, 203 bp, Homo sapiens
  source 1..203: mol_type = other DNA
ggcgcgccagtccttcgttgtatgtctgacatttctgacatttctgacatttctgacatttctgacatttctgacatttctgacatccggcggtcttctgacatccggcggtcttctgacatccggcggtcttctgacatccggcggtcttctgacatccggcggtcttctgacatttctgacatttccgactcggaccgatg

SEQ ID NO: 16598 - DNA, 203 bp, Homo sapiens
  source 1..203: mol_type = other DNA
ggcgcgccagtcctatgtatgtagtctgacatttctgacatttctgacatttctgacatttctgacatttctgacatttctgacatccggcggttttctgacatccggcggttttctgacatccggcggttttctgacatccggcggttttctgacatccggcggttttctgacatttctgacatttccgactcggaccgatg

SEQ ID NO: 16599 - DNA, 203 bp, Homo sapiens
  source 1..203: mol_type = other DNA
ggcgcgccagtcctaatctgtatgtctgacatttctgacatttctgacatttctgacatttctgacatttctgacatttctgacatccggctggtttctgacatccggctggtttctgacatccggctggtttctgacatccggctggtttctgacatccggctggtttctgacatttctgacatttccgactcggaccgatg

SEQ ID NO: 16600 - DNA, 203 bp, Homo sapiens
  source 1..203: mol_type = other DNA
ggcgcgccagtcctatcagacgaatctgacatttctgacatttctgacatttctgacatttctgacatttctgacatttctgacatccgggaggtttctgacatccgggaggtttctgacatccgggaggtttctgacatccgggaggtttctgacatccgggaggtttctgacatttctgacatttccgactcggaccgatg

SEQ ID NO: 16601 - DNA, 203 bp, Homo sapiens
  source 1..203: mol_type = other DNA
ggcgcgccagtcctactggtaggatctgacatttctgacatttctgacatttctgacatttctgacatttctgacatttctgacatccggtcggtttctgacatccggtcggtttctgacatccggtcggtttctgacatccggtcggtttctgacatccggtcggtttctgacatttctgacatttccgactcggaccgatg

SEQ ID NO: 16602 - DNA, 203 bp, Homo sapiens
  source 1..203: mol_type = other DNA
ggcgcgccagtcctgatacctctttctgacatttctgacatttctgacatttctgacatttctgacatttctgacatttctgacatccggttggtttctgacatccggttggtttctgacatccggttggtttctgacatccggttggtttctgacatccggttggtttctgacatttctgacatttccgactcggaccgatg

SEQ ID NO: 16603 - DNA, 203 bp, Homo sapiens
  source 1..203: mol_type = other DNA
ggcgcgccagtcctaggatacctctctgacatttctgacatttctgacatttctgacatttctgacatttctgacatttctgacatccgtcgggtttctgacatccgtcgggtttctgacatccgtcgggtttctgacatccgtcgggtttctgacatccgtcgggtttctgacatttctgacatttccgactcggaccgatg

SEQ ID NO: 16604 - DNA, 203 bp, Homo sapiens
  source 1..203: mol_type = other DNA
ggcgcgccagtcctactcagcgtctctgacatttctgacatttctgacatttctgacatttctgacatttctgacatttctgacatcctccgggtttctgacatcctccgggtttctgacatcctccgggtttctgacatcctccgggtttctgacatcctccgggtttctgacatttctgacatttccgactcggaccgatg

SEQ ID NO: 16605 - DNA, 203 bp, Homo sapiens
  source 1..203: mol_type = other DNA
ggcgcgccagtcctgcagttcacatctgacatttctgacatttctgacatttctgacatttctgacatttctgacatttctgacatcgacaattcctttaacatcgacaattcctttaacatcgacaattcctttaacatcgacaattcctttaacatcgacaattcctttaacatttctgacatttccgactcggaccgatg

SEQ ID NO: 16606 - DNA, 203 bp, Homo sapiens
  source 1..203: mol_type = other DNA
ggcgcgccagtcctcctgctgacatctgacatttctgacatttctgacatttctgacatttctgacatttctgacatttctgacatcgccaattcctttaacatcgccaattcctttaacatcgccaattcctttaacatcgccaattcctttaacatcgccaattcctttaacatttctgacatttccgactcggaccgatg

SEQ ID NO: 16607 - DNA, 203 bp, Homo sapiens
  source 1..203: mol_type = other DNA
ggcgcgccagtccttgtcagcatttctgacatttctgacatttctgacatttctgacatttctgacatttctgacatttctgacatcgcgaattcctttaacatcgcgaattcctttaacatcgcgaattcctttaacatcgcgaattcctttaacatcgcgaattcctttaacatttctgacatttccgactcggaccgatg

SEQ ID NO: 16608 - DNA, 203 bp, Homo sapiens
  source 1..203: mol_type = other DNA
ggcgcgccagtccttcgcaagatatctgacatttctgacatttctgacatttctgacatttctgacatttctgacatttctgacatcgctcccatttctgacatcgctcccatttctgacatcgctcccatttctgacatcgctcccatttctgacatcgctcccatttctgacatttctgacatttccgactcggaccgatg

SEQ ID NO: 16609 - DNA, 203 bp, Homo sapiens
  source 1..203: mol_type = other DNA
ggcgcgccagtcctgtggtgattctctgacatttctgacatttctgacatttctgacatttctgacatttctgacatttctgacatcgcttggcaaactgacatcgcttggcaaactgacatcgcttggcaaactgacatcgcttggcaaactgacatcgcttggcaaactgacatttctgacatttccgactcggaccgatg

SEQ ID NO: 16610 - DNA, 203 bp, Homo sapiens
  source 1..203: mol_type = other DNA
ggcgcgccagtccttctgtgcatttctgacatttctgacatttctgacatttctgacatttctgacatttctgacatttctgacatcggcaattcctttaacatcggcaattcctttaacatcggcaattcctttaacatcggcaattcctttaacatcggcaattcctttaacatttctgacatttccgactcggaccgatg

SEQ ID NO: 16611 - DNA, 203 bp, Homo sapiens
  source 1..203: mol_type = other DNA
ggcgcgccagtcctcttgttcagatctgacatttctgacatttctgacatttctgacatttctgacatttctgacatttctgacatcgtcaacgcctttaacatcgtcaacgcctttaacatcgtcaacgcctttaacatcgtcaacgcctttaacatcgtcaacgcctttaacatttctgacatttccgactcggaccgatg

SEQ ID NO: 16612 - DNA, 203 bp, Homo sapiens
  source 1..203: mol_type = other DNA
ggcgcgccagtcctaccactcagatctgacatttctgacatttctgacatttctgacatttctgacatttctgacatttctgacatcgtcaagacctttaacatcgtcaagacctttaacatcgtcaagacctttaacatcgtcaagacctttaacatcgtcaagacctttaacatttctgacatttccgactcggaccgatg

SEQ ID NO: 16613 - DNA, 203 bp, Homo sapiens
  source 1..203: mol_type = other DNA
ggcgcgccagtcctccaggcttcttctgacatttctgacatttctgacatttctgacatttctgacatttctgacatttctgacatcgtcaaggcctttaacatcgtcaaggcctttaacatcgtcaaggcctttaacatcgtcaaggcctttaacatcgtcaaggcctttaacatttctgacatttccgactcggaccgatg

SEQ ID NO: 16614 - DNA, 203 bp, Homo sapiens
  source 1..203: mol_type = other DNA
ggcgcgccagtccttacaacctggtctgacatttctgacatttctgacatttctgacatttctgacatttctgacatttctgacatcgtcaatacctttaacatcgtcaatacctttaacatcgtcaatacctttaacatcgtcaatacctttaacatcgtcaatacctttaacatttctgacatttccgactcggaccgatg

SEQ ID NO: 16615 - DNA, 203 bp, Homo sapiens
  source 1..203: mol_type = other DNA
ggcgcgccagtccttgagcaactgtctgacatttctgacatttctgacatttctgacatttctgacatttctgacatttctgacatcgtcaatgcctttaacatcgtcaatgcctttaacatcgtcaatgcctttaacatcgtcaatgcctttaacatcgtcaatgcctttaacatttctgacatttccgactcggaccgatg

SEQ ID NO: 16616 - DNA, 203 bp, Homo sapiens
  source 1..203: mol_type = other DNA
ggcgcgccagtcctcatgaggccatctgacatttctgacatttctgacatttctgacatttctgacatttctgacatttctgacatcgtcaattagtttaacatcgtcaattagtttaacatcgtcaattagtttaacatcgtcaattagtttaacatcgtcaattagtttaacatttctgacatttccgactcggaccgatg

SEQ ID NO: 16617 - DNA, 203 bp, Homo sapiens
  source 1..203: mol_type = other DNA
ggcgcgccagtccttctgacgatttctgacatttctgacatttctgacatttctgacatttctgacatttctgacatttctgacatcgtcaattcatttaacatcgtcaattcatttaacatcgtcaattcatttaacatcgtcaattcatttaacatcgtcaattcatttaacatttctgacatttccgactcggaccgatg

SEQ ID NO: 16618 - DNA, 203 bp, Homo sapiens
  source 1..203: mol_type = other DNA
ggcgcgccagtcctaggtttcaagtctgacatttctgacatttctgacatttctgacatttctgacatttctgacatttctgacatcgtcaattccaataacatcgtcaattccaataacatcgtcaattccaataacatcgtcaattccaataacatcgtcaattccaataacatttctgacatttccgactcggaccgatg

SEQ ID NO: 16619 - DNA, 203 bp, Homo sapiens
  source 1..203: mol_type = other DNA
ggcgcgccagtcctaatacgttgctctgacatttctgacatttctgacatttctgacatttctgacatttctgacatttctgacatcgtcaattcccgtaacatcgtcaattcccgtaacatcgtcaattcccgtaacatcgtcaattcccgtaacatcgtcaattcccgtaacatttctgacatttccgactcggaccgatg

SEQ ID NO: 16620 - DNA, 203 bp, Homo sapiens
  source 1..203: mol_type = other DNA
ggcgcgccagtcctggcaacgagctctgacatttctgacatttctgacatttctgacatttctgacatttctgacatttctgacatcgtcaattccgttaacatcgtcaattccgttaacatcgtcaattccgttaacatcgtcaattccgttaacatcgtcaattccgttaacatttctgacatttccgactcggaccgatg

SEQ ID NO: 16621 - DNA, 203 bp, Homo sapiens
  source 1..203: mol_type = other DNA
ggcgcgccagtcctctttgtaacatctgacatttctgacatttctgacatttctgacatttctgacatttctgacatttctgacatcgtcaattccttctacatcgtcaattccttctacatcgtcaattccttctacatcgtcaattccttctacatcgtcaattccttctacatttctgacatttccgactcggaccgatg

SEQ ID NO: 16622 - DNA, 203 bp, Homo sapiens
  source 1..203: mol_type = other DNA
ggcgcgccagtcctacaaagcctttctgacatttctgacatttctgacatttctgacatttctgacatttctgacatttctgacatcgtcaattccttgcacatcgtcaattccttgcacatcgtcaattccttgcacatcgtcaattccttgcacatcgtcaattccttgcacatttctgacatttccgactcggaccgatg

SEQ ID NO: 16623 - DNA, 203 bp, Homo sapiens
  source 1..203: mol_type = other DNA
ggcgcgccagtcctgacgaaagcctctgacatttctgacatttctgacatttctgacatttctgacatttctgacatttctgacatcgtcaattcctttaacatcgtcaattcctttaacatcgtcaattcctttaacatcgtcaattcctttaacatcgtcaattcctttaacatttctgacatttccgactcggaccgatg

SEQ ID NO: 16624 - DNA, 203 bp, Homo sapiens
  source 1..203: mol_type = other DNA
ggcgcgccagtcctctgaaaggcctctgacatttctgacatttctgacatttctgacatttctgacatttctgacatttctgacatcgtcaattcctttaacatttctgacatttctgacatttctgacatttctgacatcgtcaattcctttaacatttctgacatttctgacatttctgacatttccgactcggaccgatg

SEQ ID NO: 16625 - DNA, 203 bp, Homo sapiens
  source 1..203: mol_type = other DNA
ggcgcgccagtcctggctctgcaatctgacatttctgacatttctgacatttctgacatttctgacatttctgacatttctgacatcgtcaattcctttcacatcgtcaattcctttcacatcgtcaattcctttcacatcgtcaattcctttcacatcgtcaattcctttcacatttctgacatttccgactcggaccgatg

SEQ ID NO: 16626 - DNA, 203 bp, Homo sapiens
  source 1..203: mol_type = other DNA
ggcgcgccagtcctggcctcacaatctgacatttctgacatttctgacatttctgacatttctgacatttctgacatttctgacatcgtcaattccttttacatcgtcaattccttttacatcgtcaattccttttacatcgtcaattccttttacatcgtcaattccttttacatttctgacatttccgactcggaccgatg

SEQ ID NO: 16627 - DNA, 203 bp, Homo sapiens
  source 1..203: mol_type = other DNA
ggcgcgccagtcctgaagaccacctctgacatttctgacatttctgacatttctgacatttctgacatttctgacatttctgacatcgtcccttcctttaacatcgtcccttcctttaacatcgtcccttcctttaacatcgtcccttcctttaacatcgtcccttcctttaacatttctgacatttccgactcggaccgatg

SEQ ID NO: 16628 - DNA, 203 bp, Homo sapiens
  source 1..203: mol_type = other DNA
ggcgcgccagtcctcacactagcctctgacatttctgacatttctgacatttctgacatttctgacatttctgacatttctgacatcgtccgttcctttaacatcgtccgttcctttaacatcgtccgttcctttaacatcgtccgttcctttaacatcgtccgttcctttaacatttctgacatttccgactcggaccgatg

SEQ ID NO: 16629 - DNA, 203 bp, Homo sapiens
  source 1..203: mol_type = other DNA
ggcgcgccagtcctggtgtcctactctgacatttctgacatttctgacatttctgacatttctgacatttctgacatttctgacatcgtcgattcctttaacatcgtcgattcctttaacatcgtcgattcctttaacatcgtcgattcctttaacatcgtcgattcctttaacatttctgacatttccgactcggaccgatg

SEQ ID NO: 16630 - DNA, 203 bp, Homo sapiens
  source 1..203: mol_type = other DNA
ggcgcgccagtcctggttctgctctctgacatttctgacatttctgacatttctgacatttctgacatttctgacatttctgacatcgtcggttcctttaacatcgtcggttcctttaacatcgtcggttcctttaacatcgtcggttcctttaacatcgtcggttcctttaacatttctgacatttccgactcggaccgatg

SEQ ID NO: 16631 - DNA, 203 bp, Homo sapiens
  source 1..203: mol_type = other DNA
ggcgcgccagtcctggtgctctgttctgacatttctgacatttctgacatttctgacatttctgacatttctgacatttctgacatcgtcgtttcctttaacatcgtcgtttcctttaacatcgtcgtttcctttaacatcgtcgtttcctttaacatcgtcgtttcctttaacatttctgacatttccgactcggaccgatg

SEQ ID NO: 16632 - DNA, 203 bp, Homo sapiens
  source 1..203: mol_type = other DNA
ggcgcgccagtcctggtagccttctctgacatttctgacatttctgacatttctgacatttctgacatttctgacatttctgacatcgtctattcctttaacatcgtctattcctttaacatcgtctattcctttaacatcgtctattcctttaacatcgtctattcctttaacatttctgacatttccgactcggaccgatg

SEQ ID NO: 16633 - DNA, 203 bp, Homo sapiens
  source 1..203: mol_type = other DNA
ggcgcgccagtcctggtgtagagctctgacatttctgacatttctgacatttctgacatttctgacatttctgacatttctgacatcgtctgttcctttaacatcgtctgttcctttaacatcgtctgttcctttaacatcgtctgttcctttaacatcgtctgttcctttaacatttctgacatttccgactcggaccgatg

SEQ ID NO: 16634 - DNA, 203 bp, Homo sapiens
  source 1..203: mol_type = other DNA
ggcgcgccagtcctggtttcggtctctgacatttctgacatttctgacatttctgacatttctgacatttctgacatttctgacatcgtcttttcctttaacatcgtcttttcctttaacatcgtcttttcctttaacatcgtcttttcctttaacatcgtcttttcctttaacatttctgacatttccgactcggaccgatg

SEQ ID NO: 16635 - DNA, 203 bp, Homo sapiens
  source 1..203: mol_type = other DNA
ggcgcgccagtcctggactgagtctctgacatttctgacatttctgacatttctgacatttctgacatttctgacatttctgacatctcggccgtttctgacatctcggccgtttctgacatctcggccgtttctgacatctcggccgtttctgacatctcggccgtttctgacatttctgacatttccgactcggaccgatg

SEQ ID NO: 16636 - DNA, 203 bp, Homo sapiens
  source 1..203: mol_type = other DNA
ggcgcgccagtcctgacatgacgatctgacatttctgacatttctgacatttctgacatttctgacatttctgacatttctgacatctcttggcaaactgacatctcttggcaaactgacatctcttggcaaactgacatctcttggcaaactgacatctcttggcaaactgacatttctgacatttccgactcggaccgatg

SEQ ID NO: 16637 - DNA, 203 bp, Homo sapiens
  source 1..203: mol_type = other DNA
ggcgcgccagtcctcctctttgtgtctgacatttctgacatttctgacatttctgacatttctgacatttctgacatttctgacatctggcgggtttctgacatctggcgggtttctgacatctggcgggtttctgacatctggcgggtttctgacatctggcgggtttctgacatttctgacatttccgactcggaccgatg

SEQ ID NO: 16638 - DNA, 203 bp, Homo sapiens
  source 1..203: mol_type = other DNA
ggcgcgccagtcctagaatctttttctgacatttctgacatttctgacatttctgacatttctgacatttctgacatttctgacatcttcaattcctttaacatcttcaattcctttaacatcttcaattcctttaacatcttcaattcctttaacatcttcaattcctttaacatttctgacatttccgactcggaccgatg

SEQ ID NO: 16639 - DNA, 203 bp, Homo sapiens
  source 1..203: mol_type = other DNA
ggcgcgccagtcctctctcgtagctctgacatttctgacatttctgacatttctgacatttctgacatttctgacatttctgacatgatcaattcctttaacatgatcaattcctttaacatgatcaattcctttaacatgatcaattcctttaacatgatcaattcctttaacatttctgacatttccgactcggaccgatg

SEQ ID NO: 16640 - DNA, 203 bp, Homo sapiens
  source 1..203: mol_type = other DNA
ggcgcgccagtcctgctctacgaatctgacatttctgacatttctgacatttctgacatttctgacatttctgacatttctgacatgccggccgtttctgacatgccggccgtttctgacatgccggccgtttctgacatgccggccgtttctgacatgccggccgtttctgacatttctgacatttccgactcggaccgatg

SEQ ID NO: 16641 - DNA, 203 bp, Homo sapiens
  source 1..203: mol_type = other DNA
ggcgcgccagtcctcctacgaatctctgacatttctgacatttctgacatttctgacatttctgacatttctgacatttctgacatgcggcgggtttctgacatgcggcgggtttctgacatgcggcgggtttctgacatgcggcgggtttctgacatgcggcgggtttctgacatttctgacatttccgactcggaccgatg

SEQ ID NO: 16642 - DNA, 203 bp, Homo sapiens
  source 1..203: mol_type = other DNA
ggcgcgccagtcctttcactacgatctgacatttctgacatttctgacatttctgacatttctgacatttctgacatttctgacatgctcaattcctttaacatgctcaattcctttaacatgctcaattcctttaacatgctcaattcctttaacatgctcaattcctttaacatttctgacatttccgactcggaccgatg

SEQ ID NO: 16643 - DNA, 203 bp, Homo sapiens
  source 1..203: mol_type = other DNA
ggcgcgccagtccttccatggacctctgacatttctgacatttctgacatttctgacatttctgacatttctgacatttctgacatggtcaattcctttaacatggtcaattcctttaacatggtcaattcctttaacatggtcaattcctttaacatggtcaattcctttaacatttctgacatttccgactcggaccgatg

SEQ ID NO: 16644 - DNA, 203 bp, Homo sapiens
  source 1..203: mol_type = other DNA
ggcgcgccagtcctatgtgtcctttctgacatttctgacatttctgacatttctgacatttctgacatttctgacatttctgacatgtcggaatcgagaaacatgtcggaatcgagaaacatgtcggaatcgagaaacatgtcggaatcgagaaacatgtcggaatcgagaaacatttctgacatttccgactcggaccgatg

SEQ ID NO: 16645 - DNA, 203 bp, Homo sapiens
  source 1..203: mol_type = other DNA
ggcgcgccagtcctacactgcagttctgacatttctgacatttctgacatttctgacatttctgacatttctgacatttctgacatgtggcgggtttctgacatgtggcgggtttctgacatgtggcgggtttctgacatgtggcgggtttctgacatgtggcgggtttctgacatttctgacatttccgactcggaccgatg

SEQ ID NO: 16646 - DNA, 203 bp, Homo sapiens
  source 1..203: mol_type = other DNA
ggcgcgccagtcctgtcgtcatgttctgacatttctgacatttctgacatttctgacatttctgacatttctgacatttctgacattaaccccatttctgacattaaccccatttctgacattaaccccatttctgacattaaccccatttctgacattaaccccatttctgacatttctgacatttccgactcggaccgatg

SEQ ID NO: 16647 - DNA, 203 bp, Homo sapiens
  source 1..203: mol_type = other DNA
ggcgcgccagtcctcagtcaccattctgacatttctgacatttctgacatttctgacatttctgacatttctgacatttctgacattaacggccatgcaccaccacccacggaatcgagaaagagctatcaatctgtcaattctgacatttctgacatttctgacatttctgacatttctgacatttccgactcggaccgatg

SEQ ID NO: 16648 - DNA, 203 bp, Homo sapiens
  source 1..203: mol_type = other DNA
ggcgcgccagtcctgatcaagcagtctgacatttctgacatttctgacatttctgacatttctgacatttctgacatttctgacattaagcccatttctgacattaagcccatttctgacattaagcccatttctgacattaagcccatttctgacattaagcccatttctgacatttctgacatttccgactcggaccgatg

SEQ ID NO: 16649 - DNA, 203 bp, Homo sapiens
  source 1..203: mol_type = other DNA
ggcgcgccagtccttgtaacaaggtctgacatttctgacatttctgacatttctgacatttctgacatttctgacatttctgacattaatcccatttctgacattaatcccatttctgacattaatcccatttctgacattaatcccatttctgacattaatcccatttctgacatttctgacatttccgactcggaccgatg

SEQ ID NO: 16650 - DNA, 203 bp, Homo sapiens
  source 1..203: mol_type = other DNA
ggcgcgccagtcctgccttgttaatctgacatttctgacatttctgacatttctgacatttctgacatttctgacatttctgacattacggaatcgagaaacattacggaatcgagaaacattacggaatcgagaaacattacggaatcgagaaacattacggaatcgagaaacatttctgacatttccgactcggaccgatg

SEQ ID NO: 16651 - DNA, 203 bp, Homo sapiens
  source 1..203: mol_type = other DNA
ggcgcgccagtcctacagttgatttctgacatttctgacatttctgacatttctgacatttctgacatttctgacatttctgacattactagcatttctgacattactagcatttctgacattactagcatttctgacattactagcatttctgacattactagcatttctgacatttctgacatttccgactcggaccgatg

SEQ ID NO: 16652 - DNA, 203 bp, Homo sapiens
  source 1..203: mol_type = other DNA
ggcgcgccagtcctttgctagagatctgacatttctgacatttctgacatttctgacatttctgacatttctgacatttctgacattactcagatttctgacattactcagatttctgacattactcagatttctgacattactcagatttctgacattactcagatttctgacatttctgacatttccgactcggaccgatg

SEQ ID NO: 16653 - DNA, 203 bp, Homo sapiens
  source 1..203: mol_type = other DNA
ggcgcgccagtccttctagcaaactctgacatttctgacatttctgacatttctgacatttctgacatttctgacatttctgacattactcccatttctgacattactcccatttctgacattactcccatttctgacattactcccatttctgacattactcccatttctgacattactcccatttccgactcggaccgatg

SEQ ID NO: 16654 - DNA, 203 bp, Homo sapiens
  source 1..203: mol_type = other DNA
ggcgcgccagtcctgtagcaaacatctgacatttctgacatttctgacatttctgacatttctgacatttctgacatttctgacattactcccatttctgacattactcccatttctgacattactcccatttctgacattactcccatttctgacattactcccatttctgacatttctgacatttccgactcggaccgatg

SEQ ID NO: 16655 - DNA, 203 bp, Homo sapiens
  source 1..203: mol_type = other DNA
ggcgcgccagtcctttaaagctaatctgacatttctgacatttctgacatttctgacatttctgacatttctgacatttctgacattactcccatttctgacattactcccatttctgacattactcccatttctgacattactcccatttctgacatttctgacatttctgacatttctgacatttccgactcggaccgatg

SEQ ID NO: 16656 - DNA, 203 bp, Homo sapiens
  source 1..203: mol_type = other DNA
ggcgcgccagtccttaggatcgtctctgacatttctgacatttctgacatttctgacatttctgacatttctgacatttctgacattactcccatttctgacattactcccatttctgacattactcccatttctgacatttctgacatttctgacattactcccatttctgacattactcccatttccgactcggaccgatg

SEQ ID NO: 16657 - DNA, 203 bp, Homo sapiens
  source 1..203: mol_type = other DNA
ggcgcgccagtcctggatcgtcagtctgacatttctgacatttctgacatttctgacatttctgacatttctgacatttctgacattactcccatttctgacattactcccatttctgacattactcccatttctgacatttctgacatttctgacattactcccatttctgacatttctgacatttccgactcggaccgatg

SEQ ID NO: 16658 - DNA, 203 bp, Homo sapiens
  source 1..203: mol_type = other DNA
ggcgcgccagtccttgcttgggtctctgacatttctgacatttctgacatttctgacatttctgacatttctgacatttctgacattactcccatttctgacattactcccatttctgacattactcccatttctgacatttctgacatttctgacatttctgacatttctgacattactcccatttccgactcggaccgatg

SEQ ID NO: 16659 - DNA, 203 bp, Homo sapiens
  source 1..203: mol_type = other DNA
ggcgcgccagtccttctcttacagtctgacatttctgacatttctgacatttctgacatttctgacatttctgacatttctgacattactcccatttctgacattactcccatttctgacattactcccatttctgacatttctgacatttctgacatttctgacatttctgacatttctgacatttccgactcggaccgatg

SEQ ID NO: 16660 - DNA, 203 bp, Homo sapiens
  source 1..203: mol_type = other DNA
ggcgcgccagtccttcctgtgaactctgacatttctgacatttctgacatttctgacatttctgacatttctgacatttctgacattactcccatttctgacattactcccatttctgacatttctgacatttctgacattactcccatttctgacatttctgacatttctgacattactcccatttccgactcggaccgatg

SEQ ID NO: 16661 - DNA, 203 bp, Homo sapiens
  source 1..203: mol_type = other DNA
ggcgcgccagtcctgaaaccgtactctgacatttctgacatttctgacatttctgacatttctgacatttctgacatttctgacattactcccatttctgacattactcccatttctgacatttctgacatttctgacatttctgacatttctgacatttctgacatttctgacattactcccatttccgactcggaccgatg

SEQ ID NO: 16662 - DNA, 203 bp, Homo sapiens
  source 1..203: mol_type = other DNA
ggcgcgccagtcctgtacggtgagtctgacatttctgacatttctgacatttctgacatttctgacatttctgacatttctgacattactcccatttctgacattactcccatttctgacatttctgacatttctgacatttctgacatttctgacatttctgacatttctgacatttctgacatttccgactcggaccgatg

SEQ ID NO: 16663 - DNA, 203 bp, Homo sapiens
  source 1..203: mol_type = other DNA
ggcgcgccagtccttagtacggtatctgacatttctgacatttctgacatttctgacatttctgacatttctgacatttctgacattactcccatttctgacatttctgacatttctgacattactcccatttctgacattactcccatttctgacattactcccatttctgacattactcccatttccgactcggaccgatg

SEQ ID NO: 16664 - DNA, 203 bp, Homo sapiens
  source 1..203: mol_type = other DNA
ggcgcgccagtcctggtacggtgatctgacatttctgacatttctgacatttctgacatttctgacatttctgacatttctgacattactcccatttctgacatttctgacatttctgacattactcccatttctgacattactcccatttctgacattactcccatttctgacatttctgacatttccgactcggaccgatg

SEQ ID NO: 16665 - DNA, 203 bp, Homo sapiens
  source 1..203: mol_type = other DNA
ggcgcgccagtccttcaggacacatctgacatttctgacatttctgacatttctgacatttctgacatttctgacatttctgacattactcccatttctgacatttctgacatttctgacattactcccatttctgacattactcccatttctgacatttctgacatttctgacattactcccatttccgactcggaccgatg

SEQ ID NO: 16666 - DNA, 203 bp, Homo sapiens
  source 1..203: mol_type = other DNA
ggcgcgccagtcctggcagtcgtatctgacatttctgacatttctgacatttctgacatttctgacatttctgacatttctgacattactcccatttctgacatttctgacatttctgacattactcccatttctgacattactcccatttctgacatttctgacatttctgacatttctgacatttccgactcggaccgatg

SEQ ID NO: 16667 - DNA, 203 bp, Homo sapiens
  source 1..203: mol_type = other DNA
ggcgcgccagtcctccaggctgtatctgacatttctgacatttctgacatttctgacatttctgacatttctgacatttctgacattactcccatttctgacatttctgacatttctgacattactcccatttctgacatttctgacatttctgacattactcccatttctgacattactcccatttccgactcggaccgatg

SEQ ID NO: 16668 - DNA, 203 bp, Homo sapiens
  source 1..203: mol_type = other DNA
ggcgcgccagtcctcctcactgcctctgacatttctgacatttctgacatttctgacatttctgacatttctgacatttctgacattactcccatttctgacatttctgacatttctgacattactcccatttctgacatttctgacatttctgacattactcccatttctgacatttctgacatttccgactcggaccgatg

SEQ ID NO: 16669 - DNA, 203 bp, Homo sapiens
  source 1..203: mol_type = other DNA
ggcgcgccagtccttaggctgtgttctgacatttctgacatttctgacatttctgacatttctgacatttctgacatttctgacattactcccatttctgacatttctgacatttctgacattactcccatttctgacatttctgacatttctgacatttctgacatttctgacattactcccatttccgactcggaccgatg

SEQ ID NO: 16670 - DNA, 203 bp, Homo sapiens
  source 1..203: mol_type = other DNA
ggcgcgccagtcctggctgtcaggtctgacatttctgacatttctgacatttctgacatttctgacatttctgacatttctgacattactcccatttctgacatttctgacatttctgacatttctgacatttctgacattactcccatttctgacattactcccatttctgacattactcccatttccgactcggaccgatg

SEQ ID NO: 16671 - DNA, 203 bp, Homo sapiens
  source 1..203: mol_type = other DNA
ggcgcgccagtccttacactgccttctgacatttctgacatttctgacatttctgacatttctgacatttctgacatttctgacattactcccatttctgacatttctgacatttctgacatttctgacatttctgacattactcccatttctgacattactcccatttctgacatttctgacatttccgactcggaccgatg

SEQ ID NO: 16672 - DNA, 203 bp, Homo sapiens
  source 1..203: mol_type = other DNA
ggcgcgccagtcctaggcagtctttctgacatttctgacatttctgacatttctgacatttctgacatttctgacatttctgacattactcccatttctgacatttctgacatttctgacatttctgacatttctgacattactcccatttctgacatttctgacatttctgacatttctgacatttccgactcggaccgatg

SEQ ID NO: 16673 - DNA, 203 bp, Homo sapiens
  source 1..203: mol_type = other DNA
ggcgcgccagtccttcatggtggatctgacatttctgacatttctgacatttctgacatttctgacatttctgacatttctgacattactcccatttctgacatttctgacatttctgacatttctgacatttctgacatttctgacatttctgacattactcccatttctgacatttctgacatttccgactcggaccgatg

SEQ ID NO: 16674 - DNA, 203 bp, Homo sapiens
  source 1..203: mol_type = other DNA
ggcgcgccagtcctttaaggatcttctgacatttctgacatttctgacatttctgacatttctgacatttctgacatttctgacattactcccatttctgacatttctgacatttctgacatttctgacatttctgacatttctgacatttctgacatttctgacatttctgacattactcccatttccgactcggaccgatg

SEQ ID NO: 16675 - DNA, 203 bp, Homo sapiens
  source 1..203: mol_type = other DNA
ggcgcgccagtcctctctaccagatctgacatttctgacatttctgacatttctgacatttctgacatttctgacatttctgacattactcgtatttctgacattactcgtatttctgacattactcgtatttctgacattactcgtatttctgacattactcgtatttctgacatttctgacatttccgactcggaccgatg

SEQ ID NO: 16676 - DNA, 203 bp, Homo sapiens
  source 1..203: mol_type = other DNA
ggcgcgccagtcctacaggcttactctgacatttctgacatttctgacatttctgacatttctgacatttctgacatttctgacattactgacatttctgacattactgacatttctgacattactgacatttctgacattactgacatttctgacattactgacatttctgacatttctgacatttccgactcggaccgatg

SEQ ID NO: 16677 - DNA, 203 bp, Homo sapiens
  source 1..203: mol_type = other DNA
ggcgcgccagtcctaggacaacagtctgacatttctgacatttctgacatttctgacatttctgacatttctgacatttctgacattacttggcaaactgacattacttggcaaactgacattacttggcaaactgacattacttggcaaactgacattacttggcaaactgacatttctgacatttccgactcggaccgatg

SEQ ID NO: 16678 - DNA, 203 bp, Homo sapiens
  source 1..203: mol_type = other DNA
ggcgcgccagtcctgctacgagtttctgacatttctgacatttctgacatttctgacatttctgacatttctgacatttctgacattactttcatttctgacattactttcatttctgacattactttcatttctgacattactttcatttctgacattactttcatttctgacatttctgacatttccgactcggaccgatg

SEQ ID NO: 16679 - DNA, 203 bp, Homo sapiens
  source 1..203: mol_type = other DNA
ggcgcgccagtcctcctgagacaatctgacatttctgacatttctgacatttctgacatttctgacatttctgacatttctgacattagccccatttctgacattagccccatttctgacattagccccatttctgacattagccccatttctgacattagccccatttctgacatttctgacatttccgactcggaccgatg

SEQ ID NO: 16680 - DNA, 203 bp, Homo sapiens
  source 1..203: mol_type = other DNA
ggcgcgccagtcctgtagacaacttctgacatttctgacatttctgacatttctgacatttctgacatttctgacatttctgacattaggcccatttctgacattaggcccatttctgacattaggcccatttctgacattaggcccatttctgacattaggcccatttctgacatttctgacatttccgactcggaccgatg

SEQ ID NO: 16681 - DNA, 203 bp, Homo sapiens
  source 1..203: mol_type = other DNA
ggcgcgccagtccttcagacaagctctgacatttctgacatttctgacatttctgacatttctgacatttctgacatttctgacattaggcgggtttctgacattaggcgggtttctgacattaggcgggtttctgacattaggcgggtttctgacattaggcgggtttctgacatttctgacatttccgactcggaccgatg

SEQ ID NO: 16682 - DNA, 203 bp, Homo sapiens
  source 1..203: mol_type = other DNA
ggcgcgccagtcctcatgggtatttctgacatttctgacatttctgacatttctgacatttctgacatttctgacatttctgacattccggaatcgagaaacattccggaatcgagaaacattccggaatcgagaaacattccggaatcgagaaacattccggaatcgagaaacatttctgacatttccgactcggaccgatg

SEQ ID NO: 16683 - DNA, 203 bp, Homo sapiens
  source 1..203: mol_type = other DNA
ggcgcgccagtcctgtcatgttcatctgacatttctgacatttctgacatttctgacatttctgacatttctgacatttctgacattcctcccatttctgacattcctcccatttctgacattcctcccatttctgacattcctcccatttctgacattcctcccatttctgacatttctgacatttccgactcggaccgatg

SEQ ID NO: 16684 - DNA, 203 bp, Homo sapiens
  source 1..203: mol_type = other DNA
ggcgcgccagtcctgtgagaagtttctgacatttctgacatttctgacatttctgacatttctgacatttctgacatttctgacattgcggccgtttctgacattgcggccgtttctgacattgcggccgtttctgacattgcggccgtttctgacattgcggccgtttctgacatttctgacatttccgactcggaccgatg

SEQ ID NO: 16685 - DNA, 203 bp, Homo sapiens
  source 1..203: mol_type = other DNA
ggcgcgccagtcctgtatctaagttctgacatttctgacatttctgacatttctgacatttctgacatttctgacatttctgacattgctcccatttctgacattgctcccatttctgacattgctcccatttctgacattgctcccatttctgacattgctcccatttctgacatttctgacatttccgactcggaccgatg

SEQ ID NO: 16686 - DNA, 203 bp, Homo sapiens
  source 1..203: mol_type = other DNA
ggcgcgccagtccttctaagctcatctgacatttctgacatttctgacatttctgacatttctgacatttctgacatttctgacattgggcgggtttctgacattgggcgggtttctgacattgggcgggtttctgacattgggcgggtttctgacattgggcgggtttctgacatttctgacatttccgactcggaccgatg

SEQ ID NO: 16687 - DNA, 203 bp, Homo sapiens
  source 1..203: mol_type = other DNA
ggcgcgccagtcctaatctaaggatctgacatttctgacatttctgacatttctgacatttctgacatttctgacatttctgacattgtcaattcctttaacattgtcaattcctttaacattgtcaattcctttaacattgtcaattcctttaacattgtcaattcctttaacatttctgacatttccgactcggaccgatg

SEQ ID NO: 16688 - DNA, 203 bp, Homo sapiens
  source 1..203: mol_type = other DNA
ggcgcgccagtcctccacttagactctgacatttctgacatttctgacatttctgacatttctgacatttctgacatttctgacatttaccggccgtctgacatttctgacatttctgacatttctgacatttctgacatttctgacatttctgacatttctgacatttctgacatttctgtactccccgactcggaccgatg

SEQ ID NO: 16689 - DNA, 203 bp, Homo sapiens
  source 1..203: mol_type = other DNA
ggcgcgccagtccttcttagactgtctgacatttctgacatttctgacatttctgacatttctgacatttctgacatttctgacatttaccggccgtctgacatttctgacatttctgacatttctgacatttctgacatttctgacatttctgacatttctgacatttctgaccacggaatcgagaacgactcggaccgatg

SEQ ID NO: 16690 - DNA, 203 bp, Homo sapiens
  source 1..203: mol_type = other DNA
ggcgcgccagtccttcttagagactctgacatttctgacatttctgacatttctgacatttctgacatttctgacatttctgacatttaccggccgtctgacatttctgacatttctgacatttctgacatttctgacatttctgacatttctgacatttctgacatttctgaccgtcaattcctttacgactcggaccgatg

SEQ ID NO: 16691 - DNA, 203 bp, Homo sapiens
  source 1..203: mol_type = other DNA
ggcgcgccagtcctccaccgtgcctctgacatttctgacatttctgacatttctgacatttctgacatttctgacatttctgacatttactggcaaactgacatttactggcaaactgacatttactggcaaactgacatttactggcaaactgacatttactggcaaactgacatttctgacatttccgactcggaccgatg

SEQ ID NO: 16692 - DNA, 203 bp, Homo sapiens
  source 1..203: mol_type = other DNA
ggcgcgccagtcctagtttgggtatctgacatttctgacatttctgacatttctgacatttctgacatttctgacatttctgacatttcagccattcgcagtttcactgtaccggccgtgcgtactcagacatgcatggtttctgacatttctgacatttctgacatttctgacatttctgacatttccgactcggaccgatg

SEQ ID NO: 16693 - DNA, 203 bp, Homo sapiens
  source 1..203: mol_type = other DNA
ggcgcgccagtcctcaacagtgactctgacatttctgacatttctgacatttctgacatttctgacatttctgacatttctgacatttccggccatgcaccaccacccacggaatcgagaaagagctatcaatctgtcatttctgacatttctgacatttctgacatttctgacatttctgacatttccgactcggaccgatg

SEQ ID NO: 16694 - DNA, 203 bp, Homo sapiens
  source 1..203: mol_type = other DNA
ggcgcgccagtcctttgaacagcatctgacatttctgacatttctgacatttctgacatttctgacatttctgacatttctgacatttccggcgggtctgacatttctgacatttctgacatttctgacatttctgacatttctgacatttctgacatttctgacatttctgacatttctgtactccccgactcggaccgatg

SEQ ID NO: 16695 - DNA, 203 bp, Homo sapiens
  source 1..203: mol_type = other DNA
ggcgcgccagtcctaacgctactctctgacatttctgacatttctgacatttctgacatttctgacatttctgacatttctgacatttcctggcaaactgacatttcctggcaaactgacatttcctggcaaactgacatttcctggcaaactgacatttcctggcaaactgacatttctgacatttccgactcggaccgatg

SEQ ID NO: 16696 - DNA, 203 bp, Homo sapiens
  source 1..203: mol_type = other DNA
ggcgcgccagtcctcagatcagtgtctgacatttctgacatttctgacatttctgacatttctgacatttctgacatttctgacatttcggccgtttctgacatttcggccgtttctgacatttcggccgtttctgacatttcggccgtttctgacatttcggccgtttctgacatttctgacatttccgactcggaccgatg

SEQ ID NO: 16697 - DNA, 203 bp, Homo sapiens
  source 1..203: mol_type = other DNA
ggcgcgccagtcctgactgcagtctctgacatttctgacatttctgacatttctgacatttctgacatttctgacatttctgacatttcgtcaattcctttaatttctgacatttctgacatttctgacatttctgacatttctgacatttctgacatttctgacatttctgacatttcaccggccgtcgactcggaccgatg

SEQ ID NO: 16698 - DNA, 203 bp, Homo sapiens
  source 1..203: mol_type = other DNA
ggcgcgccagtcctcttaacacattctgacatttctgacatttctgacatttctgacatttctgacatttctgacatttctgacatttcgtcaattcctttaatttctgacatttctgacatttctgacatttctgacatttctgacatttctgacatttctgacatttctgacatttcccggcgggtcgactcggaccgatg

SEQ ID NO: 16699 - DNA, 203 bp, Homo sapiens
  source 1..203: mol_type = other DNA
ggcgcgccagtcctaggttgacgatctgacatttctgacatttctgacatttctgacatttctgacatttctgacatttctgacatttcgttcttgattaatgaaaacattcttggcaaatgctttcgctctggtccgtcttctgacatttctgacatttctgacatttctgacatttctgacatttccgactcggaccgatg

SEQ ID NO: 16700 - DNA, 203 bp, Homo sapiens
  source 1..203: mol_type = other DNA
ggcgcgccagtcctctcgtcaacctctgacatttctgacatttctgacatttctgacatttctgacatttctgacatttctgacatttcgttcttgattaatgaaaacattcttggcaaatgctttcgctctggtccgttttctgacatttctgacatttctgacatttctgacatttctgacatttccgactcggaccgatg

SEQ ID NO: 16701 - DNA, 203 bp, Homo sapiens
  source 1..203: mol_type = other DNA
ggcgcgccagtcctgaggatcacttctgacatttctgacatttctgacatttctgacatttctgacatttctgacatttctgacatttctaggcaaactgacatttctaggcaaactgacatttctaggcaaactgacatttctaggcaaactgacatttctaggcaaactgacatttctgacatttccgactcggaccgatg

SEQ ID NO: 16702 - DNA, 203 bp, Homo sapiens
  source 1..203: mol_type = other DNA
ggcgcgccagtcctcactgggttctctgacatttctgacatttctgacatttctgacatttctgacatttctgacatttctgacatttctcacggaatcgagaattctgacatttctgacatttctgacatttctgacatttctgacatttctgacatttctgacatttctgaccacggaatcgagaacgactcggaccgatg

SEQ ID NO: 16703 - DNA, 203 bp, Homo sapiens
  source 1..203: mol_type = other DNA
ggcgcgccagtcctgacccagtattctgacatttctgacatttctgacatttctgacatttctgacatttctgacatttctgacatttctcacggaatcgagaattctgacatttctgacatttctgacatttctgacatttctgacatttctgacatttctgacatttctgaccgtcaattcctttacgactcggaccgatg

SEQ ID NO: 16704 - DNA, 203 bp, Homo sapiens
  source 1..203: mol_type = other DNA
ggcgcgccagtcctacccagtatgtctgacatttctgacatttctgacatttctgacatttctgacatttctgacatttctgacatttctcagcaaactgacatttctcagcaaactgacatttctcagcaaactgacatttctcagcaaactgacatttctcagcaaactgacatttctgacatttccgactcggaccgatg

SEQ ID NO: 16705 - DNA, 203 bp, Homo sapiens
  source 1..203: mol_type = other DNA
ggcgcgccagtcctcccagtttgctctgacatttctgacatttctgacatttctgacatttctgacatttctgacatttctgacatttctcgattccgtgacatttctcgattccgtgacatttctcgattccgtgacatttctcgattccgtgacatttctcgattccgtgacatttctgacatttccgactcggaccgatg

SEQ ID NO: 16706 - DNA, 203 bp, Homo sapiens
  source 1..203: mol_type = other DNA
ggcgcgccagtcctgatcctgaactctgacatttctgacatttctgacatttctgacatttctgacatttctgacatttctgacatttctcggcaaactgacatttctcggcaaactgacatttctcggcaaactgacatttctcggcaaactgacatttctcggcaaactgacatttctgacatttccgactcggaccgatg

SEQ ID NO: 16707 - DNA, 203 bp, Homo sapiens
  source 1..203: mol_type = other DNA
ggcgcgccagtcctaaacggtgcctctgacatttctgacatttctgacatttctgacatttctgacatttctgacatttctgacatttctgaagtttcagctttgcaaccatactccccccggaacccaaagacttacatttctgacatttctgacatttctgacatttctgacatttctgacatttccgactcggaccgatg

SEQ ID NO: 16708 - DNA, 203 bp, Homo sapiens
  source 1..203: mol_type = other DNA
ggcgcgccagtcctagagaggatctctgacatttctgacatttctgacatttctgacatttctgacatttctgacatttctgacatttctgacaccggccgtatttctgacatttctgacatttctgacatttctgacatttctgacatttctgacatttctgacatttctgacatttcccggcgggtcgactcggaccgatg

SEQ ID NO: 16709 - DNA, 203 bp, Homo sapiens
  source 1..203: mol_type = other DNA
ggcgcgccagtcctatgggttaaatctgacatttctgacatttctgacatttctgacatttctgacatttctgacatttctgacatttctgacagtttcccggaagctgcccggcgggtcatgggaataacgcctgacatttctgacatttctgacatttctgacatttctgacatttctgacatttccgactcggaccgatg

SEQ ID NO: 16710 - DNA, 203 bp, Homo sapiens
  source 1..203: mol_type = other DNA
ggcgcgccagtcctagttaaaggatctgacatttctgacatttctgacatttctgacatttctgacatttctgacatttctgacatttctgacataccggccgtttctgacatttctgacatttctgacatttctgacatttctgacatttctgacatttctgacatttctgacatttctgacatttccgactcggaccgatg

SEQ ID NO: 16711 - DNA, 203 bp, Homo sapiens
  source 1..203: mol_type = other DNA
ggcgcgccagtcctcgaaaactgttctgacatttctgacatttctgacatttctgacatttctgacatttctgacatttctgacatttctgacatccggcgggtttctgacatttctgacatttctgacatttctgacatttctgacatttctgacatttctgacatttctgacatttctgtactccccgactcggaccgatg

SEQ ID NO: 16712 - DNA, 203 bp, Homo sapiens
  source 1..203: mol_type = other DNA
ggcgcgccagtccttgtatcctcgtctgacatttctgacatttctgacatttctgacatttctgacatttctgacatttctgacatttctgacatccggcgggtttctgacatttctgacatttctgacatttctgacatttctgacatttctgacatttctgacatttctgaccgtcaattcctttacgactcggaccgatg

SEQ ID NO: 16713 - DNA, 203 bp, Homo sapiens
  source 1..203: mol_type = other DNA
ggcgcgccagtcctcgaaaaccagtctgacatttctgacatttctgacatttctgacatttctgacatttctgacatttctgacatttctgacatcgtcaattcctttaacatttctgacatttctgacatttctgacatttctgacatttctgacatttctgacatttctgacatttcaccggccgtcgactcggaccgatg

SEQ ID NO: 16714 - DNA, 203 bp, Homo sapiens
  source 1..203: mol_type = other DNA
ggcgcgccagtcctggaccactcgtctgacatttctgacatttctgacatttctgacatttctgacatttctgacatttctgacatttctgacatgattaatgaaaacattcttggcaaatgctttcgctctgctgacatttctgacatttctgacatttctgacatttctgacatttctgacatttccgactcggaccgatg

SEQ ID NO: 16715 - DNA, 203 bp, Homo sapiens
  source 1..203: mol_type = other DNA
ggcgcgccagtcctttgagtatcgtctgacatttctgacatttctgacatttctgacatttctgacatttctgacatttctgacatttctgacatgtggtgcccttccgtcaattcctttaagtttcagctttctgacatttctgacatttctgacatttctgacatttctgacatttctgacatttccgactcggaccgatg

SEQ ID NO: 16716 - DNA, 203 bp, Homo sapiens
  source 1..203: mol_type = other DNA
ggcgcgccagtcctttactgctcgtctgacatttctgacatttctgacatttctgacatttctgacatttctgacatttctgacatttctgacattcgcagtttcactgtaccggccgtgcgtactcagacatctgacatttctgacatttctgacatttctgacatttctgacatttctgacatttccgactcggaccgatg

SEQ ID NO: 16717 - DNA, 203 bp, Homo sapiens
  source 1..203: mol_type = other DNA
ggcgcgccagtcctcgaagcagtttctgacatttctgacatttctgacatttctgacatttctgacatttctgacatttctgacatttctgacattcgcagtttcactgtaccggccgtgcgtactcagacatgcgacatttctgacatttctgacatttctgacatttctgacatttctgacatttccgactcggaccgatg

SEQ ID NO: 16718 - DNA, 203 bp, Homo sapiens
  source 1..203: mol_type = other DNA
ggcgcgccagtcctgttggactcgtctgacatttctgacatttctgacatttctgacatttctgacatttctgacatttctgacatttctgacattgcaccaccacccacggaatcgagaaagagctatcaatctgacatttctgacatttctgacatttctgacatttctgacatttctgacatttccgactcggaccgatg

SEQ ID NO: 16719 - DNA, 203 bp, Homo sapiens
  source 1..203: mol_type = other DNA
ggcgcgccagtcctatccacctcgtctgacatttctgacatttctgacatttctgacatttctgacatttctgacatttctgacatttctgacatttcaccggccgttgacatttctgacatttctgacatttctgacatttctgacatttctgacatttctgacatttctgacattttcttggcaaacgactcggaccgatg

SEQ ID NO: 16720 - DNA, 203 bp, Homo sapiens
  source 1..203: mol_type = other DNA
ggcgcgccagtcctgaggccttcgtctgacatttctgacatttctgacatttctgacatttctgacatttctgacatttctgacatttctgacatttcacggaatcgagaaatttctgacatttctgacatttctgacatttctgacatttctgacatttctgacatttctgaccacggaatcgagaacgactcggaccgatg

SEQ ID NO: 16721 - DNA, 203 bp, Homo sapiens
  source 1..203: mol_type = other DNA
ggcgcgccagtcctcgacaacgtttctgacatttctgacatttctgacatttctgacatttctgacatttctgacatttctgacatttctgacatttcagctttgcaaccatactccccccggaacccaaagtctgacatttctgacatttctgacatttctgacatttctgacatttctgacatttccgactcggaccgatg

SEQ ID NO: 16722 - DNA, 203 bp, Homo sapiens
  source 1..203: mol_type = other DNA
ggcgcgccagtcctcgactctgtgtctgacatttctgacatttctgacatttctgacatttctgacatttctgacatttctgacatttctgacatttcagctttgcaaccatactccccccggaacccaaattctgacatttctgacatttctgacatttctgacatttctgacatttctgacatttccgactcggaccgatg

SEQ ID NO: 16723 - DNA, 203 bp, Homo sapiens
  source 1..203: mol_type = other DNA
ggcgcgccagtcctctgttgctcgtctgacatttctgacatttctgacatttctgacatttctgacatttctgacatttctgacatttctgacatttcccggcgggttgacatttctgacatttctgacatttctgacatttctgacatttctgacatttctgacatttctgacattttcttggcaaacgactcggaccgatg

SEQ ID NO: 16724 - DNA, 203 bp, Homo sapiens
  source 1..203: mol_type = other DNA
ggcgcgccagtcctcgagttcacctctgacatttctgacatttctgacatttctgacatttctgacatttctgacatttctgacatttctgacatttcgtgcccttccgtcaattcctttaagtttcagctttctgacatttctgacatttctgacatttctgacatttctgacatttctgacatttccgactcggaccgatg

SEQ ID NO: 16725 - DNA, 203 bp, Homo sapiens
  source 1..203: mol_type = other DNA
ggcgcgccagtcctcgaatcctggtctgacatttctgacatttctgacatttctgacatttctgacatttctgacatttctgacatttctgacatttctaatgaaaacattcttggcaaatgctttcgcttttctgacatttctgacatttctgacatttctgacatttctgacatttctgacatttccgactcggaccgatg

SEQ ID NO: 16726 - DNA, 203 bp, Homo sapiens
  source 1..203: mol_type = other DNA
ggcgcgccagtcctcgatacgttatctgacatttctgacatttctgacatttctgacatttctgacatttctgacatttctgacatttctgacatttctgaaccacccacggaatcgagaaagagctacatttctgacatttctgacatttctgacatttctgacatttctgacatttctgacatttccgactcggaccgatg

SEQ ID NO: 16727 - DNA, 203 bp, Homo sapiens
  source 1..203: mol_type = other DNA
ggcgcgccagtccttgctctgtcgtctgacatttctgacatttctgacatttctgacatttctgacatttctgacatttctgacatttctgacatttctgacatacccgccggttctgacatacccgccggttctgacatacccgccggttctgacatacccgccggttctgacatttctgacatttccgactcggaccgatg

SEQ ID NO: 16728 - DNA, 203 bp, Homo sapiens
  source 1..203: mol_type = other DNA
ggcgcgccagtcctcacaacgtcgtctgacatttctgacatttctgacatttctgacatttctgacatttctgacatttctgacatttctgacatttctgacataccggccgtttctgacataccggccgtttctgacatttctgacatttctgacataccggccgtttctgacataccggccgtttccgactcggaccgatg

SEQ ID NO: 16729 - DNA, 203 bp, Homo sapiens
  source 1..203: mol_type = other DNA
ggcgcgccagtcctcgagcaagtttctgacatttctgacatttctgacatttctgacatttctgacatttctgacatttctgacatttctgacatttctgacataccggccgtttctgacatttctgacatttctgacataccggccgtttctgacatttctgacatttctgacataccggccgtttccgactcggaccgatg

SEQ ID NO: 16730 - DNA, 203 bp, Homo sapiens
  source 1..203: mol_type = other DNA
ggcgcgccagtcctcgagttgaggtctgacatttctgacatttctgacatttctgacatttctgacatttctgacatttctgacatttctgacatttctgacataccggccgtttctgacatttctgacatttctgacatttctgacatttctgacatttctgacatttctgacataccggccgtttccgactcggaccgatg

SEQ ID NO: 16731 - DNA, 203 bp, Homo sapiens
  source 1..203: mol_type = other DNA
ggcgcgccagtcctgttttgaatatctgacatttctgacatttctgacatttctgacatttctgacatttctgacatttctgacatttctgacatttctgacataccggccgtttctgacatttctgacatttctgacatttctgacatttctgacatttctgacatttctgacatttctgacatttccgactcggaccgatg

SEQ ID NO: 16732 - DNA, 203 bp, Homo sapiens
  source 1..203: mol_type = other DNA
ggcgcgccagtcctgtttaacttatctgacatttctgacatttctgacatttctgacatttctgacatttctgacatttctgacatttctgacatttctgacatacggccggtttctgacatacggccggtttctgacatacggccggtttctgacatacggccggtttctgacatttctgacatttccgactcggaccgatg

SEQ ID NO: 16733 - DNA, 203 bp, Homo sapiens
  source 1..203: mol_type = other DNA
ggcgcgccagtcctccactttctttctgacatttctgacatttctgacatttctgacatttctgacatttctgacatttctgacatttctgacatttctgacatagctgcccggcgggtcatggctgacatttctgacatttctgacatttctgacatttctgacatttctgacatttctgacatttccgactcggaccgatg

SEQ ID NO: 16734 - DNA, 203 bp, Homo sapiens
  source 1..203: mol_type = other DNA
ggcgcgccagtcctaaatcacagctctgacatttctgacatttctgacatttctgacatttctgacatttctgacatttctgacatttctgacatttctgacatcacggaatcgagaaacatcacggaatcgagaaacatcacggaatcgagaaacatttctgacatttctgacatttctgacatttccgactcggaccgatg

SEQ ID NO: 16735 - DNA, 203 bp, Homo sapiens
  source 1..203: mol_type = other DNA
ggcgcgccagtcctagcaaaatgctctgacatttctgacatttctgacatttctgacatttctgacatttctgacatttctgacatttctgacatttctgacatcacggaatcgagaaacatttctgacatttctgacatttctgacatttctgacatcacggaatcgagaaacatttctgacatttccgactcggaccgatg

SEQ ID NO: 16736 - DNA, 203 bp, Homo sapiens
  source 1..203: mol_type = other DNA
ggcgcgccagtcctaaatctctagtctgacatttctgacatttctgacatttctgacatttctgacatttctgacatttctgacatttctgacatttctgacatcacggaatcgagaaacatttctgacatttctgacatttctgacatttctgacatttctgacatttctgacatttctgacatttccgactcggaccgatg

SEQ ID NO: 16737 - DNA, 203 bp, Homo sapiens
  source 1..203: mol_type = other DNA
ggcgcgccagtccttgcacaaatgtctgacatttctgacatttctgacatttctgacatttctgacatttctgacatttctgacatttctgacatttctgacatcacggaatcgagaaacatttctgacatttctgacatttctgacatttctgacatttctgacatttctgacatttctgtactccccgactcggaccgatg

SEQ ID NO: 16738 - DNA, 203 bp, Homo sapiens
  source 1..203: mol_type = other DNA
ggcgcgccagtcctcttgcaaatctctgacatttctgacatttctgacatttctgacatttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16739 - DNA, 203 bp, Homo sapiens
  source 1..203: mol_type = other DNA
ggcgcgccagtcctgctagaaatctctgacatttctgacatttctgacatttctgacatttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16740 - DNA, 203 bp, Homo sapiens
  source 1..203: mol_type = other DNA
ggcgcgccagtcctaaatgagttgtctgacatttctgacatttctgacatttctgacatttctgacatttctgacatttctgacatttctgacatttctgacatccggcgggtttctgacatccggcgggtttctgacatccggcgggtttctgacatccggcgggtttctgacatccggcgggtttccgactcggaccgatg

SEQ ID NO: 16741 - DNA, 203 bp, Homo sapiens
  source 1..203: mol_type = other DNA
ggcgcgccagtcctcctgaaaatgtctgacatttctgacatttctgacatttctgacatttctgacatttctgacatttctgacatttctgacatttctgacatccggcgggtttctgacatccggcgggtttctgacatccggcgggtttctgacatttctgacatttctgacatccggcgggtttccgactcggaccgatg

SEQ ID NO: 16742 - DNA, 203 bp, Homo sapiens
  source 1..203: mol_type = other DNA
ggcgcgccagtccttgctgaaatctctgacatttctgacatttctgacatttctgacatttctgacatttctgacatttctgacatttctgacatttctgacatccggcgggtttctgacatccggcgggtttctgacatttctgacatttctgacatccggcgggtttctgacatttctgacatttccgactcggaccgatg

SEQ ID NO: 16743 - DNA, 203 bp, Homo sapiens
  source 1..203: mol_type = other DNA
ggcgcgccagtcctctcaaatggttctgacatttctgacatttctgacatttctgacatttctgacatttctgacatttctgacatttctgacatttctgacatccggcgggtttctgacatccggcgggtttctgacatttctgacatttctgacatttctgacatttctgacatccggcgggtttccgactcggaccgatg

SEQ ID NO: 16744 - DNA, 203 bp, Homo sapiens
  source 1..203: mol_type = other DNA
ggcgcgccagtcctcagatttgattctgacatttctgacatttctgacatttctgacatttctgacatttctgacatttctgacatttctgacatttctgacatccggcgggtttctgacatttctgacatttctgacatccggcgggtttctgacatttctgacatttctgacatttctgacatttccgactcggaccgatg

SEQ ID NO: 16745 - DNA, 203 bp, Homo sapiens
  source 1..203: mol_type = other DNA
ggcgcgccagtcctgaatgatttctctgacatttctgacatttctgacatttctgacatttctgacatttctgacatttctgacatttctgacatttctgacatccggcgggtttctgacatttctgacatttctgacatttctgacatttctgacatttctgacatttctgacatccggcgggtttccgactcggaccgatg

SEQ ID NO: 16746 - DNA, 203 bp, Homo sapiens
  source 1..203: mol_type = other DNA
ggcgcgccagtcctgatttcacaatctgacatttctgacatttctgacatttctgacatttctgacatttctgacatttctgacatttctgacatttctgacatcgtcaattcctttaacatcgtcaattcctttaacatcgtcaattcctttaacatcgtcaattcctttaacatttctgacatttccgactcggaccgatg

SEQ ID NO: 16747 - DNA, 203 bp, Homo sapiens
  source 1..203: mol_type = other DNA
ggcgcgccagtccttacttgattttctgacatttctgacatttctgacatttctgacatttctgacatttctgacatttctgacatttctgacatttctgacatcgtcaattcctttaacatcgtcaattcctttaacatcgtcaattcctttaacatttctgacatttctgacatttctgacatttccgactcggaccgatg

SEQ ID NO: 16748 - DNA, 203 bp, Homo sapiens
  source 1..203: mol_type = other DNA
ggcgcgccagtcctatttgatcagtctgacatttctgacatttctgacatttctgacatttctgacatttctgacatttctgacatttctgacatttctgacatcgtcaattcctttaacatttctgacatttctgacatttctgacatttctgacatcgtcaattcctttaacatttctgacatttccgactcggaccgatg

SEQ ID NO: 16749 - DNA, 203 bp, Homo sapiens
  source 1..203: mol_type = other DNA
ggcgcgccagtcctgtgatttcactctgacatttctgacatttctgacatttctgacatttctgacatttctgacatttctgacatttctgacatttctgacatgcaaccatactccccccggaatgacatttctgacatttctgacatttctgacatttctgacatttctgacatttctgacatttccgactcggaccgatg

SEQ ID NO: 16750 - DNA, 203 bp, Homo sapiens
  source 1..203: mol_type = other DNA
ggcgcgccagtcctgcagatttgttctgacatttctgacatttctgacatttctgacatttctgacatttctgacatttctgacatttctgacatttctgacattactcccatttctgacattactcccatttctgacattactcccatttctgacatttctgacatttctgacattactcccatttccgactcggaccgatg

SEQ ID NO: 16751 - DNA, 203 bp, Homo sapiens
  source 1..203: mol_type = other DNA
ggcgcgccagtcctttagatttggtctgacatttctgacatttctgacatttctgacatttctgacatttctgacatttctgacatttctgacatttctgacattactcccatttctgacattactcccatttctgacatttctgacatttctgacattactcccatttctgacatttctgacatttccgactcggaccgatg

SEQ ID NO: 16752 - DNA, 203 bp, Homo sapiens
  source 1..203: mol_type = other DNA
ggcgcgccagtccttaggatttcgtctgacatttctgacatttctgacatttctgacatttctgacatttctgacatttctgacatttctgacatttctgacattactcccatttctgacatttctgacatttctgacattactcccatttctgacattactcccatttctgacattactcccatttccgactcggaccgatg

SEQ ID NO: 16753 - DNA, 203 bp, Homo sapiens
  source 1..203: mol_type = other DNA
ggcgcgccagtcctagaacactagtctgacatttctgacatttctgacatttctgacatttctgacatttctgacatttctgacatttctgacatttctgacattactcccatttctgacatttctgacatttctgacattactcccatttctgacattactcccatttctgacatttctgacatttccgactcggaccgatg

SEQ ID NO: 16754 - DNA, 203 bp, Homo sapiens
  source 1..203: mol_type = other DNA
ggcgcgccagtccttgatcctacatctgacatttctgacatttctgacatttctgacatttctgacatttctgacatttctgacatttctgacatttctgacattactcccatttctgacatttctgacatttctgacattactcccatttctgacatttctgacatttctgacattactcccatttccgactcggaccgatg

SEQ ID NO: 16755 - DNA, 203 bp, Homo sapiens
  source 1..203: mol_type = other DNA
ggcgcgccagtcctcgacctacaatctgacatttctgacatttctgacatttctgacatttctgacatttctgacatttctgacatttctgacatttctgacattactcccatttctgacatttctgacatttctgacatttctgacatttctgacattactcccatttctgacattactcccatttccgactcggaccgatg

SEQ ID NO: 16756 - DNA, 203 bp, Homo sapiens
  source 1..203: mol_type = other DNA
ggcgcgccagtcctccaaccagtgtctgacatttctgacatttctgacatttctgacatttctgacatttctgacatttctgacatttctgacatttctgacattactcccatttctgacatttctgacatttctgacatttctgacatttctgacatttctgacatttctgacattactcccatttccgactcggaccgatg

SEQ ID NO: 16757 - DNA, 203 bp, Homo sapiens
  source 1..203: mol_type = other DNA
ggcgcgccagtcctcatgtatgcatctgacatttctgacatttctgacatttctgacatttctgacatttctgacatttctgacatttctgacatttctgacattactgtaccggccgtgcgttctgacatttctgacatttctgacatttctgacatttctgacatttctgacatttctgacatttccgactcggaccgatg

SEQ ID NO: 16758 - DNA, 203 bp, Homo sapiens
  source 1..203: mol_type = other DNA
ggcgcgccagtcctactacatgagtctgacatttctgacatttctgacatttctgacatttctgacatttctgacatttctgacatttctgacatttctgacattccggcgggttctgacatttctgacatttctgacatttctgacatttctgacatttctgacatttctgacattttcttggcaaacgactcggaccgatg

SEQ ID NO: 16759 - DNA, 203 bp, Homo sapiens
  source 1..203: mol_type = other DNA
ggcgcgccagtccttacaggttggtctgacatttctgacatttctgacatttctgacatttctgacatttctgacatttctgacatttctgacatttctgacatttaaccatactccccccgttctgacatttctgacatttctgacatttctgacatttctgacatttctgacatttctgacatttccgactcggaccgatg

SEQ ID NO: 16760 - DNA, 203 bp, Homo sapiens
  source 1..203: mol_type = other DNA
ggcgcgccagtccttcgcaggtggtctgacatttctgacatttctgacatttctgacatttctgacatttctgacatttctgacatttctgacatttctgacatttcaccggccgttgacatttctgacatttctgacatttctgacatttctgacatttctgacatttctgacatttcccggcgggtcgactcggaccgatg

SEQ ID NO: 16761 - DNA, 203 bp, Homo sapiens
  source 1..203: mol_type = other DNA
ggcgcgccagtcctgtcactcatttctgacatttctgacatttctgacatttctgacatttctgacatttctgacatttctgacatttctgacatttctgacatttccacggaatcgagaatttctgacatttctgacatttctgacatttctgacatttctgacatttctgacatttctgacatttccgactcggaccgatg

SEQ ID NO: 16762 - DNA, 203 bp, Homo sapiens
  source 1..203: mol_type = other DNA
ggcgcgccagtcctacgagcagcatctgacatttctgacatttctgacatttctgacatttctgacatttctgacatttctgacatttctgacatttctgacatttcccggcgggttgacatttctgacatttctgacatttctgacatttctgacatttctgacatttctgacatttcaccggccgtcgactcggaccgatg

SEQ ID NO: 16763 - DNA, 203 bp, Homo sapiens
  source 1..203: mol_type = other DNA
ggcgcgccagtcctgtgcagcatatctgacatttctgacatttctgacatttctgacatttctgacatttctgacatttctgacatttctgacatttctgacatttccgtcaattcctttaattctgacatttctgacatttctgacatttctgacatttctgacatttctgacatttctgacatttccgactcggaccgatg

SEQ ID NO: 16764 - DNA, 203 bp, Homo sapiens
  source 1..203: mol_type = other DNA
ggcgcgccagtcctatccaacagttctgacatttctgacatttctgacatttctgacatttctgacatttctgacatttctgacatttctgacatttctgacatttctcgattccgtgacatttctcgattccgtgacatttctcgattccgtgacatttctcgattccgtgacatttctgacatttccgactcggaccgatg

SEQ ID NO: 16765 - DNA, 203 bp, Homo sapiens
  source 1..203: mol_type = other DNA
ggcgcgccagtcctgttaggcctctctgacatttctgacatttctgacatttctgacatttctgacatttctgacatttctgacatttctgacatttctgacatttctgacaaccggccgttttctgacatttctgacatttctgacatttctgacatttctgacatttctgacattttcttggcaaacgactcggaccgatg

SEQ ID NO: 16766 - DNA, 203 bp, Homo sapiens
  source 1..203: mol_type = other DNA
ggcgcgccagtcctgagctttctatctgacatttctgacatttctgacatttctgacatttctgacatttctgacatttctgacatttctgacatttctgacatttctgacaattcctacatttctgacatttctgacatttctgacatttctgacatttctgacatttctgacatttctgacatttccgactcggaccgatg

SEQ ID NO: 16767 - DNA, 203 bp, Homo sapiens
  source 1..203: mol_type = other DNA
ggcgcgccagtccttaacttgaaatctgacatttctgacatttctgacatttctgacatttctgacatttctgacatttctgacatttctgacatttctgacatttctgacaattctgacatttctgacatttctgacatttctgacatttctgacatttctgacatttctgacatttctgacatttccgactcggaccgatg

SEQ ID NO: 16768 - DNA, 203 bp, Homo sapiens
  source 1..203: mol_type = other DNA
ggcgcgccagtcctcaagcacttgtctgacatttctgacatttctgacatttctgacatttctgacatttctgacatttctgacatttctgacatttctgacatttctgacatatctgacatttctgacatttctgacatttctgacatttctgacatttctgacatttctgacatttctgacatttccgactcggaccgatg

SEQ ID NO: 16769 - DNA, 203 bp, Homo sapiens
  source 1..203: mol_type = other DNA
ggcgcgccagtcctatgtgcttactctgacatttctgacatttctgacatttctgacatttctgacatttctgacatttctgacatttctgacatttctgacatttctgacatgcctgacatttctgacatttctgacatttctgacatttctgacatttctgacatttctgacatttctgacatttccgactcggaccgatg

SEQ ID NO: 16770 - DNA, 203 bp, Homo sapiens
  source 1..203: mol_type = other DNA
ggcgcgccagtcctcatgaagcactctgacatttctgacatttctgacatttctgacatttctgacatttctgacatttctgacatttctgacatttctgacatttctgacattaccggccgttctgacatttctgacatttctgacatttctgacatttctgacatttctgacatttcaccggccgtcgactcggaccgatg

SEQ ID NO: 16771 - DNA, 203 bp, Homo sapiens
  source 1..203: mol_type = other DNA
ggcgcgccagtcctagtgcttttctctgacatttctgacatttctgacatttctgacatttctgacatttctgacatttctgacatttctgacatttctgacatttctgacattccggcgggttctgacatttctgacatttctgacatttctgacatttctgacatttctgacatttcaccggccgtcgactcggaccgatg

SEQ ID NO: 16772 - DNA, 203 bp, Homo sapiens
  source 1..203: mol_type = other DNA
ggcgcgccagtcctgagtgctttatctgacatttctgacatttctgacatttctgacatttctgacatttctgacatttctgacatttctgacatttctgacatttctgacattcgtcaattcctttacatttctgacatttctgacatttctgacatttctgacatttctgacattttcttggcaaacgactcggaccgatg

SEQ ID NO: 16773 - DNA, 203 bp, Homo sapiens
  source 1..203: mol_type = other DNA
ggcgcgccagtcctactaacaagatctgacatttctgacatttctgacatttctgacatttctgacatttctgacatttctgacatttctgacatttctgacatttctgacattcttggcaaatctgacatttctgacatttctgacatttctgacatttctgacatttctgacatttcaccggccgtcgactcggaccgatg

SEQ ID NO: 16774 - DNA, 203 bp, Homo sapiens
  source 1..203: mol_type = other DNA
ggcgcgccagtccttagttagtagtctgacatttctgacatttctgacatttctgacatttctgacatttctgacatttctgacatttctgacatttctgacatttctgacattggtgacatttctgacatttctgacatttctgacatttctgacatttctgacatttctgacatttctgacatttccgactcggaccgatg

SEQ ID NO: 16775 - DNA, 203 bp, Homo sapiens
  source 1..203: mol_type = other DNA
ggcgcgccagtccttactaacaggtctgacatttctgacatttctgacatttctgacatttctgacatttctgacatttctgacatttctgacatttctgacatttctgacatttactccctttctgacatttctgacatttctgacatttctgacatttctgacatttctgacattttcttggcaaacgactcggaccgatg

SEQ ID NO: 16776 - DNA, 203 bp, Homo sapiens
  source 1..203: mol_type = other DNA
ggcgcgccagtcctctgtactaactctgacatttctgacatttctgacatttctgacatttctgacatttctgacatttctgacatttctgacatttctgacatttctgacatttcaccggccgttgacatttctgacatttctgacatttctgacatttctgacatttctgacatttctgtactccccgactcggaccgatg

SEQ ID NO: 16777 - DNA, 203 bp, Homo sapiens
  source 1..203: mol_type = other DNA
ggcgcgccagtccttcctcaaaattctgacatttctgacatttctgacatttctgacatttctgacatttctgacatttctgacatttctgacatttctgacatttctgacatttccacggaatcgagaatttctgacatttctgacatttctgacatttctgacatttctgacatttcaccggccgtcgactcggaccgatg

SEQ ID NO: 16778 - DNA, 203 bp, Homo sapiens
  source 1..203: mol_type = other DNA
ggcgcgccagtccttcctctgcagtctgacatttctgacatttctgacatttctgacatttctgacatttctgacatttctgacatttctgacatttctgacatttctgacatttcccggcgggttgacatttctgacatttctgacatttctgacatttctgacatttctgacatttctgtactccccgactcggaccgatg

SEQ ID NO: 16779 - DNA, 203 bp, Homo sapiens
  source 1..203: mol_type = other DNA
ggcgcgccagtcctaactcggttatctgacatttctgacatttctgacatttctgacatttctgacatttctgacatttctgacatttctgacatttctgacatttctgacatttccgtcaattcctttatttctgacatttctgacatttctgacatttctgacatttctgacatttcaccggccgtcgactcggaccgatg

SEQ ID NO: 16780 - DNA, 203 bp, Homo sapiens
  source 1..203: mol_type = other DNA
ggcgcgccagtcctcactcagcagtctgacatttctgacatttctgacatttctgacatttctgacatttctgacatttctgacatttctgacatttctgacatttctgacatttctactccctctgacatttctgacatttctgacatttctgacatttctgacatttctgacatttcaccggccgtcgactcggaccgatg

SEQ ID NO: 16781 - DNA, 203 bp, Homo sapiens
  source 1..203: mol_type = other DNA
ggcgcgccagtcctcacgcctagctctgacatttctgacatttctgacatttctgacatttctgacatttctgacatttctgacatttctgacatttctgacatttctgacatttctgaaccggccgtcatttctgacatttctgacatttctgacatttctgacatttctgacattttcttggcaaacgactcggaccgatg

SEQ ID NO: 16782 - DNA, 203 bp, Homo sapiens
  source 1..203: mol_type = other DNA
ggcgcgccagtcctatggacttcgtctgacatttctgacatttctgacatttctgacatttctgacatttctgacatttctgacatttctgacatttctgacatttctgacatttctgacaaccggccgttttctgacatttctgacatttctgacatttctgacatttctgacatttcccggcgggtcgactcggaccgatg

SEQ ID NO: 16783 - DNA, 203 bp, Homo sapiens
  source 1..203: mol_type = other DNA
ggcgcgccagtcctttgagacccatctgacatttctgacatttctgacatttctgacatttctgacatttctgacatttctgacatttctgacatttctgacatttctgacatttctgacataccggccgtttctgacataccggccgtttctgacatttctgacatttctgacataccggccgtttccgactcggaccgatg

SEQ ID NO: 16784 - DNA, 203 bp, Homo sapiens
  source 1..203: mol_type = other DNA
ggcgcgccagtccttgttcgtcactctgacatttctgacatttctgacatttctgacatttctgacatttctgacatttctgacatttctgacatttctgacatttctgacatttctgacataccggccgtttctgacatttctgacatttctgacataccggccgtttctgacataccggccgtttccgactcggaccgatg

SEQ ID NO: 16785 - DNA, 203 bp, Homo sapiens
  source 1..203: mol_type = other DNA
ggcgcgccagtcctgatcaaccgttctgacatttctgacatttctgacatttctgacatttctgacatttctgacatttctgacatttctgacatttctgacatttctgacatttctgacataccggccgtttctgacatttctgacatttctgacataccggccgtttctgacatttctgacatttccgactcggaccgatg

SEQ ID NO: 16786 - DNA, 203 bp, Homo sapiens
  source 1..203: mol_type = other DNA
ggcgcgccagtcctcagcttaacctctgacatttctgacatttctgacatttctgacatttctgacatttctgacatttctgacatttctgacatttctgacatttctgacatttctgacatcacggaatcgagaaacatcacggaatcgagaaacatttctgacatttctgacatttctgacatttccgactcggaccgatg

SEQ ID NO: 16787 - DNA, 203 bp, Homo sapiens
  source 1..203: mol_type = other DNA
ggcgcgccagtcctggcagtattctctgacatttctgacatttctgacatttctgacatttctgacatttctgacatttctgacatttctgacatttctgacatttctgacatttctgacatcacggaatcgagaaacatttctgacatttctgacatcacggaatcgagaaacatttctgacatttccgactcggaccgatg

SEQ ID NO: 16788 - DNA, 203 bp, Homo sapiens
  source 1..203: mol_type = other DNA
ggcgcgccagtcctcaagtgaacctctgacatttctgacatttctgacatttctgacatttctgacatttctgacatttctgacatttctgacatttctgacatttctgacatttctgacatcacggaatcgagaaacatttctgacatttctgacatttctgacatttctgacatttctgacatttccgactcggaccgatg

SEQ ID NO: 16789 - DNA, 203 bp, Homo sapiens
  source 1..203: mol_type = other DNA
ggcgcgccagtccttctctaagcctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16790 - DNA, 203 bp, Homo sapiens
  source 1..203: mol_type = other DNA
ggcgcgccagtcctacagtgtacctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16791 - DNA, 203 bp, Homo sapiens
  source 1..203: mol_type = other DNA
ggcgcgccagtcctttgcaacacctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16792 - DNA, 203 bp, Homo sapiens
  source 1..203: mol_type = other DNA
ggcgcgccagtccttgcaaagacctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16793 - DNA, 203 bp, Homo sapiens
  source 1..203: mol_type = other DNA
ggcgcgccagtcctctgagaatcctctgacatttctgacatttctgacatttctgacatttctgacatttctgacatttctgacatttctgacatttctgacatttctgacatttctgacatccggcgggtttctgacatccggcgggtttctgacatccggcgggtttctgacatccggcgggtttccgactcggaccgatg

SEQ ID NO: 16794 - DNA, 203 bp, Homo sapiens
  source 1..203: mol_type = other DNA
ggcgcgccagtcctggtaactacctctgacatttctgacatttctgacatttctgacatttctgacatttctgacatttctgacatttctgacatttctgacatttctgacatttctgacatccggcgggtttctgacatttctgacatttctgacatccggcgggtttctgacatccggcgggtttccgactcggaccgatg

SEQ ID NO: 16795 - DNA, 203 bp, Homo sapiens
  source 1..203: mol_type = other DNA
ggcgcgccagtcctggtctaagactctgacatttctgacatttctgacatttctgacatttctgacatttctgacatttctgacatttctgacatttctgacatttctgacatttctgacatccggcgggtttctgacatttctgacatttctgacatccggcgggtttctgacatttctgacatttccgactcggaccgatg

SEQ ID NO: 16796 - DNA, 203 bp, Homo sapiens
  source 1..203: mol_type = other DNA
ggcgcgccagtcctggcctgaaattctgacatttctgacatttctgacatttctgacatttctgacatttctgacatttctgacatttctgacatttctgacatttctgacatttctgacatccggcgggtttctgacatttctgacatttctgacatttctgacatttctgacatccggcgggtttccgactcggaccgatg

SEQ ID NO: 16797 - DNA, 203 bp, Homo sapiens
  source 1..203: mol_type = other DNA
ggcgcgccagtcctggtcaaagcttctgacatttctgacatttctgacatttctgacatttctgacatttctgacatttctgacatttctgacatttctgacatttctgacatttctgacatcgtcaattcctttaacatcgtcaattcctttaacatcgtcaattcctttaacatttctgacatttccgactcggaccgatg

SEQ ID NO: 16798 - DNA, 203 bp, Homo sapiens
  source 1..203: mol_type = other DNA
ggcgcgccagtcctggtcctttcatctgacatttctgacatttctgacatttctgacatttctgacatttctgacatttctgacatttctgacatttctgacatttctgacatttctgacatgggagtaatttctgacatgggagtaatttctgacatgggagtaatttctgacatttctgacatttccgactcggaccgatg

SEQ ID NO: 16799 - DNA, 203 bp, Homo sapiens
  source 1..203: mol_type = other DNA
ggcgcgccagtcctggtaagcttgtctgacatttctgacatttctgacatttctgacatttctgacatttctgacatttctgacatttctgacatttctgacatttctgacatttctgacattactcccatttctgacattactcccatttctgacattactcccatttctgacatttctgacatttccgactcggaccgatg

SEQ ID NO: 16800 - DNA, 203 bp, Homo sapiens
  source 1..203: mol_type = other DNA
ggcgcgccagtcctggctaaaggttctgacatttctgacatttctgacatttctgacatttctgacatttctgacatttctgacatttctgacatttctgacatttctgacatttctgacattactcccatttctgacattactcccatttctgacatttctgacatttctgacatttctgacatttccgactcggaccgatg

SEQ ID NO: 16801 - DNA, 203 bp, Homo sapiens
  source 1..203: mol_type = other DNA
ggcgcgccagtcctggactgtctttctgacatttctgacatttctgacatttctgacatttctgacatttctgacatttctgacatttctgacatttctgacatttctgacatttctgacattccggcgggttctgacatttctgacatttctgacatttctgacatttctgacatttctgacatttccgactcggaccgatg

SEQ ID NO: 16802 - DNA, 203 bp, Homo sapiens
  source 1..203: mol_type = other DNA
ggcgcgccagtccttacagtcgattctgacatttctgacatttctgacatttctgacatttctgacatttctgacatttctgacatttctgacatttctgacatttctgacatttctgacattcttggcaaatctgacatttctgacatttctgacatttctgacatttctgacatttctgacatttccgactcggaccgatg

SEQ ID NO: 16803 - DNA, 203 bp, Homo sapiens
  source 1..203: mol_type = other DNA
ggcgcgccagtcctttgagtcgagtctgacatttctgacatttctgacatttctgacatttctgacatttctgacatttctgacatttctgacatttctgacatttctgacatttctgacattcttggcaaatctgacatttctgacatttctgacatttctgacatttctgaccacggaatcgagaacgactcggaccgatg

SEQ ID NO: 16804 - DNA, 203 bp, Homo sapiens
  source 1..203: mol_type = other DNA
ggcgcgccagtcctcagtcgactttctgacatttctgacatttctgacatttctgacatttctgacatttctgacatttctgacatttctgacatttctgacatttctgacatttctgacatttactccctttctgacatttctgacatttctgacatttctgacatttctgacatttcccggcgggtcgactcggaccgatg

SEQ ID NO: 16805 - DNA, 203 bp, Homo sapiens
  source 1..203: mol_type = other DNA
ggcgcgccagtccttcgactgtcatctgacatttctgacatttctgacatttctgacatttctgacatttctgacatttctgacatttctgacatttctgacatttctgacatttctgacatttccacggaatcgagaatttctgacatttctgacatttctgacatttctgacatttctgacatttccgactcggaccgatg

SEQ ID NO: 16806 - DNA, 203 bp, Homo sapiens
  source 1..203: mol_type = other DNA
ggcgcgccagtccttggaccaacatctgacatttctgacatttctgacatttctgacatttctgacatttctgacatttctgacatttctgacatttctgacatttctgacatttctgacatttccgtcaattcctttatttctgacatttctgacatttctgacatttctgacatttctgacatttccgactcggaccgatg

SEQ ID NO: 16807 - DNA, 203 bp, Homo sapiens
  source 1..203: mol_type = other DNA
ggcgcgccagtcctggcgtttgcttctgacatttctgacatttctgacatttctgacatttctgacatttctgacatttctgacatttctgacatttctgacatttctgacatttctgacatttctaccggccgtgacatttctgacatttctgacatttctgacatttctgacattttcttggcaaacgactcggaccgatg

SEQ ID NO: 16808 - DNA, 203 bp, Homo sapiens
  source 1..203: mol_type = other DNA
ggcgcgccagtcctaaacgctcgttctgacatttctgacatttctgacatttctgacatttctgacatttctgacatttctgacatttctgacatttctgacatttctgacatttctgacatttctactccctctgacatttctgacatttctgacatttctgacatttctgaccacggaatcgagaacgactcggaccgatg

SEQ ID NO: 16809 - DNA, 203 bp, Homo sapiens
  source 1..203: mol_type = other DNA
ggcgcgccagtcctcgaagtaccttctgacatttctgacatttctgacatttctgacatttctgacatttctgacatttctgacatttctgacatttctgacatttctgacatttctgacatttctgacaaccggccgttttctgacatttctgacatttctgacatttctgaccacggaatcgagaacgactcggaccgatg

SEQ ID NO: 16810 - DNA, 203 bp, Homo sapiens
  source 1..203: mol_type = other DNA
ggcgcgccagtcctactgtacctctctgacatttctgacatttctgacatttctgacatttctgacatttctgacatttctgacatttctgacatttctgacatttctgacatttctgacatttctgacacacggaatcgagaagacatttctgacatttctgacatttctgacatttcaccggccgtcgactcggaccgatg

SEQ ID NO: 16811 - DNA, 203 bp, Homo sapiens
  source 1..203: mol_type = other DNA
ggcgcgccagtcctaaaattcgtctctgacatttctgacatttctgacatttctgacatttctgacatttctgacatttctgacatttctgacatttctgacatttctgacatttctgacatttctgacaccggcgggttttctgacatttctgacatttctgacatttctgacatttctgacatttccgactcggaccgatg

SEQ ID NO: 16812 - DNA, 203 bp, Homo sapiens
  source 1..203: mol_type = other DNA
ggcgcgccagtcctccaccaaatttctgacatttctgacatttctgacatttctgacatttctgacatttctgacatttctgacatttctgacatttctgacatttctgacatttctgacatttctgacacggaatcgagaactgacatttctgacatttctgacatttctgacattttcttggcaaacgactcggaccgatg

SEQ ID NO: 16813 - DNA, 203 bp, Homo sapiens
  source 1..203: mol_type = other DNA
ggcgcgccagtccttgtagaaatttctgacatttctgacatttctgacatttctgacatttctgacatttctgacatttctgacatttctgacatttctgacatttctgacatttctgacatttctgacacgtcaattcctttagacatttctgacatttctgacatttctgacatttcccggcgggtcgactcggaccgatg

SEQ ID NO: 16814 - DNA, 203 bp, Homo sapiens
  source 1..203: mol_type = other DNA
ggcgcgccagtcctgcaagaattttctgacatttctgacatttctgacatttctgacatttctgacatttctgacatttctgacatttctgacatttctgacatttctgacatttctgacatttctgacatactccccatttctgacatttctgacatttctgacatttctgacatttcccggcgggtcgactcggaccgatg

SEQ ID NO: 16815 - DNA, 203 bp, Homo sapiens
  source 1..203: mol_type = other DNA
ggcgcgccagtcctcacggtggactctgacatttctgacatttctgacatttctgacatttctgacatttctgacatttctgacatttctgacatttctgacatttctgacatttctgacatttctgacattcgtcaattcctttacatttctgacatttctgacatttctgaccgtcaattcctttacgactcggaccgatg

SEQ ID NO: 16816 - DNA, 203 bp, Homo sapiens
  source 1..203: mol_type = other DNA
ggcgcgccagtcctatgcaccgtgtctgacatttctgacatttctgacatttctgacatttctgacatttctgacatttctgacatttctgacatttctgacatttctgacatttctgacatttctgacatttaccggccgtctgacatttctgacatttctgacatttctgacattttcttggcaaacgactcggaccgatg

SEQ ID NO: 16817 - DNA, 203 bp, Homo sapiens
  source 1..203: mol_type = other DNA
ggcgcgccagtcctctgcaccgactctgacatttctgacatttctgacatttctgacatttctgacatttctgacatttctgacatttctgacatttctgacatttctgacatttctgacatttctgacatttactccctttctgacatttctgacatttctgacatttctgacatttctgtactccccgactcggaccgatg

SEQ ID NO: 16818 - DNA, 203 bp, Homo sapiens
  source 1..203: mol_type = other DNA
ggcgcgccagtccttttcacaccatctgacatttctgacatttctgacatttctgacatttctgacatttctgacatttctgacatttctgacatttctgacatttctgacatttctgacatttctgacatttactccctttctgacatttctgacatttctgacatttctgaccacggaatcgagaacgactcggaccgatg

SEQ ID NO: 16819 - DNA, 203 bp, Homo sapiens
  source 1..203: mol_type = other DNA
ggcgcgccagtcctaacagaagattctgacatttctgacatttctgacatttctgacatttctgacatttctgacatttctgacatttctgacatttctgacatttctgacatttctgacatttctgacatttctaccggccgtgacatttctgacatttctgacatttctgacatttcaccggccgtcgactcggaccgatg

SEQ ID NO: 16820 - DNA, 203 bp, Homo sapiens
  source 1..203: mol_type = other DNA
ggcgcgccagtccttagaacttgctctgacatttctgacatttctgacatttctgacatttctgacatttctgacatttctgacatttctgacatttctgacatttctgacatttctgacatttctgacatttctaccggccgtgacatttctgacatttctgacatttctgacatttcccggcgggtcgactcggaccgatg

SEQ ID NO: 16821 - DNA, 203 bp, Homo sapiens
  source 1..203: mol_type = other DNA
ggcgcgccagtcctctagaacttctctgacatttctgacatttctgacatttctgacatttctgacatttctgacatttctgacatttctgacatttctgacatttctgacatttctgacatttctgacatttctcacggaatcgagaattctgacatttctgacatttctgacattttcttggcaaacgactcggaccgatg

SEQ ID NO: 16822 - DNA, 203 bp, Homo sapiens
  source 1..203: mol_type = other DNA
ggcgcgccagtcctcgaaatttcttctgacatttctgacatttctgacatttctgacatttctgacatttctgacatttctgacatttctgacatttctgacatttctgacatttctgacatttctgacatttctccggcgggtgacatttctgacatttctgacatttctgacatttcaccggccgtcgactcggaccgatg

SEQ ID NO: 16823 - DNA, 203 bp, Homo sapiens
  source 1..203: mol_type = other DNA
ggcgcgccagtcctggttgacgtttctgacatttctgacatttctgacatttctgacatttctgacatttctgacatttctgacatttctgacatttctgacatttctgacatttctgacatttctgacatttctcgtcaattcctttattctgacatttctgacatttctgacattttcttggcaaacgactcggaccgatg

SEQ ID NO: 16824 - DNA, 203 bp, Homo sapiens
  source 1..203: mol_type = other DNA
ggcgcgccagtcctctgttttcgttctgacatttctgacatttctgacatttctgacatttctgacatttctgacatttctgacatttctgacatttctgacatttctgacatttctgacatttctgacatttctgacacgtcaattcctttagacatttctgacatttctgacatttctgtactccccgactcggaccgatg

SEQ ID NO: 16825 - DNA, 203 bp, Homo sapiens
  source 1..203: mol_type = other DNA
ggcgcgccagtccttcacaaagtatctgacatttctgacatttctgacatttctgacatttctgacatttctgacatttctgacatttctgacatttctgacatttctgacatttctgacatttctgacatttctgacacgtcaattcctttagacatttctgacatttctgaccgtcaattcctttacgactcggaccgatg

SEQ ID NO: 16826 - DNA, 203 bp, Homo sapiens
  source 1..203: mol_type = other DNA
ggcgcgccagtcctcttgtagaactctgacatttctgacatttctgacatttctgacatttctgacatttctgacatttctgacatttctgacatttctgacatttctgacatttctgacatttctgacatttctgacatacccgccggttctgacatacccgccggttctgacatttctgacatttccgactcggaccgatg

SEQ ID NO: 16827 - DNA, 203 bp, Homo sapiens
  source 1..203: mol_type = other DNA
ggcgcgccagtcctggcaggttactctgacatttctgacatttctgacatttctgacatttctgacatttctgacatttctgacatttctgacatttctgacatttctgacatttctgacatttctgacatttctgacataccggccgtttctgacatttctgacatttctgacataccggccgtttccgactcggaccgatg

SEQ ID NO: 16828 - DNA, 203 bp, Homo sapiens
  source 1..203: mol_type = other DNA
ggcgcgccagtcctaacctacctctctgacatttctgacatttctgacatttctgacatttctgacatttctgacatttctgacatttctgacatttctgacatttctgacatttctgacatttctgacatttctgacataccggccgtttctgacatttctgacatttctgacattttcttggcaaacgactcggaccgatg

SEQ ID NO: 16829 - DNA, 203 bp, Homo sapiens
  source 1..203: mol_type = other DNA
ggcgcgccagtccttagtaggttgtctgacatttctgacatttctgacatttctgacatttctgacatttctgacatttctgacatttctgacatttctgacatttctgacatttctgacatttctgacatttctgacatactccccatttctgacatttctgacatttctgacatttctgacatttccgactcggaccgatg

SEQ ID NO: 16830 - DNA, 203 bp, Homo sapiens
  source 1..203: mol_type = other DNA
ggcgcgccagtcctgcacgatcgttctgacatttctgacatttctgacatttctgacatttctgacatttctgacatttctgacatttctgacatttctgacatttctgacatttctgacatttctgacatttctgacatactccccatttctgacatttctgacatttctgaccgtcaattcctttacgactcggaccgatg

SEQ ID NO: 16831 - DNA, 203 bp, Homo sapiens
  source 1..203: mol_type = other DNA
ggcgcgccagtcctgacgtcactatctgacatttctgacatttctgacatttctgacatttctgacatttctgacatttctgacatttctgacatttctgacatttctgacatttctgacatttctgacatttctgacatcacggaatcgagaaacatttctgacatttctgacatttctgacatttccgactcggaccgatg

SEQ ID NO: 16832 - DNA, 203 bp, Homo sapiens
  source 1..203: mol_type = other DNA
ggcgcgccagtcctagtcctcgtgtctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16833 - DNA, 203 bp, Homo sapiens
  source 1..203: mol_type = other DNA
ggcgcgccagtcctctcgtgagcatctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16834 - DNA, 203 bp, Homo sapiens
  source 1..203: mol_type = other DNA
ggcgcgccagtcctgtgctcgtggtctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16835 - DNA, 203 bp, Homo sapiens
  source 1..203: mol_type = other DNA
ggcgcgccagtcctccacgagcagtctgacatttctgacatttctgacatttctgacatttctgacatttctgacatttctgacatttctgacatttctgacatttctgacatttctgacatttctgacatttctgacatccggcgggtttctgacatccggcgggtttctgacatccggcgggtttccgactcggaccgatg

SEQ ID NO: 16836 - DNA, 203 bp, Homo sapiens
  source 1..203: mol_type = other DNA
ggcgcgccagtccttctgttgagctctgacatttctgacatttctgacatttctgacatttctgacatttctgacatttctgacatttctgacatttctgacatttctgacatttctgacatttctgacatttctgacatccggcgggtttctgacatttctgacatttctgacatttctgacatttccgactcggaccgatg

SEQ ID NO: 16837 - DNA, 203 bp, Homo sapiens
  source 1..203: mol_type = other DNA
ggcgcgccagtccttatgcacggttctgacatttctgacatttctgacatttctgacatttctgacatttctgacatttctgacatttctgacatttctgacatttctgacatttctgacatttctgacatttctgacatcgtcaattcctttaacatcgtcaattcctttaacatttctgacatttccgactcggaccgatg

SEQ ID NO: 16838 - DNA, 203 bp, Homo sapiens
  source 1..203: mol_type = other DNA
ggcgcgccagtccttcgatttctatctgacatttctgacatttctgacatttctgacatttctgacatttctgacatttctgacatttctgacatttctgacatttctgacatttctgacatttctgacatttctgacattactcccatttctgacattactcccatttctgacattactcccatttccgactcggaccgatg

SEQ ID NO: 16839 - DNA, 203 bp, Homo sapiens
  source 1..203: mol_type = other DNA
ggcgcgccagtcctccactttagatctgacatttctgacatttctgacatttctgacatttctgacatttctgacatttctgacatttctgacatttctgacatttctgacatttctgacatttctgacatttctgacattactcccatttctgacatttctgacatttctgacattactcccatttccgactcggaccgatg

SEQ ID NO: 16840 - DNA, 203 bp, Homo sapiens
  source 1..203: mol_type = other DNA
ggcgcgccagtcctataccatgtttctgacatttctgacatttctgacatttctgacatttctgacatttctgacatttctgacatttctgacatttctgacatttctgacatttctgacatttctgacatttctgacatttctaccggccgtgacatttctgacatttctgacatttctgtactccccgactcggaccgatg

SEQ ID NO: 16841 - DNA, 203 bp, Homo sapiens
  source 1..203: mol_type = other DNA
ggcgcgccagtccttccagaaacgtctgacatttctgacatttctgacatttctgacatttctgacatttctgacatttctgacatttctgacatttctgacatttctgacatttctgacatttctgacatttctgacatttctaccggccgtgacatttctgacatttctgaccacggaatcgagaacgactcggaccgatg

SEQ ID NO: 16842 - DNA, 203 bp, Homo sapiens
  source 1..203: mol_type = other DNA
ggcgcgccagtcctggtcatgacgtctgacatttctgacatttctgacatttctgacatttctgacatttctgacatttctgacatttctgacatttctgacatttctgacatttctgacatttctgacatttctgacatttctcacggaatcgagaattctgacatttctgacatttcccggcgggtcgactcggaccgatg

SEQ ID NO: 16843 - DNA, 203 bp, Homo sapiens
  source 1..203: mol_type = other DNA
ggcgcgccagtcctcgtagcaagatctgacatttctgacatttctgacatttctgacatttctgacatttctgacatttctgacatttctgacatttctgacatttctgacatttctgacatttctgacatttctgacatttctccggcgggtgacatttctgacatttctgacatttctgacatttccgactcggaccgatg

SEQ ID NO: 16844 - DNA, 203 bp, Homo sapiens
  source 1..203: mol_type = other DNA
ggcgcgccagtcctttcttgaacgtctgacatttctgacatttctgacatttctgacatttctgacatttctgacatttctgacatttctgacatttctgacatttctgacatttctgacatttctgacatttctgacatttctcgattccgtgacatttctcgattccgtgacatttctgacatttccgactcggaccgatg

SEQ ID NO: 16845 - DNA, 203 bp, Homo sapiens
  source 1..203: mol_type = other DNA
ggcgcgccagtcctcgtcttgacttctgacatttctgacatttctgacatttctgacatttctgacatttctgacatttctgacatttctgacatttctgacatttctgacatttctgacatttctgacatttctgacatttctcgtcaattcctttattctgacatttctgacatttcccggcgggtcgactcggaccgatg

SEQ ID NO: 16846 - DNA, 203 bp, Homo sapiens
  source 1..203: mol_type = other DNA
ggcgcgccagtcctcgacaagacgtctgacatttctgacatttctgacatttctgacatttctgacatttctgacatttctgacatttctgacatttctgacatttctgacatttctgacatttctgacatttctgacatttctgacacggaatcgagaactgacatttctgaccgtcaattcctttacgactcggaccgatg

SEQ ID NO: 16847 - DNA, 203 bp, Homo sapiens
  source 1..203: mol_type = other DNA
ggcgcgccagtcctcgtctcggtttctgacatttctgacatttctgacatttctgacatttctgacatttctgacatttctgacatttctgacatttctgacatttctgacatttctgacatttctgacatttctgacatttctgacatccggcgggtttctgacatttctgacatttcccggcgggtcgactcggaccgatg

SEQ ID NO: 16848 - DNA, 203 bp, Homo sapiens
  source 1..203: mol_type = other DNA
ggcgcgccagtcctaatcttaacgtctgacatttctgacatttctgacatttctgacatttctgacatttctgacatttctgacatttctgacatttctgacatttctgacatttctgacatttctgacatttctgacatttctgacatcgtcaattcctttaacatttctgacattttcttggcaaacgactcggaccgatg

SEQ ID NO: 16849 - DNA, 203 bp, Homo sapiens
  source 1..203: mol_type = other DNA
ggcgcgccagtcctcgttgactgttctgacatttctgacatttctgacatttctgacatttctgacatttctgacatttctgacatttctgacatttctgacatttctgacatttctgacatttctgacatttctgacatttctgacatttaccggccgtctgacatttctgacatttctgacatttccgactcggaccgatg

SEQ ID NO: 16850 - DNA, 203 bp, Homo sapiens
  source 1..203: mol_type = other DNA
ggcgcgccagtcctgtcttagacgtctgacatttctgacatttctgacatttctgacatttctgacatttctgacatttctgacatttctgacatttctgacatttctgacatttctgacatttctgacatttctgacatttctgacatttaccggccgtctgacatttctgacatttctgtactccccgactcggaccgatg

SEQ ID NO: 16851 - DNA, 203 bp, Homo sapiens
  source 1..203: mol_type = other DNA
ggcgcgccagtcctctgtgcaacgtctgacatttctgacatttctgacatttctgacatttctgacatttctgacatttctgacatttctgacatttctgacatttctgacatttctgacatttctgacatttctgacatttctgacatttaccggccgtctgacatttctgaccgtcaattcctttacgactcggaccgatg

SEQ ID NO: 16852 - DNA, 203 bp, Homo sapiens
  source 1..203: mol_type = other DNA
ggcgcgccagtcctgacatggacgtctgacatttctgacatttctgacatttctgacatttctgacatttctgacatttctgacatttctgacatttctgacatttctgacatttctgacatttctgacatttctgacatttctgacatttccggcgggtctgacatttctgaccgtcaattcctttacgactcggaccgatg

SEQ ID NO: 16853 - DNA, 203 bp, Homo sapiens
  source 1..203: mol_type = other DNA
ggcgcgccagtcctcgttcacttatctgacatttctgacatttctgacatttctgacatttctgacatttctgacatttctgacatttctgacatttctgacatttctgacatttctgacatttctgacatttctgacatttctgacatttctcacggaatcgagaattctgaccacggaatcgagaacgactcggaccgatg

SEQ ID NO: 16854 - DNA, 203 bp, Homo sapiens
  source 1..203: mol_type = other DNA
ggcgcgccagtcctgaatcagacgtctgacatttctgacatttctgacatttctgacatttctgacatttctgacatttctgacatttctgacatttctgacatttctgacatttctgacatttctgacatttctgacatttctgacatttctcgtcaattcctttattctgacatttctgtactccccgactcggaccgatg

SEQ ID NO: 16855 - DNA, 203 bp, Homo sapiens
  source 1..203: mol_type = other DNA
ggcgcgccagtcctcgtaaagtgctctgacatttctgacatttctgacatttctgacatttctgacatttctgacatttctgacatttctgacatttctgacatttctgacatttctgacatttctgacatttctgacatttctgacatttctgacaccggccgtatttctgacatttcccggcgggtcgactcggaccgatg

SEQ ID NO: 16856 - DNA, 203 bp, Homo sapiens
  source 1..203: mol_type = other DNA
ggcgcgccagtcctcaggactacgtctgacatttctgacatttctgacatttctgacatttctgacatttctgacatttctgacatttctgacatttctgacatttctgacatttctgacatttctgacatttctgacatttctgacatttctgacatcacggaatcgagaaacatttcaccggccgtcgactcggaccgatg

SEQ ID NO: 16857 - DNA, 203 bp, Homo sapiens
  source 1..203: mol_type = other DNA
ggcgcgccagtcctgactgttacgtctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16858 - DNA, 203 bp, Homo sapiens
  source 1..203: mol_type = other DNA
ggcgcgccagtcctcgtcaccttctctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16859 - DNA, 203 bp, Homo sapiens
  source 1..203: mol_type = other DNA
ggcgcgccagtcctcgttaactcgtctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16860 - DNA, 203 bp, Homo sapiens
  source 1..203: mol_type = other DNA
ggcgcgccagtcctcgtagtcgagtctgacatttctgacatttctgacatttctgacatttctgacatttctgacatttctgacatttctgacatttctgacatttctgacatttctgacatttctgacatttctgacatttctgacatttctgacatccggcgggtttctgacatccggcgggtttccgactcggaccgatg

SEQ ID NO: 16861 - DNA, 203 bp, Homo sapiens
  source 1..203: mol_type = other DNA
ggcgcgccagtcctgcaccaagcgtctgacatttctgacatttctgacatttctgacatttctgacatttctgacatttctgacatttctgacatttctgacatttctgacatttctgacatttctgacatttctgacatttctgacatttctgacatccggcgggtttctgaccgtcaattcctttacgactcggaccgatg

SEQ ID NO: 16862 - DNA, 203 bp, Homo sapiens
  source 1..203: mol_type = other DNA
ggcgcgccagtcctgctgtctgcgtctgacatttctgacatttctgacatttctgacatttctgacatttctgacatttctgacatttctgacatttctgacatttctgacatttctgacatttctgacatttctgacatttctgacatttctgacatcgtcaattcctttaacatttcaccggccgtcgactcggaccgatg

SEQ ID NO: 16863 - DNA, 203 bp, Homo sapiens
  source 1..203: mol_type = other DNA
ggcgcgccagtccttgggtctgcgtctgacatttctgacatttctgacatttctgacatttctgacatttctgacatttctgacatttctgacatttctgacatttctgacatttctgacatttctgacatttctgacatttctgacatttctgacatcgtcaattcctttaacatttcccggcgggtcgactcggaccgatg

SEQ ID NO: 16864 - DNA, 203 bp, Homo sapiens
  source 1..203: mol_type = other DNA
ggcgcgccagtccttgctactgcgtctgacatttctgacatttctgacatttctgacatttctgacatttctgacatttctgacatttctgacatttctgacatttctgacatttctgacatttctgacatttctgacatttctgacatttctgacatcgtcaattcctttaacatttctgacatttccgactcggaccgatg

SEQ ID NO: 16865 - DNA, 203 bp, Homo sapiens
  source 1..203: mol_type = other DNA
ggcgcgccagtcctcctacaagcgtctgacatttctgacatttctgacatttctgacatttctgacatttctgacatttctgacatttctgacatttctgacatttctgacatttctgacatttctgacatttctgacatttctgacatttctgacatgggagtaatttctgacatttctgacatttccgactcggaccgatg

SEQ ID NO: 16866 - DNA, 203 bp, Homo sapiens
  source 1..203: mol_type = other DNA
ggcgcgccagtcctcttgttagcgtctgacatttctgacatttctgacatttctgacatttctgacatttctgacatttctgacatttctgacatttctgacatttctgacatttctgacatttctgacatttctgacatttctgacatttctgacatttcacggaatcgagaaatttctgacatttccgactcggaccgatg

SEQ ID NO: 16867 - DNA, 203 bp, Homo sapiens
  source 1..203: mol_type = other DNA
ggcgcgccagtcctctcaagagcgtctgacatttctgacatttctgacatttctgacatttctgacatttctgacatttctgacatttctgacatttctgacatttctgacatttctgacatttctgacatttctgacatttctgacatttctgacatttcacggaatcgagaaatttctgtactccccgactcggaccgatg

SEQ ID NO: 16868 - DNA, 203 bp, Homo sapiens
  source 1..203: mol_type = other DNA
ggcgcgccagtccttcgctttgcgtctgacatttctgacatttctgacatttctgacatttctgacatttctgacatttctgacatttctgacatttctgacatttctgacatttctgacatttctgacatttctgacatttctgacatttctgacatttcgtcaattcctttacgtcaattcctttacgactcggaccgatg

SEQ ID NO: 16869 - DNA, 203 bp, Homo sapiens
  source 1..203: mol_type = other DNA
ggcgcgccagtcctcgctctaagatctgacatttctgacatttctgacatttctgacatttctgacatttctgacatttctgacatttctgacatttctgacatttctgacatttctgacatttctgacatttctgacatttctgacatttctgacatttctgacatcgtcaattcctttaacatttccgactcggaccgatg

SEQ ID NO: 16870 - DNA, 203 bp, Homo sapiens
  source 1..203: mol_type = other DNA
ggcgcgccagtcctcgctaggatctctgacatttctgacatttctgacatttctgacatttctgacatttctgacatttctgacatttctgacatttctgacatttctgacatttctgacatttctgacatttctgacatttctgacatttctgacatttctgacattactccccgtcaattcctttacgactcggaccgatg

SEQ ID NO: 16871 - DNA, 203 bp, Homo sapiens
  source 1..203: mol_type = other DNA
ggcgcgccagtcctcgcctcgtagtctgacatttctgacatttctgacatttctgacatttctgacatttctgacatttctgacatttctgacatttctgacatttctgacatttctgacatttctgacatttctgacatttctgacatttctgacatttctgacatttcaccggccgtccggcgggtcgactcggaccgatg

SEQ ID NO: 16872 - DNA, 203 bp, Homo sapiens
  source 1..203: mol_type = other DNA
ggcgcgccagtcctcgctcagcgttctgacatttctgacatttctgacatttctgacatttctgacatttctgacatttctgacatttctgacatttctgacatttctgacatttctgacatttctgacatttctgacatttctgacatttctgacatttctgacatttctactcccttcttggcaaacgactcggaccgatg

SEQ ID NO: 16873 - DNA, 203 bp, Homo sapiens
  source 1..203: mol_type = other DNA
ggcgcgccagtcctcgcctttcgttctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16874 - DNA, 203 bp, Homo sapiens
  source 1..203: mol_type = other DNA
ggcgcgccagtcctcgcctagtcctctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16875 - DNA, 203 bp, Homo sapiens
  source 1..203: mol_type = other DNA
ggcgcgccagtcctcgctttgagttctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16876 - DNA, 203 bp, Homo sapiens
  source 1..203: mol_type = other DNA
ggcgcgccagtcctcgctgacaaatctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16877 - DNA, 203 bp, Homo sapiens
  source 1..203: mol_type = other DNA
ggcgcgccagtcctcgctaccgtttctgacatttctgacatttctgacatttctgacatttctgacatttctgacatttctgacatttctgacatttctgacatttctgacatttctgacatttctgacatttctgacatttctgacatttctgacatttctgacatttctgacatccggcgggtttccgactcggaccgatg

SEQ ID NO: 16878 - DNA, 203 bp, Homo sapiens
  source 1..203: mol_type = other DNA
ggcgcgccagtcctacaactcacgtctgacatttctgacatttctgacatttctgacatttctgacatttctgacatttctgacatttctgacatttctgacatttctgacatttctgacatttctgacatttctgacatttctgacatttctgacatttctgacatttctgacattactcccatttccgactcggaccgatg

SEQ ID NO: 16879 - DNA, 203 bp, Homo sapiens
  source 1..203: mol_type = other DNA
ggcgcgccagtccttaacgaggcatctgacatttctgacatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 16880 - DNA, 203 bp, Homo sapiens
  source 1..203: mol_type = other DNA
ggcgcgccagtcctagcttcgttatctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16881 - DNA, 203 bp, Homo sapiens
  source 1..203: mol_type = other DNA
ggcgcgccagtccttctttaacgatctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16882 - DNA, 203 bp, Homo sapiens
  source 1..203: mol_type = other DNA
ggcgcgccagtcctcttctcgttatctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16883 - DNA, 203 bp, Homo sapiens
  source 1..203: mol_type = other DNA
ggcgcgccagtccttaacgacatttctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16884 - DNA, 203 bp, Homo sapiens
  source 1..203: mol_type = other DNA
ggcgcgccagtccttaacgagtggtctgacatttctgacatttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 16885 - DNA, 203 bp, Homo sapiens
  source 1..203: mol_type = other DNA
ggcgcgccagtcctgcaaacgcactctgacatttctgacatttctgacatttctgacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 16886 - DNA, 203 bp, Homo sapiens
  source 1..203: mol_type = other DNA
ggcgcgccagtcctcgacctagtctctgacatttctgacatttctgacatttctgacatttctgacatttctgacatttctgacatttctgacatttctgacatttctgacatttctgacatttctgacatttctgacatttctgacatttctgacatttctgacatttctgactactccctactccccgactcggaccgatg

SEQ ID NO: 16887 - DNA, 203 bp, Homo sapiens
  source 1..203: mol_type = other DNA
ggcgcgccagtcctcacgttaacatctgacatttctgacatttctgacatttctgacatttctgacatttctgacatttctgacatttctgacatttctgacatttctgacatttctgacatttctgacatttctgacatttctgacatttctgacatttctgacatttcttcttggcaaatactccccgactcggaccgatg

SEQ ID NO: 16888 - DNA, 203 bp, Homo sapiens
  source 1..203: mol_type = other DNA
ggcgcgccagtcctgctaccacgttctgacatttctgacatttctgacatttctgacatttctgacatttctgacatttctgacatttctgacatttctgacatttctgacatttctgacatttctgacatttctgacatttctgacatttctgacatttctgactactcccacatttcaccggccgtcgactcggaccgatg

SEQ ID NO: 16889 - DNA, 203 bp, Homo sapiens
  source 1..203: mol_type = other DNA
ggcgcgccagtcctttaaacgtgctctgacatttctgacatttctgacatttctgacatttctgacatttctgacatttctgacatttctgacatttctgacatttctgacatttctgacatttctgacatttctgacatttctgacatttctgacatttctgcacggaatcgagaattcttggcaaacgactcggaccgatg

SEQ ID NO: 16890 - DNA, 203 bp, Homo sapiens
  source 1..203: mol_type = other DNA
ggcgcgccagtcctaacgtgcatttctgacatttctgacatttctgacatttctgacatttctgacatttctgacatttctgacatttctgacatttctgacatttctgacatttctgacatttctgacatttctgacatttctgacatttctgacatttctgccggcgggtacatttcaccggccgtcgactcggaccgatg

SEQ ID NO: 16891 - DNA, 203 bp, Homo sapiens
  source 1..203: mol_type = other DNA
ggcgcgccagtcctacgtgcttcttctgacatttctgacatttctgacatttctgacatttctgacatttctgacatttctgacatttctgacatttctgacatttctgacatttctgacatttctgacatttctgacatttctgacatttctgacatttctgccggcgggtacatttcccggcgggtcgactcggaccgatg

SEQ ID NO: 16892 - DNA, 203 bp, Homo sapiens
  source 1..203: mol_type = other DNA
ggcgcgccagtccttgcgttaaggtctgacatttctgacatttctgacatttctgacatttctgacatttctgacatttctgacatttctgacatttctgacatttctgacatttctgacatttctgacatttctgacatttctgacatttctgacatttctgtactccctgacattttcttggcaaacgactcggaccgatg

SEQ ID NO: 16893 - DNA, 203 bp, Homo sapiens
  source 1..203: mol_type = other DNA
ggcgcgccagtcctttaacgcatttctgacatttctgacatttctgacatttctgacatttctgacatttctgacatttctgacatttctgacatttctgacatttctgacatttctgacatttctgacatttctgacatttctgacatttctgacatttctgttcttggcaaaatttctgacatttccgactcggaccgatg

SEQ ID NO: 16894 - DNA, 203 bp, Homo sapiens
  source 1..203: mol_type = other DNA
ggcgcgccagtccttgtctaacgctctgacatttctgacatttctgacatttctgacatttctgacatttctgacatttctgacatttctgacatttctgacatttctgacatttctgacatttctgacatttctgacatttctgacatttctgacatttctgttcttggcaaacacggaatcgagaacgactcggaccgatg

SEQ ID NO: 16895 - DNA, 203 bp, Homo sapiens
  source 1..203: mol_type = other DNA
ggcgcgccagtcctctgctgtgcgtctgacatttctgacatttctgacatttctgacatttctgacatttctgacatttctgacatttctgacatttctgacatttctgacatttctgacatttctgacatttctgacatttctgacatttctgacatttcttcttggcaaaacatttcccggcgggtcgactcggaccgatg

SEQ ID NO: 16896 - DNA, 203 bp, Homo sapiens
  source 1..203: mol_type = other DNA
ggcgcgccagtccttgacatactctctgacatttctgacatttctgacatttctgacatttctgacatttctgacatttctgacatttctgacatttctgacatttctgacatttctgacatttctgacatttctgacatttctgacatttctgacccggcgggtatttctgacatttcaccggccgtcgactcggaccgatg

SEQ ID NO: 16897 - DNA, 203 bp, Homo sapiens
  source 1..203: mol_type = other DNA
ggcgcgccagtcctgaccagtacatctgacatttctgacatttctgacatttctgacatttctgacatttctgacatttctgacatttctgacatttctgacatttctgacatttctgacatttctgacatttctgacatttctgacatttctgactactcccacatttctgacattttcttggcaaacgactcggaccgatg

SEQ ID NO: 16898 - DNA, 203 bp, Homo sapiens
  source 1..203: mol_type = other DNA
ggcgcgccagtcctcgtctacagctctgacatttctgacatttctgacatttctgacatttctgacatttctgacatttctgacatttctgacatttctgacatttctgacatttctgacatttctgacatttctgacatttctgacatttctgacttcttggcaaattctgacatttctgacatttccgactcggaccgatg

SEQ ID NO: 16899 - DNA, 203 bp, Homo sapiens
  source 1..203: mol_type = other DNA
ggcgcgccagtcctagacctgggttctgacatttctgacatttctgacatttctgacatttctgacatttctgacatttctgacatttctgacatttctgacatttctgacatttctgacatttctgacatttctgacatttctgacatttctgacttcttggcaaattctgacatttctgtactccccgactcggaccgatg

SEQ ID NO: 16900 - DNA, 203 bp, Homo sapiens
  source 1..203: mol_type = other DNA
ggcgcgccagtcctgcagcctgggtctgacatttctgacatttctgacatttctgacatttctgacatttctgacatttctgacatttctgacatttctgacatttctgacatttctgacatttctgacatttctgacatttctgacatttctgacttcttggcaaattctgaccgtcaattcctttacgactcggaccgatg

SEQ ID NO: 16901 - DNA, 203 bp, Homo sapiens
  source 1..203: mol_type = other DNA
ggcgcgccagtcctacccaggttctctgacatttctgacatttctgacatttctgacatttctgacatttctgacatttctgacatttctgacatttctgacatttctgacatttctgacatttctgacatttctgacatttctgacatttctgccggcgggtacatttctgacattttcttggcaaacgactcggaccgatg

SEQ ID NO: 16902 - DNA, 203 bp, Homo sapiens
  source 1..203: mol_type = other DNA
ggcgcgccagtcctcattctactatctgacatttctgacatttctgacatttctgacatttctgacatttctgacatttctgacatttctgacatttctgacatttctgacatttctgacatttctgacatttctgacatttctgacatttcttactcccctgacatttctgaccgtcaattcctttacgactcggaccgatg

SEQ ID NO: 16903 - DNA, 203 bp, Homo sapiens
  source 1..203: mol_type = other DNA
ggcgcgccagtcctggatcttgggtctgacatttctgacatttctgacatttctgacatttctgacatttctgacatttctgacatttctgacatttctgacatttctgacatttctgacatttctgacatttctgacatttctgacatttcttggcaaactgacatttctgacatttctgacatttccgactcggaccgatg

SEQ ID NO: 16904 - DNA, 203 bp, Homo sapiens
  source 1..203: mol_type = other DNA
ggcgcgccagtcctgtctgacagttctgacatttctgacatttctgacatttctgacatttctgacatttctgacatttctgacatttctgacatttctgacatttctgacatttctgacatttctgacatttctgacatttctgacattttactcccttctgacatttctgacatttcaccggccgtcgactcggaccgatg

SEQ ID NO: 16905 - DNA, 203 bp, Homo sapiens
  source 1..203: mol_type = other DNA
ggcgcgccagtcctcagtctgacatctgacatttctgacatttctgacatttctgacatttctgacatttctgacatttctgacatttctgacatttctgacatttctgacatttctgacatttctgacatttctgacatttctgacattttactcccttctgacatttctgacatttcccggcgggtcgactcggaccgatg

SEQ ID NO: 16906 - DNA, 203 bp, Homo sapiens
  source 1..203: mol_type = other DNA
ggcgcgccagtccttgtcagacagtctgacatttctgacatttctgacatttctgacatttctgacatttctgacatttctgacatttctgacatttctgacatttctgacatttctgacatttctgacatttctgacatttctgacccggcgggtatttctgacatttctgacattttcttggcaaacgactcggaccgatg

SEQ ID NO: 16907 - DNA, 203 bp, Homo sapiens
  source 1..203: mol_type = other DNA
ggcgcgccagtcctacgtctacgttctgacatttctgacatttctgacatttctgacatttctgacatttctgacatttctgacatttctgacatttctgacatttctgacatttctgacatttctgacatttctgacatttcttggcaaactgacatttcttggcaaactgacatttcttggcaaaccgactcggaccgatg

SEQ ID NO: 16908 - DNA, 203 bp, Homo sapiens
  source 1..203: mol_type = other DNA
ggcgcgccagtccttgttagacgttctgacatttctgacatttctgacatttctgacatttctgacatttctgacatttctgacatttctgacatttctgacatttctgacatttctgacatttctgacatttctgacattttactcccttctgacatttctgacatttctgacattttcttggcaaacgactcggaccgatg

SEQ ID NO: 16909 - DNA, 203 bp, Homo sapiens
  source 1..203: mol_type = other DNA
ggcgcgccagtcctagacgtacagtctgacatttctgacatttctgacatttctgacatttctgacatttctgacatttctgacatttctgacatttctgacatttctgacatttctgacatttctgacatttctgaccggcgggtcatttctgacatttctgacatttctgaccgtcaattcctttacgactcggaccgatg

SEQ ID NO: 16910 - DNA, 203 bp, Homo sapiens
  source 1..203: mol_type = other DNA
ggcgcgccagtcctagttttgaaatctgacatttctgacatttctgacatttctgacatttctgacatttctgacatttctgacatttctgacatttctgacatttctgacatttctgacatttctgacatttctgacttcttggcaaattctgacatttctgacatttctgacattttcttggcaaacgactcggaccgatg

SEQ ID NO: 16911 - DNA, 203 bp, Homo sapiens
  source 1..203: mol_type = other DNA
ggcgcgccagtcctctggatcggttctgacatttctgacatttctgacatttctgacatttctgacatttctgacatttctgacatttctgacatttctgacatttctgacatttctgacatttctgacatttctgatactcccgacatttctgacatttctgacatttctgacatttcaccggccgtcgactcggaccgatg

SEQ ID NO: 16912 - DNA, 203 bp, Homo sapiens
  source 1..203: mol_type = other DNA
ggcgcgccagtccttgcgaccttctctgacatttctgacatttctgacatttctgacatttctgacatttctgacatttctgacatttctgacatttctgacatttctgacatttctgacatttctgacatttcttactcccctgacatttctgacatttctgacatttctgacattttcttggcaaacgactcggaccgatg

SEQ ID NO: 16913 - DNA, 203 bp, Homo sapiens
  source 1..203: mol_type = other DNA
ggcgcgccagtcctctctagcgactctgacatttctgacatttctgacatttctgacatttctgacatttctgacatttctgacatttctgacatttctgacatttctgacatttctgacatttctgacatttttcttggcaaagacatttctgacatttctgacatttctgacatttcccggcgggtcgactcggaccgatg

SEQ ID NO: 16914 - DNA, 203 bp, Homo sapiens
  source 1..203: mol_type = other DNA
ggcgcgccagtcctgcgacttggttctgacatttctgacatttctgacatttctgacatttctgacatttctgacatttctgacatttctgacatttctgacatttctgacatttctgacatttctgaccggcgggtcatttctgacatttctgacatttctgacatttctgacatttcaccggccgtcgactcggaccgatg

SEQ ID NO: 16915 - DNA, 203 bp, Homo sapiens
  source 1..203: mol_type = other DNA
ggcgcgccagtcctagagtcgccttctgacatttctgacatttctgacatttctgacatttctgacatttctgacatttctgacatttctgacatttctgacatttctgacatttctgacatttctgaccggcgggtcatttctgacatttctgacatttctgacatttctgacatttcccggcgggtcgactcggaccgatg

SEQ ID NO: 16916 - DNA, 203 bp, Homo sapiens
  source 1..203: mol_type = other DNA
ggcgcgccagtcctcgacgtcgcttctgacatttctgacatttctgacatttctgacatttctgacatttctgacatttctgacatttctgacatttctgacatttctgacatttctgacatttctgacgtcaattcctttactgacatttctgacatttctgacatttctgacattttcttggcaaacgactcggaccgatg

SEQ ID NO: 16917 - DNA, 203 bp, Homo sapiens
  source 1..203: mol_type = other DNA
ggcgcgccagtccttaagtcgctatctgacatttctgacatttctgacatttctgacatttctgacatttctgacatttctgacatttctgacatttctgacatttctgacatttctgacatttctgattcttggcaaatttctgacatttctgacatttctgacatttctgaccgtcaattcctttacgactcggaccgatg

SEQ ID NO: 16918 - DNA, 203 bp, Homo sapiens
  source 1..203: mol_type = other DNA
ggcgcgccagtcctctgcgacatgtctgacatttctgacatttctgacatttctgacatttctgacatttctgacatttctgacatttctgacatttctgacatttctgacatttctgacatttcttggcaaactgacatttctgacatttctgacatttcttggcaaactgacatttctgacatttccgactcggaccgatg

SEQ ID NO: 16919 - DNA, 203 bp, Homo sapiens
  source 1..203: mol_type = other DNA
ggcgcgccagtcctcacctgtcgctctgacatttctgacatttctgacatttctgacatttctgacatttctgacatttctgacatttctgacatttctgacatttctgacatttctgattcttggcaaatttctgacatttctgacatttctgacatttctgacatttctgacatttcccggcgggtcgactcggaccgatg

SEQ ID NO: 16920 - DNA, 203 bp, Homo sapiens
  source 1..203: mol_type = other DNA
ggcgcgccagtcctcgagcgacagtctgacatttctgacatttctgacatttctgacatttctgacatttctgacatttctgacatttctgacatttctgacatttctgacatttctgcacggaatcgagaatctgacatttctgacatttctgacatttctgacatttctgacatttctgacatttccgactcggaccgatg

SEQ ID NO: 16921 - DNA, 203 bp, Homo sapiens
  source 1..203: mol_type = other DNA
ggcgcgccagtccttgaatgtcgctctgacatttctgacatttctgacatttctgacatttctgacatttctgacatttctgacatttctgacatttctgacatttctgacatttctgcacggaatcgagaatctgacatttctgacatttctgacatttctgacatttctgaccacggaatcgagaacgactcggaccgatg

SEQ ID NO: 16922 - DNA, 203 bp, Homo sapiens
  source 1..203: mol_type = other DNA
ggcgcgccagtcctgttggtcgcctctgacatttctgacatttctgacatttctgacatttctgacatttctgacatttctgacatttctgacatttctgacatttctgacatttctgcgtcaattcctttatctgacatttctgacatttctgacatttctgacatttctgacatttctgacatttccgactcggaccgatg

SEQ ID NO: 16923 - DNA, 203 bp, Homo sapiens
  source 1..203: mol_type = other DNA
ggcgcgccagtcctgtcgctctaatctgacatttctgacatttctgacatttctgacatttctgacatttctgacatttctgacatttctgacatttctgacatttctgacatttctgcgtcaattcctttatctgacatttctgacatttctgacatttctgacatttctgaccgtcaattcctttacgactcggaccgatg

SEQ ID NO: 16924 - DNA, 203 bp, Homo sapiens
  source 1..203: mol_type = other DNA
ggcgcgccagtcctgtcgctgatctctgacatttctgacatttctgacatttctgacatttctgacatttctgacatttctgacatttctgacatttctgacatttctgacatttctgtactccctgacatttctgacatttctgacatttctgacatttctgacatttctgaccgtcaattcctttacgactcggaccgatg

SEQ ID NO: 16925 - DNA, 203 bp, Homo sapiens
  source 1..203: mol_type = other DNA
ggcgcgccagtcctgtgtcgctcatctgacatttctgacatttctgacatttctgacatttctgacatttctgacatttctgacatttctgacatttctgacatttctgacatttctttcttggcaaacatttctgacatttctgacatttctgacatttctgacatttctgacattttcttggcaaacgactcggaccgatg

SEQ ID NO: 16926 - DNA, 203 bp, Homo sapiens
  source 1..203: mol_type = other DNA
ggcgcgccagtcctaatgtcgtagtctgacatttctgacatttctgacatttctgacatttctgacatttctgacatttctgacatttctgacatttctgacatttctgaccacggaatcgagaatgacatttctgacatttctgacatttctgacatttctgacatttctgacatttctgacatttccgactcggaccgatg

SEQ ID NO: 16927 - DNA, 203 bp, Homo sapiens
  source 1..203: mol_type = other DNA
ggcgcgccagtcctcgcctagaattctgacatttctgacatttctgacatttctgacatttctgacatttctgacatttctgacatttctgacatttctgacatttctgaccgtcaattcctttatgacatttctgacatttctgacatttctgacatttctgacatttctgacatttctgtactccccgactcggaccgatg

SEQ ID NO: 16928 - DNA, 203 bp, Homo sapiens
  source 1..203: mol_type = other DNA
ggcgcgccagtcctcctagacggttctgacatttctgacatttctgacatttctgacatttctgacatttctgacatttctgacatttctgacatttctgacatttctgattcttggcaaatttctgacatttctgacatttctgacatttctgacatttctgacatttctgacattttcttggcaaacgactcggaccgatg

SEQ ID NO: 16929 - DNA, 203 bp, Homo sapiens
  source 1..203: mol_type = other DNA
ggcgcgccagtccttctttctaggtctgacatttctgacatttctgacatttctgacatttctgacatttctgacatttctgacatttctgacatttctgacatttctgcacggaatcgagaatctgacatttctgacatttctgacatttctgacatttctgacatttctgacatttcccggcgggtcgactcggaccgatg

SEQ ID NO: 16930 - DNA, 203 bp, Homo sapiens
  source 1..203: mol_type = other DNA
ggcgcgccagtcctcgtctagtgttctgacatttctgacatttctgacatttctgacatttctgacatttctgacatttctgacatttctgacatttctgacatttctgcatactcccccatttctgacatttctgacatttctgacatttctgacatttctgacatttctgacatttctgacatttccgactcggaccgatg

SEQ ID NO: 16931 - DNA, 203 bp, Homo sapiens
  source 1..203: mol_type = other DNA
ggcgcgccagtcctgcttctagtctctgacatttctgacatttctgacatttctgacatttctgacatttctgacatttctgacatttctgacatttctgacatttctgcgtcaattcctttatctgacatttctgacatttctgacatttctgacatttctgacatttctgacatttcccggcgggtcgactcggaccgatg

SEQ ID NO: 16932 - DNA, 203 bp, Homo sapiens
  source 1..203: mol_type = other DNA
ggcgcgccagtcctatctagttggtctgacatttctgacatttctgacatttctgacatttctgacatttctgacatttctgacatttctgacatttctgacatttctgtaccggccgtgcgttctgacatttctgacatttctgacatttctgacatttctgacatttctgacatttctgacatttccgactcggaccgatg

SEQ ID NO: 16933 - DNA, 203 bp, Homo sapiens
  source 1..203: mol_type = other DNA
ggcgcgccagtcctcttctaggcgtctgacatttctgacatttctgacatttctgacatttctgacatttctgacatttctgacatttctgacatttctgacatttctgtaccggccgtgctttctgacatttctgacatttctgacatttctgacatttctgacatttctgacatttctgacatttccgactcggaccgatg

SEQ ID NO: 16934 - DNA, 203 bp, Homo sapiens
  source 1..203: mol_type = other DNA
ggcgcgccagtcctggtttagcgttctgacatttctgacatttctgacatttctgacatttctgacatttctgacatttctgacatttctgacatttctgacatttctgttcttggcaacatttctgacatttctgacatttctgacatttctgacatttctgacatttctgacatttctgacatttccgactcggaccgatg

SEQ ID NO: 16935 - DNA, 203 bp, Homo sapiens
  source 1..203: mol_type = other DNA
ggcgcgccagtccttagtcaggtgtctgacatttctgacatttctgacatttctgacatttctgacatttctgacatttctgacatttctgacatttctgacatttcttcttggcaaaacatttctgacatttctgacatttctgacatttctgacatttctgacatttctgacatttctgacatttccgactcggaccgatg

SEQ ID NO: 16936 - DNA, 203 bp, Homo sapiens
  source 1..203: mol_type = other DNA
ggcgcgccagtcctggtcaggtcctctgacatttctgacatttctgacatttctgacatttctgacatttctgacatttctgacatttctgacatttctgacatttcttggcaaactgacatttctgacatttctgacatttctgacatttctgacatttctgacatttctgacatttctgacatttccgactcggaccgatg

SEQ ID NO: 16937 - DNA, 203 bp, Homo sapiens
  source 1..203: mol_type = other DNA
ggcgcgccagtcctaaacctgatctctgacatttctgacatttctgacatttctgacatttctgacatttctgacatttctgacatttctgacatttctgacatttcttggcaaactgacatttctgacatttctgacatttcttggcaaactgacatttctgacatttctgacatttctgacatttccgactcggaccgatg

SEQ ID NO: 16938 - DNA, 203 bp, Homo sapiens
  source 1..203: mol_type = other DNA
ggcgcgccagtcctacctgaagaatctgacatttctgacatttctgacatttctgacatttctgacatttctgacatttctgacatttctgacatttctgacatttcttggcaaactgacatttctgacatttctgacatttcttggcaaactgacatttcttggcaaactgacatttctgacatttccgactcggaccgatg

SEQ ID NO: 16939 - DNA, 203 bp, Homo sapiens
  source 1..203: mol_type = other DNA
ggcgcgccagtcctctggtgcatttctgacatttctgacatttctgacatttctgacatttctgacatttctgacatttctgacatttctgacatttctgacattttcttggcaaatgacatttctgacatttctgacatttctgacatttctgacatttctgacatttctgacatttcaccggccgtcgactcggaccgatg

SEQ ID NO: 16940 - DNA, 203 bp, Homo sapiens
  source 1..203: mol_type = other DNA
ggcgcgccagtcctaatgcaccactctgacatttctgacatttctgacatttctgacatttctgacatttctgacatttctgacatttctgacatttctgacattttcttggcaaatgacatttctgacatttctgacatttctgacatttctgacatttctgacatttctgacatttcccggcgggtcgactcggaccgatg

SEQ ID NO: 16941 - DNA, 203 bp, Homo sapiens
  source 1..203: mol_type = other DNA
ggcgcgccagtcctgactagaacgtctgacatttctgacatttctgacatttctgacatttctgacatttctgacatttctgacatttctgacatttctgacattttgccaagaactgacattttgccaagaactgacattttgccaagaactgacattttgccaagaactgacatttctgacatttccgactcggaccgatg

SEQ ID NO: 16942 - DNA, 203 bp, Homo sapiens
  source 1..203: mol_type = other DNA
ggcgcgccagtcctggtagaacgttctgacatttctgacatttctgacatttctgacatttctgacatttctgacatttctgacatttctgacatttctgaccacggaatcgagaatgacatttctgacatttctgacatttctgacatttctgacatttctgacatttctgacatttcaccggccgtcgactcggaccgatg

SEQ ID NO: 16943 - DNA, 203 bp, Homo sapiens
  source 1..203: mol_type = other DNA
ggcgcgccagtcctcgttctagcatctgacatttctgacatttctgacatttctgacatttctgacatttctgacatttctgacatttctgacatttctgaccacggaatcgagaatgacatttctgacatttctgacatttctgacatttctgacatttctgacatttctgacatttcccggcgggtcgactcggaccgatg

SEQ ID NO: 16944 - DNA, 203 bp, Homo sapiens
  source 1..203: mol_type = other DNA
ggcgcgccagtcctattttcagtttctgacatttctgacatttctgacatttctgacatttctgacatttctgacatttctgacatttctgacatttctgacccggcgggtatttctgacatttctgacatttctgacatttctgacatttctgacatttctgacatttctgaccacggaatcgagaacgactcggaccgatg

SEQ ID NO: 16945 - DNA, 203 bp, Homo sapiens
  source 1..203: mol_type = other DNA
ggcgcgccagtcctgtatgtcgggtctgacatttctgacatttctgacatttctgacatttctgacatttctgacatttctgacatttctgacatttctgacccttccgtcaattcctttaagtttgacatttctgacatttctgacatttctgacatttctgacatttctgacatttctgacatttccgactcggaccgatg

SEQ ID NO: 16946 - DNA, 203 bp, Homo sapiens
  source 1..203: mol_type = other DNA
ggcgcgccagtcctaaagaccgggtctgacatttctgacatttctgacatttctgacatttctgacatttctgacatttctgacatttctgacatttctgaccggccgtacatttctgacatttctgacatttctgacatttctgacatttctgacatttctgacatttctgacatttcccggcgggtcgactcggaccgatg

SEQ ID NO: 16947 - DNA, 203 bp, Homo sapiens
  source 1..203: mol_type = other DNA
ggcgcgccagtccttcgtctcgggtctgacatttctgacatttctgacatttctgacatttctgacatttctgacatttctgacatttctgacatttctgaccgtcaattcctttatgacatttctgacatttctgacatttctgacatttctgacatttctgacatttctgacatttcccggcgggtcgactcggaccgatg

SEQ ID NO: 16948 - DNA, 203 bp, Homo sapiens
  source 1..203: mol_type = other DNA
ggcgcgccagtccttagtcatttctctgacatttctgacatttctgacatttctgacatttctgacatttctgacatttctgacatttctgacatttctgaggaagctgcccggcgggtcatgggaaacatttctgacatttctgacatttctgacatttctgacatttctgacatttctgacatttccgactcggaccgatg

SEQ ID NO: 16949 - DNA, 203 bp, Homo sapiens
  source 1..203: mol_type = other DNA
ggcgcgccagtccttacagtgctctctgacatttctgacatttctgacatttctgacatttctgacatttctgacatttctgacatttctgacatttctgatttgcaaccatactccccccggaaccacatttctgacatttctgacatttctgacatttctgacatttctgacatttctgacatttccgactcggaccgatg

SEQ ID NO: 16950 - DNA, 203 bp, Homo sapiens
  source 1..203: mol_type = other DNA
ggcgcgccagtcctgtgagttaagtctgacatttctgacatttctgacatttctgacatttctgacatttctgacatttctgacatttctgacatttctgcaccacccacggaatcgagaaagagctacatttctgacatttctgacatttctgacatttctgacatttctgacatttctgacatttccgactcggaccgatg

SEQ ID NO: 16951 - DNA, 203 bp, Homo sapiens
  source 1..203: mol_type = other DNA
ggcgcgccagtccttttggtcacgtctgacatttctgacatttctgacatttctgacatttctgacatttctgacatttctgacatttctgacatttctgccggcgggtacatttctgacatttctgacatttctgacatttctgacatttctgacatttctgacatttctgacatttcaccggccgtcgactcggaccgatg

SEQ ID NO: 16952 - DNA, 203 bp, Homo sapiens
  source 1..203: mol_type = other DNA
ggcgcgccagtcctgtcactaccctctgacatttctgacatttctgacatttctgacatttctgacatttctgacatttctgacatttctgacatttctgctttgcaaccatactccccccggaaccccatttctgacatttctgacatttctgacatttctgacatttctgacatttctgacatttccgactcggaccgatg

SEQ ID NO: 16953 - DNA, 203 bp, Homo sapiens
  source 1..203: mol_type = other DNA
ggcgcgccagtcctaacgagaccctctgacatttctgacatttctgacatttctgacatttctgacatttctgacatttctgacatttctgacatttctgtactccctgacatttctgacatttctgacatttctgacatttctgacatttctgacatttctgacatttctgacattttcttggcaaacgactcggaccgatg

SEQ ID NO: 16954 - DNA, 203 bp, Homo sapiens
  source 1..203: mol_type = other DNA
ggcgcgccagtcctatcatgaccctctgacatttctgacatttctgacatttctgacatttctgacatttctgacatttctgacatttctgacatttctgttcttggcaaaatttctgacatttctgacatttctgacatttctgacatttctgacatttctgacatttctgacatttctgacatttccgactcggaccgatg

SEQ ID NO: 16955 - DNA, 203 bp, Homo sapiens
  source 1..203: mol_type = other DNA
ggcgcgccagtcctggcaggaccctctgacatttctgacatttctgacatttctgacatttctgacatttctgacatttctgacatttctgacatttcttcttggcaaaacatttctgacatttctgacatttctgacatttctgacatttctgacatttctgacatttctgacatttcaccggccgtcgactcggaccgatg

SEQ ID NO: 16956 - DNA, 203 bp, Homo sapiens
  source 1..203: mol_type = other DNA
ggcgcgccagtcctcctttgaccctctgacatttctgacatttctgacatttctgacatttctgacatttctgacatttctgacatttctgacatttcttgcccttccgtcaattcctttaagtttcagatttctgacatttctgacatttctgacatttctgacatttctgacatttctgacatttccgactcggaccgatg

SEQ ID NO: 16957 - DNA, 203 bp, Homo sapiens
  source 1..203: mol_type = other DNA
ggcgcgccagtcctgggttaagtgtctgacatttctgacatttctgacatttctgacatttctgacatttctgacatttctgacatttctgacattttactcccttctgacatttctgacatttctgacatttctgacatttctgacatttctgacatttctgacatttctgacatttctgacatttccgactcggaccgatg

SEQ ID NO: 16958 - DNA, 203 bp, Homo sapiens
  source 1..203: mol_type = other DNA
ggcgcgccagtcctgggtgacctctctgacatttctgacatttctgacatttctgacatttctgacatttctgacatttctgacatttctgacattttactcccttctgacatttctgacatttctgacatttctgacatttctgacatttctgacatttctgacatttctgacatttctgtactccccgactcggaccgatg

SEQ ID NO: 16959 - DNA, 203 bp, Homo sapiens
  source 1..203: mol_type = other DNA
ggcgcgccagtcctgggtagcctgtctgacatttctgacatttctgacatttctgacatttctgacatttctgacatttctgacatttctgacattttactcccttctgacatttctgacatttctgacatttctgacatttctgacatttctgacatttctgacatttctgaccacggaatcgagaacgactcggaccgatg

SEQ ID NO: 16960 - DNA, 203 bp, Homo sapiens
  source 1..203: mol_type = other DNA
ggcgcgccagtcctcctgcacttctctgacatttctgacatttctgacatttctgacatttctgacatttctgacatttctgacatttctgacattttcttggcaaatgacatttctgacatttctgacatttctgacatttctgacatttctgacatttctgacatttctgacattttcttggcaaacgactcggaccgatg

SEQ ID NO: 16961 - DNA, 203 bp, Homo sapiens
  source 1..203: mol_type = other DNA
ggcgcgccagtccttactagcgtgtctgacatttctgacatttctgacatttctgacatttctgacatttctgacatttctgacatttctgacatttttaatgaaaacattcttggcaaatgctttcgctcttctgacatttctgacatttctgacatttctgacatttctgacatttctgacatttccgactcggaccgatg

SEQ ID NO: 16962 - DNA, 203 bp, Homo sapiens
  source 1..203: mol_type = other DNA
ggcgcgccagtcctgcagtgactttctgacatttctgacatttctgacatttctgacatttctgacatttctgacatttctgacatttctgaccacggaatcgagaatgacatttctgacatttctgacatttctgacatttctgacatttctgacatttctgacatttctgacattttcttggcaaacgactcggaccgatg

SEQ ID NO: 16963 - DNA, 203 bp, Homo sapiens
  source 1..203: mol_type = other DNA
ggcgcgccagtcctgggttgactttctgacatttctgacatttctgacatttctgacatttctgacatttctgacatttctgacatttctgaccatgcaccaccacccacggaatcgagaaagagctatcaatctgacatttctgacatttctgacatttctgacatttctgacatttctgacatttccgactcggaccgatg

SEQ ID NO: 16964 - DNA, 203 bp, Homo sapiens
  source 1..203: mol_type = other DNA
ggcgcgccagtcctggctaagtcatctgacatttctgacatttctgacatttctgacatttctgacatttctgacatttctgacatttctgacggtttcccggaagctgcccggcgggtcatgggaataacgccggacatttctgacatttctgacatttctgacatttctgacatttctgacatttccgactcggaccgatg

SEQ ID NO: 16965 - DNA, 203 bp, Homo sapiens
  source 1..203: mol_type = other DNA
ggcgcgccagtccttggcaagtcatctgacatttctgacatttctgacatttctgacatttctgacatttctgacatttctgacatttctgactggtggtgcccttccgtcaattcctttaagtttcagctttgcaacatttctgacatttctgacatttctgacatttctgacatttctgacatttccgactcggaccgatg

SEQ ID NO: 16966 - DNA, 203 bp, Homo sapiens
  source 1..203: mol_type = other DNA
ggcgcgccagtccttgttgacttgtctgacatttctgacatttctgacatttctgacatttctgacatttctgacatttctgacatttctgacttcttggcaaattctgacatttctgacatttctgacatttctgacatttctgacatttctgacatttctgacatttctgacatttctgacatttccgactcggaccgatg

SEQ ID NO: 16967 - DNA, 203 bp, Homo sapiens
  source 1..203: mol_type = other DNA
ggcgcgccagtcctaagtcaggcctctgacatttctgacatttctgacatttctgacatttctgacatttctgacatttctgacatttctgacttcttggcaaattctgacatttctgacatttctgacatttctgacatttctgacatttctgacatttctgacatttctgaccacggaatcgagaacgactcggaccgatg

SEQ ID NO: 16968 - DNA, 203 bp, Homo sapiens
  source 1..203: mol_type = other DNA
ggcgcgccagtcctacgatctttatctgacatttctgacatttctgacatttctgacatttctgacatttctgacatttctgacatttctgatggtttcccggaagctgcccggcgggtcatgggaataacgccgcacatttctgacatttctgacatttctgacatttctgacatttctgacatttccgactcggaccgatg

SEQ ID NO: 16969 - DNA, 203 bp, Homo sapiens
  source 1..203: mol_type = other DNA
ggcgcgccagtccttttgcacacctctgacatttctgacatttctgacatttctgacatttctgacatttctgacatttctgacatttctgccggcgggtacatttctgacatttctgacatttctgacatttctgacatttctgacatttctgacatttctgacatttctgacattttcttggcaaacgactcggaccgatg

SEQ ID NO: 16970 - DNA, 203 bp, Homo sapiens
  source 1..203: mol_type = other DNA
ggcgcgccagtccttgcacactactctgacatttctgacatttctgacatttctgacatttctgacatttctgacatttctgacatttctgcctggtggtgcccttccgtcaattcctttaagtttcagctttgcaacatttctgacatttctgacatttctgacatttctgacatttctgacatttccgactcggaccgatg

SEQ ID NO: 16971 - DNA, 203 bp, Homo sapiens
  source 1..203: mol_type = other DNA
ggcgcgccagtcctgtctggtttatctgacatttctgacatttctgacatttctgacatttctgacatttctgacatttctgacatttctgcgcaaactgacatttctgcgcaaactgacatttctgcgcaaactgacatttctgcgcaaactgacatttctgcgcaaactgacatttctgacatttccgactcggaccgatg

SEQ ID NO: 16972 - DNA, 203 bp, Homo sapiens
  source 1..203: mol_type = other DNA
ggcgcgccagtcctaaagtatgaatctgacatttctgacatttctgacatttctgacatttctgacatttctgacatttctgacatttctgtgcaaactgacatttctgtgcaaactgacatttctgtgcaaactgacatttctgtgcaaactgacatttctgtgcaaactgacatttctgacatttccgactcggaccgatg

SEQ ID NO: 16973 - DNA, 203 bp, Homo sapiens
  source 1..203: mol_type = other DNA
ggcgcgccagtccttaagtatgggtctgacatttctgacatttctgacatttctgacatttctgacatttctgacatttctgacatttctgttcttggcaaaatttctgacatttctgacatttctgacatttctgacatttctgacatttctgacatttctgacatttctgacatttcaccggccgtcgactcggaccgatg

SEQ ID NO: 16974 - DNA, 203 bp, Homo sapiens
  source 1..203: mol_type = other DNA
ggcgcgccagtcctacgacagatatctgacatttctgacatttctgacatttctgacatttctgacatttctgacatttctgacatttcttagcaaactgacatttcttagcaaactgacatttcttagcaaactgacatttcttagcaaactgacatttcttagcaaactgacatttctgacatttccgactcggaccgatg

SEQ ID NO: 16975 - DNA, 203 bp, Homo sapiens
  source 1..203: mol_type = other DNA
ggcgcgccagtcctgtttgtatcctctgacatttctgacatttctgacatttctgacatttctgacatttctgacatttctgacatttcttcctggtggtgcccttccgtcaattcctttaagtttcagctttgcaacatttctgacatttctgacatttctgacatttctgacatttctgacatttccgactcggaccgatg

SEQ ID NO: 16976 - DNA, 203 bp, Homo sapiens
  source 1..203: mol_type = other DNA
ggcgcgccagtccttttagagacctctgacatttctgacatttctgacatttctgacatttctgacatttctgacatttctgacatttcttcgcaaactgacatttcttcgcaaactgacatttcttcgcaaactgacatttcttcgcaaactgacatttcttcgcaaactgacatttctgacatttccgactcggaccgatg

SEQ ID NO: 16977 - DNA, 203 bp, Homo sapiens
  source 1..203: mol_type = other DNA
ggcgcgccagtccttgaacatacctctgacatttctgacatttctgacatttctgacatttctgacatttctgacatttctgacatttcttgaaaaactgacatttcttgaaaaactgacatttcttgaaaaactgacatttcttgaaaaactgacatttcttgaaaaactgacatttctgacatttccgactcggaccgatg

SEQ ID NO: 16978 - DNA, 203 bp, Homo sapiens
  source 1..203: mol_type = other DNA
ggcgcgccagtcctgatacttacctctgacatttctgacatttctgacatttctgacatttctgacatttctgacatttctgacatttcttgagaaactgacatttcttgagaaactgacatttcttgagaaactgacatttcttgagaaactgacatttcttgagaaactgacatttctgacatttccgactcggaccgatg

SEQ ID NO: 16979 - DNA, 203 bp, Homo sapiens
  source 1..203: mol_type = other DNA
ggcgcgccagtccttactgtaacctctgacatttctgacatttctgacatttctgacatttctgacatttctgacatttctgacatttcttgcaaaactgacatttcttgcaaaactgacatttcttgcaaaactgacatttcttgcaaaactgacatttcttgcaaaactgacatttctgacatttccgactcggaccgatg

SEQ ID NO: 16980 - DNA, 203 bp, Homo sapiens
  source 1..203: mol_type = other DNA
ggcgcgccagtcctaaacagatcctctgacatttctgacatttctgacatttctgacatttctgacatttctgacatttctgacatttcttggcaaactgacatttctgacatttctgacatttctgacatttctgacatttctgacatttctgacatttctgacatttctgaccacggaatcgagaacgactcggaccgatg

SEQ ID NO: 16981 - DNA, 203 bp, Homo sapiens
  source 1..203: mol_type = other DNA
ggcgcgccagtcctggtaacgaattctgacatttctgacatttctgacatttctgacatttctgacatttctgacatttctgacatttcttggcaaactgacatttctgacatttctgacatttcttggcaaactgacatttctgacatttctgacatttctgacatttctgacatttctgacatttccgactcggaccgatg

SEQ ID NO: 16982 - DNA, 203 bp, Homo sapiens
  source 1..203: mol_type = other DNA
ggcgcgccagtcctggtaagaatctctgacatttctgacatttctgacatttctgacatttctgacatttctgacatttctgacatttcttggcaaactgacatttctgacatttctgacatttcttggcaaactgacatttcttggcaaactgacatttcttggcaaactgacatttctgacatttccgactcggaccgatg

SEQ ID NO: 16983 - DNA, 203 bp, Homo sapiens
  source 1..203: mol_type = other DNA
ggcgcgccagtcctggttcatgtatctgacatttctgacatttctgacatttctgacatttctgacatttctgacatttctgacatttcttggcaaactgacatttcttggcaaactgacatttctgacatttctgacatttctgacatttctgacatttctgacatttctgacatttctgacatttccgactcggaccgatg

SEQ ID NO: 16984 - DNA, 203 bp, Homo sapiens
  source 1..203: mol_type = other DNA
ggcgcgccagtcctatgtgatctatctgacatttctgacatttctgacatttctgacatttctgacatttctgacatttctgacatttcttggcaaactgacatttcttggcaaactgacatttcttggcaaactgacatttcttggcaaactgacatttcttggcaaactgacatttcttggcaaaccgactcggaccgatg

SEQ ID NO: 16985 - DNA, 203 bp, Homo sapiens
  source 1..203: mol_type = other DNA
ggcgcgccagtcctggcttcaccctctgacatttctgacatttctgacatttctgacatttctgacatttctgacatttctgacatttcttggcaacctgacatttcttggcaacctgacatttcttggcaacctgacatttcttggcaacctgacatttcttggcaacctgacatttctgacatttccgactcggaccgatg

SEQ ID NO: 16986 - DNA, 203 bp, Homo sapiens
  source 1..203: mol_type = other DNA
ggcgcgccagtcctgttcacccactctgacatttctgacatttctgacatttctgacatttctgacatttctgacatttctgacatttcttggcaagctgacatttcttggcaagctgacatttcttggcaagctgacatttcttggcaagctgacatttcttggcaagctgacatttctgacatttccgactcggaccgatg

SEQ ID NO: 16987 - DNA, 203 bp, Homo sapiens
  source 1..203: mol_type = other DNA
ggcgcgccagtcctagagttaacgtctgacatttctgacatttctgacatttctgacatttctgacatttctgacatttctgacatttcttggcaatctgacatttcttggcaatctgacatttcttggcaatctgacatttcttggcaatctgacatttcttggcaatctgacatttctgacatttccgactcggaccgatg

SEQ ID NO: 16988 - DNA, 203 bp, Homo sapiens
  source 1..203: mol_type = other DNA
ggcgcgccagtcctgaaacctagatctgacatttctgacatttctgacatttctgacatttctgacatttctgacatttctgacatttcttggcacactgacatttcttggcacactgacatttcttggcacactgacatttcttggcacactgacatttcttggcacactgacatttctgacatttccgactcggaccgatg

SEQ ID NO: 16989 - DNA, 203 bp, Homo sapiens
  source 1..203: mol_type = other DNA
ggcgcgccagtcctaacctagcagtctgacatttctgacatttctgacatttctgacatttctgacatttctgacatttctgacatttcttggcaccctgacatttcttggcaccctgacatttcttggcaccctgacatttcttggcaccctgacatttcttggcaccctgacatttctgacatttccgactcggaccgatg

SEQ ID NO: 16990 - DNA, 203 bp, Homo sapiens
  source 1..203: mol_type = other DNA
ggcgcgccagtcctagcaacctagtctgacatttctgacatttctgacatttctgacatttctgacatttctgacatttctgacatttcttggcactctgacatttcttggcactctgacatttcttggcactctgacatttcttggcactctgacatttcttggcactctgacatttctgacatttccgactcggaccgatg

SEQ ID NO: 16991 - DNA, 203 bp, Homo sapiens
  source 1..203: mol_type = other DNA
ggcgcgccagtccttaaccgagcctctgacatttctgacatttctgacatttctgacatttctgacatttctgacatttctgacatttcttggcagactgacatttcttggcagactgacatttcttggcagactgacatttcttggcagactgacatttcttggcagactgacatttctgacatttccgactcggaccgatg

SEQ ID NO: 16992 - DNA, 203 bp, Homo sapiens
  source 1..203: mol_type = other DNA
ggcgcgccagtcctcgcaagttgctctgacatttctgacatttctgacatttctgacatttctgacatttctgacatttctgacatttcttggcaggctgacatttcttggcaggctgacatttcttggcaggctgacatttcttggcaggctgacatttcttggcaggctgacatttctgacatttccgactcggaccgatg

SEQ ID NO: 16993 - DNA, 203 bp, Homo sapiens
  source 1..203: mol_type = other DNA
ggcgcgccagtcctgcaacttgcgtctgacatttctgacatttctgacatttctgacatttctgacatttctgacatttctgacatttcttggcagtctgacatttcttggcagtctgacatttcttggcagtctgacatttcttggcagtctgacatttcttggcagtctgacatttctgacatttccgactcggaccgatg

SEQ ID NO: 16994 - DNA, 203 bp, Homo sapiens
  source 1..203: mol_type = other DNA
ggcgcgccagtcctagcaggacgttctgacatttctgacatttctgacatttctgacatttctgacatttctgacatttctgacatttcttggcatgctgacatttcttggcatgctgacatttcttggcatgctgacatttcttggcatgctgacatttcttggcatgctgacatttctgacatttccgactcggaccgatg

SEQ ID NO: 16995 - DNA, 203 bp, Homo sapiens
  source 1..203: mol_type = other DNA
ggcgcgccagtcctgacgtccaactctgacatttctgacatttctgacatttctgacatttctgacatttctgacatttctgacatttcttggccaactgacatttcttggccaactgacatttcttggccaactgacatttcttggccaactgacatttcttggccaactgacatttctgacatttccgactcggaccgatg

SEQ ID NO: 16996 - DNA, 203 bp, Homo sapiens
  source 1..203: mol_type = other DNA
ggcgcgccagtcctcgacgtcctgtctgacatttctgacatttctgacatttctgacatttctgacatttctgacatttctgacatttcttggcccactgacatttcttggcccactgacatttcttggcccactgacatttcttggcccactgacatttcttggcccactgacatttctgacatttccgactcggaccgatg

SEQ ID NO: 16997 - DNA, 203 bp, Homo sapiens
  source 1..203: mol_type = other DNA
ggcgcgccagtcctaagacgtccttctgacatttctgacatttctgacatttctgacatttctgacatttctgacatttctgacatttcttggccgactgacatttcttggccgactgacatttcttggccgactgacatttcttggccgactgacatttcttggccgactgacatttctgacatttccgactcggaccgatg

SEQ ID NO: 16998 - DNA, 203 bp, Homo sapiens
  source 1..203: mol_type = other DNA
ggcgcgccagtcctgaggacgtcttctgacatttctgacatttctgacatttctgacatttctgacatttctgacatttctgacatttcttggcgaactgacatttcttggcgaactgacatttcttggcgaactgacatttcttggcgaactgacatttcttggcgaactgacatttctgacatttccgactcggaccgatg

SEQ ID NO: 16999 - DNA, 203 bp, Homo sapiens
  source 1..203: mol_type = other DNA
ggcgcgccagtcctggacgtttcgtctgacatttctgacatttctgacatttctgacatttctgacatttctgacatttctgacatttcttggcgcactgacatttcttggcgcactgacatttcttggcgcactgacatttcttggcgcactgacatttcttggcgcactgacatttctgacatttccgactcggaccgatg

SEQ ID NO: 17000 - DNA, 203 bp, Homo sapiens
  source 1..203: mol_type = other DNA
ggcgcgccagtcctggtagtaggctctgacatttctgacatttctgacatttctgacatttctgacatttctgacatttctgacatttcttggctcactgacatttcttggctcactgacatttcttggctcactgacatttcttggctcactgacatttcttggctcactgacatttctgacatttccgactcggaccgatg

SEQ ID NO: 17001 - DNA, 203 bp, Homo sapiens
  source 1..203: mol_type = other DNA
ggcgcgccagtccttggattcacgtctgacatttctgacatttctgacatttctgacatttctgacatttctgacatttctgacatttcttgggaaactgacatttcttgggaaactgacatttcttgggaaactgacatttcttgggaaactgacatttcttgggaaactgacatttctgacatttccgactcggaccgatg

SEQ ID NO: 17002 - DNA, 203 bp, Homo sapiens
  source 1..203: mol_type = other DNA
ggcgcgccagtcctcgtgaatacgtctgacatttctgacatttctgacatttctgacatttctgacatttctgacatttctgacatttcttgtgaaactgacatttcttgtgaaactgacatttcttgtgaaactgacatttcttgtgaaactgacatttcttgtgaaactgacatttctgacatttccgactcggaccgatg

SEQ ID NO: 17003 - DNA, 203 bp, Homo sapiens
  source 1..203: mol_type = other DNA
ggcgcgccagtcctgtgcgaatactctgacatttctgacatttctgacatttctgacatttctgacatttctgacatttctgacatttggcgggtttctgacatttggcgggtttctgacatttggcgggtttctgacatttggcgggtttctgacatttggcgggtttctgacatttctgacatttccgactcggaccgatg

SEQ ID NO: 17004 - DNA, 203 bp, Homo sapiens
  source 1..203: mol_type = other DNA
ggcgcgccagtcctagcgaatgtctctgacatttctgacatttctgacatttctgacatttctgacatttctgacatttctgacattttactcccttctgacatttctgacatttctgacatttctgacatttctgacatttctgacatttctgacatttctgacatttctgacatttcccggcgggtcgactcggaccgatg

SEQ ID NO: 17005 - DNA, 203 bp, Homo sapiens
  source 1..203: mol_type = other DNA
ggcgcgccagtcctaggctgcgaatctgacatttctgacatttctgacatttctgacatttctgacatttctgacatttctgacattttatggcaaactgacattttatggcaaactgacattttatggcaaactgacattttatggcaaactgacattttatggcaaactgacatttctgacatttccgactcggaccgatg

SEQ ID NO: 17006 - DNA, 203 bp, Homo sapiens
  source 1..203: mol_type = other DNA
ggcgcgccagtccttctgcgaagctctgacatttctgacatttctgacatttctgacatttctgacatttctgacatttctgacattttgccaagaactgacattttgccaagaactgacattttgccaagaactgacattttgccaagaactgacattttgccaagaactgacatttctgacatttccgactcggaccgatg

SEQ ID NO: 17007 - DNA, 203 bp, Homo sapiens
  source 1..203: mol_type = other DNA
ggcgcgccagtccttgcttgcgaatctgacatttctgacatttctgacatttctgacatttctgacatttctgacatttctgacccggcgggtatttctgacatttctgacatttctgacatttctgacatttctgacatttctgacatttctgacatttctgacatttctgacattttcttggcaaacgactcggaccgatg

SEQ ID NO: 17008 - DNA, 203 bp, Homo sapiens
  source 1..203: mol_type = other DNA
ggcgcgccagtcctactgcgaaaatctgacatttctgacatttctgacatttctgacatttctgacatttctgacatttctgacctccactcctggtggtgcccttccgtcaattcctttaagtttcagctttgcaaccatactgacatttctgacatttctgacatttctgacatttctgacatttccgactcggaccgatg

SEQ ID NO: 17009 - DNA, 203 bp, Homo sapiens
  source 1..203: mol_type = other DNA
ggcgcgccagtccttggcgaagtctctgacatttctgacatttctgacatttctgacatttctgacatttctgacatttctgacgtcaattcctttactgacatttctgacatttctgacatttctgacatttctgacatttctgacatttctgacatttctgacatttctgacatttctgacatttccgactcggaccgatg

SEQ ID NO: 17010 - DNA, 203 bp, Homo sapiens
  source 1..203: mol_type = other DNA
ggcgcgccagtcctaagcgaaaattctgacatttctgacatttctgacatttctgacatttctgacatttctgacatttctgacgtcaattcctttactgacatttctgacatttctgacatttctgacatttctgacatttctgacatttctgacatttctgacatttctgaccgtcaattcctttacgactcggaccgatg

SEQ ID NO: 17011 - DNA, 203 bp, Homo sapiens
  source 1..203: mol_type = other DNA
ggcgcgccagtcctggttcgctcttctgacatttctgacatttctgacatttctgacatttctgacatttctgacatttctgacttcctttaagtttcagctttgcaaccatactccccccggaacccaaagactttggtttccgacatttctgacatttctgacatttctgacatttctgacatttccgactcggaccgatg

SEQ ID NO: 17012 - DNA, 203 bp, Homo sapiens
  source 1..203: mol_type = other DNA
ggcgcgccagtcctaagttcgcagtctgacatttctgacatttctgacatttctgacatttctgacatttctgacatttctgacttcttggcaaattctgacatttctgacatttctgacatttctgacatttctgacatttctgacatttctgacatttctgacatttctgacatttcaccggccgtcgactcggaccgatg

SEQ ID NO: 17013 - DNA, 203 bp, Homo sapiens
  source 1..203: mol_type = other DNA
ggcgcgccagtcctacgctttcgctctgacatttctgacatttctgacatttctgacatttctgacatttctgacatttctgatactcccgacatttctgacatttctgacatttctgacatttctgacatttctgacatttctgacatttctgacatttctgacatttctgacatttctgtactccccgactcggaccgatg

SEQ ID NO: 17014 - DNA, 203 bp, Homo sapiens
  source 1..203: mol_type = other DNA
ggcgcgccagtcctaggattcgcttctgacatttctgacatttctgacatttctgacatttctgacatttctgacatttctggactttcgttcttgattaatgaaaacattcttggcaaatgctttcgctctggtccgtcttgcgccatttctgacatttctgacatttctgacatttctgacatttccgactcggaccgatg

SEQ ID NO: 17015 - DNA, 203 bp, Homo sapiens
  source 1..203: mol_type = other DNA
ggcgcgccagtcctctgcttcgcctctgacatttctgacatttctgacatttctgacatttctgacatttctgacatttctgggctccactcctggtggtgcccttccgtcaattcctttaagtttcagctttgcaaccatactcccatttctgacatttctgacatttctgacatttctgacatttccgactcggaccgatg

SEQ ID NO: 17016 - DNA, 203 bp, Homo sapiens
  source 1..203: mol_type = other DNA
ggcgcgccagtcctatttcgctcgtctgacatttctgacatttctgacatttctgacatttctgacatttctgacatttcttactcccctgacatttctgacatttctgacatttctgacatttctgacatttctgacatttctgacatttctgacatttctgacatttctgacatttcaccggccgtcgactcggaccgatg

SEQ ID NO: 17017 - DNA, 203 bp, Homo sapiens
  source 1..203: mol_type = other DNA
ggcgcgccagtcctctctttcgcatctgacatttctgacatttctgacatttctgacatttctgacatttctgacatttcttggcaaactgacatttctgacatttctgacatttctgacatttctgacatttctgacatttctgacatttctgacatttctgacatttctgacatttcaccggccgtcgactcggaccgatg

SEQ ID NO: 17018 - DNA, 203 bp, Homo sapiens
  source 1..203: mol_type = other DNA
ggcgcgccagtcctggtcattcgctctgacatttctgacatttctgacatttctgacatttctgacatttctgacatttcttggcaaactgacatttctgacatttctgacatttctgacatttctgacatttctgacatttctgacatttctgacatttctgacatttctgacatttcccggcgggtcgactcggaccgatg

SEQ ID NO: 17019 - DNA, 203 bp, Homo sapiens
  source 1..203: mol_type = other DNA
ggcgcgccagtcctggatttcgcttctgacatttctgacatttctgacatttctgacatttctgacatttctgacattttactcccttctgacatttctgacatttctgacatttctgacatttctgacatttctgacatttctgacatttctgacatttctgacatttctgacattttcttggcaaacgactcggaccgatg

SEQ ID NO: 17020 - DNA, 203 bp, Homo sapiens
  source 1..203: mol_type = other DNA
ggcgcgccagtcctcttcgctagttctgacatttctgacatttctgacatttctgacatttctgacatttctgacattttccgactttcgttcttgattaatgaaaacattcttggcaaatgctttcgctctggtccgtcttgcgccggttctgacatttctgacatttctgacatttctgacatttccgactcggaccgatg

SEQ ID NO: 17021 - DNA, 203 bp, Homo sapiens
  source 1..203: mol_type = other DNA
ggcgcgccagtcctaatgcaagtgtctgacatttctgacatttctgacatttctgacatttctgacatttctgacatttttcttggcaaagacatttctgacatttctgacatttctgacatttctgacatttctgacatttctgacatttctgacatttctgacatttctgacatttctgtactccccgactcggaccgatg

SEQ ID NO: 17022 - DNA, 203 bp, Homo sapiens
  source 1..203: mol_type = other DNA
ggcgcgccagtcctttgtcatgggtctgacatttctgacatttctgacatttctgacatttctgacatttctgacatttttcttggcaaagacatttctgacatttctgacatttctgacatttctgacatttctgacatttctgacatttctgacatttctgacatttctgaccgtcaattcctttacgactcggaccgatg

SEQ ID NO: 17023 - DNA, 203 bp, Homo sapiens
  source 1..203: mol_type = other DNA
ggcgcgccagtcctgtgacgttcttctgacatttctgacatttctgacatttctgacatttctgacatttctgacccggaacccaaagactttggtttcccggaagctgcccggcgggtcatgggaataacgccgccgcatcgccggtcggcagacatttctgacatttctgacatttctgacatttccgactcggaccgatg

SEQ ID NO: 17024 - DNA, 203 bp, Homo sapiens
  source 1..203: mol_type = other DNA
ggcgcgccagtcctgagcgtaagctctgacatttctgacatttctgacatttctgacatttctgacatttctgaccggcgggtcatttctgacatttctgacatttctgacatttctgacatttctgacatttctgacatttctgacatttctgacatttctgacatttctgacatttctgtactccccgactcggaccgatg

SEQ ID NO: 17025 - DNA, 203 bp, Homo sapiens
  source 1..203: mol_type = other DNA
ggcgcgccagtcctgctttacgcctctgacatttctgacatttctgacatttctgacatttctgacatttctgaccggcgggtcatttctgacatttctgacatttctgacatttctgacatttctgacatttctgacatttctgacatttctgacatttctgacatttctgaccgtcaattcctttacgactcggaccgatg

SEQ ID NO: 17026 - DNA, 203 bp, Homo sapiens
  source 1..203: mol_type = other DNA
ggcgcgccagtcctcttacgctcttctgacatttctgacatttctgacatttctgacatttctgacatttctgacgtcaattcctttactgacatttctgacatttctgacatttctgacatttctgacatttctgacatttctgacatttctgacatttctgacatttctgacatttcaccggccgtcgactcggaccgatg

SEQ ID NO: 17027 - DNA, 203 bp, Homo sapiens
  source 1..203: mol_type = other DNA
ggcgcgccagtccttcttacgccatctgacatttctgacatttctgacatttctgacatttctgacatttctgacgtcaattcctttactgacatttctgacatttctgacatttctgacatttctgacatttctgacatttctgacatttctgacatttctgacatttctgacatttcccggcgggtcgactcggaccgatg

SEQ ID NO: 17028 - DNA, 203 bp, Homo sapiens
  source 1..203: mol_type = other DNA
ggcgcgccagtcctcccgaaatggtctgacatttctgacatttctgacatttctgacatttctgacatttctgacttccgtcaattcctttaagtttcagctttgcaaccatactccccccggaacccaaagactttggtttcccggaagctgcacatttctgacatttctgacatttctgacatttccgactcggaccgatg

SEQ ID NO: 17029 - DNA, 203 bp, Homo sapiens
  source 1..203: mol_type = other DNA
ggcgcgccagtcctagaattcgggtctgacatttctgacatttctgacatttctgacatttctgacatttctgacttccgtcaattcctttaagtttcagctttgcaaccatactccccccggaacccaaagactttggtttcccggaagctggacatttctgacatttctgacatttctgacatttccgactcggaccgatg

SEQ ID NO: 17030 - DNA, 203 bp, Homo sapiens
  source 1..203: mol_type = other DNA
ggcgcgccagtcctaatgacatgatctgacatttctgacatttctgacatttctgacatttctgacatttctgatactcccgacatttctgacatttctgacatttctgacatttctgacatttctgacatttctgacatttctgacatttctgacatttctgacatttctgacatttcccggcgggtcgactcggaccgatg

SEQ ID NO: 17031 - DNA, 203 bp, Homo sapiens
  source 1..203: mol_type = other DNA
ggcgcgccagtccttgctgtgttctctgacatttctgacatttctgacatttctgacatttctgacatttctgatccaccaactaagaacggccatgcaccaccacccacggaatcgagaaagagctatcaatctgtcaatcctgtccgtgtccacatttctgacatttctgacatttctgacatttccgactcggaccgatg

SEQ ID NO: 17032 - DNA, 203 bp, Homo sapiens
  source 1..203: mol_type = other DNA
ggcgcgccagtcctctcgtgttggtctgacatttctgacatttctgacatttctgacatttctgacatttctgcgaacctccgactttcgttcttgattaatgaaaacattcttggcaaatgctttcgctctggtccgtcttgcgccggtccaagcatttctgacatttctgacatttctgacatttccgactcggaccgatg

SEQ ID NO: 17033 - DNA, 203 bp, Homo sapiens
  source 1..203: mol_type = other DNA
ggcgcgccagtcctaacacgatcgtctgacatttctgacatttctgacatttctgacatttctgacatttctgctccaccaactaagaacggccatgcaccaccacccacggaatcgagaaagagctatcaatctgtcaatcctgtccgtgtccggatttctgacatttctgacatttctgacatttccgactcggaccgatg

SEQ ID NO: 17034 - DNA, 203 bp, Homo sapiens
  source 1..203: mol_type = other DNA
ggcgcgccagtcctagacctaaggtctgacatttctgacatttctgacatttctgacatttctgacatttcttcgaacctccgactttcgttcttgattaatgaaaacattcttggcaaatgctttcgctctggtccgtcttgcgccggtccaagaatttctgacatttctgacatttctgacatttccgactcggaccgatg

SEQ ID NO: 17035 - DNA, 203 bp, Homo sapiens
  source 1..203: mol_type = other DNA
ggcgcgccagtccttggctgattttctgacatttctgacatttctgacatttctgacatttctgacatttcttggcaaactgacatttctgacatttctgacatttctgacatttctgacatttctgacatttctgacatttcttggcaaactgacatttctgacatttctgacatttctgacatttccgactcggaccgatg

SEQ ID NO: 17036 - DNA, 203 bp, Homo sapiens
  source 1..203: mol_type = other DNA
ggcgcgccagtccttggcagaccatctgacatttctgacatttctgacatttctgacatttctgacatttcttggcaaactgacatttctgacatttctgacatttctgacatttctgacatttcttggcaaactgacatttcttggcaaactgacatttcttggcaaactgacatttctgacatttccgactcggaccgatg

SEQ ID NO: 17037 - DNA, 203 bp, Homo sapiens
  source 1..203: mol_type = other DNA
ggcgcgccagtcctctttcagccttctgacatttctgacatttctgacatttctgacatttctgacatttcttggcaaactgacatttctgacatttctgacatttcttggcaaactgacatttctgacatttctgacatttctgacatttctgacatttcttggcaaactgacatttctgacatttccgactcggaccgatg

SEQ ID NO: 17038 - DNA, 203 bp, Homo sapiens
  source 1..203: mol_type = other DNA
ggcgcgccagtcctacctcagccatctgacatttctgacatttctgacatttctgacatttctgacatttcttggcaaactgacatttctgacatttctgacatttcttggcaaactgacatttctgacatttctgacatttcttggcaaactgacatttcttggcaaactgacatttctgacatttccgactcggaccgatg

SEQ ID NO: 17039 - DNA, 203 bp, Homo sapiens
  source 1..203: mol_type = other DNA
ggcgcgccagtcctgcactgcacctctgacatttctgacatttctgacatttctgacatttctgacatttcttggcaaactgacatttctgacatttctgacatttcttggcaaactgacatttcttggcaaactgacatttctgacatttctgacatttctgacatttctgacatttctgacatttccgactcggaccgatg

SEQ ID NO: 17040 - DNA, 203 bp, Homo sapiens
  source 1..203: mol_type = other DNA
ggcgcgccagtcctgtaagtcatgtctgacatttctgacatttctgacatttctgacatttctgacatttcttggcaaactgacatttctgacatttctgacatttcttggcaaactgacatttcttggcaaactgacatttctgacatttctgacatttcttggcaaactgacatttctgacatttccgactcggaccgatg

SEQ ID NO: 17041 - DNA, 203 bp, Homo sapiens
  source 1..203: mol_type = other DNA
ggcgcgccagtcctagaaccttgctctgacatttctgacatttctgacatttctgacatttctgacatttcttggcaaactgacatttctgacatttctgacatttcttggcaaactgacatttcttggcaaactgacatttcttggcaaactgacatttctgacatttctgacatttctgacatttccgactcggaccgatg

SEQ ID NO: 17042 - DNA, 203 bp, Homo sapiens
  source 1..203: mol_type = other DNA
ggcgcgccagtcctagaacctgtgtctgacatttctgacatttctgacatttctgacatttctgacatttcttggcaaactgacatttcttggcaaactgacatttctgacatttctgacatttctgacatttctgacatttctgacatttctgacatttctgacatttctgacatttctgacatttccgactcggaccgatg

SEQ ID NO: 17043 - DNA, 203 bp, Homo sapiens
  source 1..203: mol_type = other DNA
ggcgcgccagtcctgaccgaaacatctgacatttctgacatttctgacatttctgacatttctgacatttcttggcaaactgacatttcttggcaaactgacatttctgacatttctgacatttcttggcaaactgacatttcttggcaaactgacatttctgacatttctgacatttctgacatttccgactcggaccgatg

SEQ ID NO: 17044 - DNA, 203 bp, Homo sapiens
  source 1..203: mol_type = other DNA
ggcgcgccagtcctgttgatcctttctgacatttctgacatttctgacatttctgacatttctgacatttcttggcaaactgacatttcttggcaaactgacatttctgacatttctgacatttcttggcaaactgacatttcttggcaaactgacatttcttggcaaactgacatttctgacatttccgactcggaccgatg

SEQ ID NO: 17045 - DNA, 203 bp, Homo sapiens
  source 1..203: mol_type = other DNA
ggcgcgccagtcctaaccgtgtattctgacatttctgacatttctgacatttctgacatttctgacatttcttggcaaactgacatttcttggcaaactgacatttcttggcaaactgacatttctgacatttctgacatttcttggcaaactgacatttctgacatttctgacatttctgacatttccgactcggaccgatg

SEQ ID NO: 17046 - DNA, 203 bp, Homo sapiens
  source 1..203: mol_type = other DNA
ggcgcgccagtcctcgtgtacccatctgacatttctgacatttctgacatttctgacatttctgacatttcttggcaaactgacatttcttggcaaactgacatttcttggcaaactgacatttctgacatttctgacatttcttggcaaactgacatttcttggcaaactgacatttctgacatttccgactcggaccgatg

SEQ ID NO: 17047 - DNA, 203 bp, Homo sapiens
  source 1..203: mol_type = other DNA
ggcgcgccagtcctcgtgtatctgtctgacatttctgacatttctgacatttctgacatttctgacatttctttaagccgcaggctccactcctggtggtgcccttccgtcaattcctttaagtttcagctttgcaaccatactccccccggaaccatttctgacatttctgacatttctgacatttccgactcggaccgatg

SEQ ID NO: 17048 - DNA, 203 bp, Homo sapiens
  source 1..203: mol_type = other DNA
ggcgcgccagtcctgtcaacacgttctgacatttctgacatttctgacatttctgacatttctgacatttctttcttggcaaacatttctgacatttctgacatttctgacatttctgacatttctgacatttctgacatttctgacatttctgacatttctgacatttctgacatttctgtactccccgactcggaccgatg

SEQ ID NO: 17049 - DNA, 203 bp, Homo sapiens
  source 1..203: mol_type = other DNA
ggcgcgccagtcctagtgttgatctctgacatttctgacatttctgacatttctgacatttctgacatttctttcttggcaaacatttctgacatttctgacatttctgacatttctgacatttctgacatttctgacatttctgacatttctgacatttctgacatttctgaccgtcaattcctttacgactcggaccgatg

SEQ ID NO: 17050 - DNA, 203 bp, Homo sapiens
  source 1..203: mol_type = other DNA
ggcgcgccagtcctatgctgcttttctgacatttctgacatttctgacatttctgacatttctgacgtggtgcccttccgtcaattcctttaagtttcagctttgcaaccatactccccccggaacccaaagactttggtttcccggaagctgcccggcggggacatttctgacatttctgacatttccgactcggaccgatg

SEQ ID NO: 17051 - DNA, 203 bp, Homo sapiens
  source 1..203: mol_type = other DNA
ggcgcgccagtccttgagtgcatgtctgacatttctgacatttctgacatttctgacatttctgatactcccgacatttctgacatttctgacatttctgacatttctgacatttctgacatttctgacatttctgacatttctgacatttctgacatttctgacatttctgacattttcttggcaaacgactcggaccgatg

SEQ ID NO: 17052 - DNA, 203 bp, Homo sapiens
  source 1..203: mol_type = other DNA
ggcgcgccagtcctgctggacttttctgacatttctgacatttctgacatttctgacatttctgattcttggcaaatttctgacatttctgacatttctgacatttctgacatttctgacatttctgacatttctgacatttctgacatttctgacatttctgacatttctgaccgtcaattcctttacgactcggaccgatg

SEQ ID NO: 17053 - DNA, 203 bp, Homo sapiens
  source 1..203: mol_type = other DNA
ggcgcgccagtcctgggtcccaactctgacatttctgacatttctgacatttctgacatttctgcaaaggaaccataactgatttaatgagccattcgcagtttcactgtaccggccgtgcgtactcagacatgcatggcttaatctttgagacaagcatatgccatttctgacatttctgacatttccgactcggaccgatg

SEQ ID NO: 17054 - DNA, 203 bp, Homo sapiens
  source 1..203: mol_type = other DNA
ggcgcgccagtccttcccaaccgttctgacatttctgacatttctgacatttctgacatttctttcttggcaaacatttctgacatttctgacatttctgacatttctgacatttctgacatttctgacatttctgacatttctgacatttctgacatttctgacatttctgacatttcaccggccgtcgactcggaccgatg

SEQ ID NO: 17055 - DNA, 203 bp, Homo sapiens
  source 1..203: mol_type = other DNA
ggcgcgccagtccttcccaggacttctgacatttctgacatttctgacatttctgacatttctttcttggcaaacatttctgacatttctgacatttctgacatttctgacatttctgacatttctgacatttctgacatttctgacatttctgacatttctgacatttctgacatttcccggcgggtcgactcggaccgatg

SEQ ID NO: 17056 - DNA, 203 bp, Homo sapiens
  source 1..203: mol_type = other DNA
ggcgcgccagtcctcgtcccaacttctgacatttctgacatttctgacatttctgacatttgaccaaaggaaccataactgatttaatgagccattcgcagtttcactgtaccggccgtgcgtactcagacatgcatggcttaatctttgagacaagcatatgctacttctgacatttctgacatttccgactcggaccgatg

SEQ ID NO: 17057 - DNA, 203 bp, Homo sapiens
  source 1..203: mol_type = other DNA
ggcgcgccagtcctatcccaaggatctgacatttctgacatttctgacatttctgacattttcctggtggtgcccttccgtcaattcctttaagtttcagctttgcaaccatactccccccggaacccaaagactttggtttcccggaagctgcccggcgggtcatgttctgacatttctgacatttccgactcggaccgatg

SEQ ID NO: 17058 - DNA, 203 bp, Homo sapiens
  source 1..203: mol_type = other DNA
ggcgcgccagtcctttgggacctctctgacatttctgacatttctgacatttctgacgagcgaccaaaggaaccataactgatttaatgagccattcgcagtttcactgtaccggccgtgcgtactcagacatgcatggcttaatctttgagacaagcatatgctactggcgacatttctgacatttccgactcggaccgatg

SEQ ID NO: 17059 - DNA, 203 bp, Homo sapiens
  source 1..203: mol_type = other DNA
ggcgcgccagtcctacctgggatatctgacatttctgacatttctgacatttctgacggtatctgatcgtcttcgaacctccgactttcgttcttgattaatgaaaacattcttggcaaatgctttcgctctggtccgtcttgcgccggtccaagaatttcacctctagcggccatttctgacatttccgactcggaccgatg

SEQ ID NO: 17060 - DNA, 203 bp, Homo sapiens
  source 1..203: mol_type = other DNA
ggcgcgccagtcctctcatgggattctgacatttctgacatttctgacatttctgatccactcctggtggtgcccttccgtcaattcctttaagtttcagctttgcaaccatactccccccggaacccaaagactttggtttcccggaagctgcccggcgggtcatgggaatacatttctgacatttccgactcggaccgatg

SEQ ID NO: 17061 - DNA, 203 bp, Homo sapiens
  source 1..203: mol_type = other DNA
ggcgcgccagtcctgcaacgctgatctgacatttctgacatttctgacatttctgcgtcaattcctttatctgacatttctgacatttctgacatttctgacatttctgacatttctgacatttctgacatttctgacatttctgacatttctgacatttctgacatttctgaccacggaatcgagaacgactcggaccgatg

SEQ ID NO: 17062 - DNA, 203 bp, Homo sapiens
  source 1..203: mol_type = other DNA
ggcgcgccagtccttgtcgtgagctctgacatttctgacatttctgacatttctgctccactcctggtggtgcccttccgtcaattcctttaagtttcagctttgcaaccatactccccccggaacccaaagactttggtttcccggaagctgcccggcgggtcatgggaataaatttctgacatttccgactcggaccgatg

SEQ ID NO: 17063 - DNA, 203 bp, Homo sapiens
  source 1..203: mol_type = other DNA
ggcgcgccagtcctacacgacgaatctgacatttctgacatttctgacatttctgtactccctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17064 - DNA, 203 bp, Homo sapiens
  source 1..203: mol_type = other DNA
ggcgcgccagtccttgcggttgcatctgacatttctgacatttctgacatttcttggcaaactgacatttctgacatttctgacatttctgacatttctgacatttcttggcaaactgacatttctgacatttctgacatttcttggcaaactgacatttcttggcaaactgacatttctgacatttccgactcggaccgatg

SEQ ID NO: 17065 - DNA, 203 bp, Homo sapiens
  source 1..203: mol_type = other DNA
ggcgcgccagtcctgcggttaggttctgacatttctgacatttctgacatttcttggcaaactgacatttctgacatttctgacatttctgacatttctgacatttcttggcaaactgacatttcttggcaaactgacatttctgacatttctgacatttctgacatttctgacatttctgacatttccgactcggaccgatg

SEQ ID NO: 17066 - DNA, 203 bp, Homo sapiens
  source 1..203: mol_type = other DNA
ggcgcgccagtcctgcggtttgcctctgacatttctgacatttctgacatttcttggcaaactgacatttctgacatttctgacatttctgacatttctgacatttcttggcaaactgacatttcttggcaaactgacatttcttggcaaactgacatttctgacatttctgacatttctgacatttccgactcggaccgatg

SEQ ID NO: 17067 - DNA, 203 bp, Homo sapiens
  source 1..203: mol_type = other DNA
ggcgcgccagtcctagttagcggttctgacatttctgacatttctgacatttcttggcaaactgacatttctgacatttctgacatttcttggcaaactgacatttctgacatttctgacatttcttggcaaactgacatttctgacatttctgacatttctgacatttctgacatttctgacatttccgactcggaccgatg

SEQ ID NO: 17068 - DNA, 203 bp, Homo sapiens
  source 1..203: mol_type = other DNA
ggcgcgccagtccttgagcggtattctgacatttctgacatttctgacatttcttggcaaactgacatttctgacatttctgacatttcttggcaaactgacatttctgacatttctgacatttcttggcaaactgacatttctgacatttctgacatttcttggcaaactgacatttctgacatttccgactcggaccgatg

SEQ ID NO: 17069 - DNA, 203 bp, Homo sapiens
  source 1..203: mol_type = other DNA
ggcgcgccagtcctctagcggtgctctgacatttctgacatttctgacatttcttggcaaactgacatttctgacatttctgacatttcttggcaaactgacatttctgacatttctgacatttcttggcaaactgacatttcttggcaaactgacatttctgacatttctgacatttctgacatttccgactcggaccgatg

SEQ ID NO: 17070 - DNA, 203 bp, Homo sapiens
  source 1..203: mol_type = other DNA
ggcgcgccagtcctcagcggtgattctgacatttctgacatttctgacatttcttggcaaactgacatttctgacatttctgacatttcttggcaaactgacatttctgacatttctgacatttcttggcaaactgacatttcttggcaaactgacatttcttggcaaactgacatttctgacatttccgactcggaccgatg

SEQ ID NO: 17071 - DNA, 203 bp, Homo sapiens
  source 1..203: mol_type = other DNA
ggcgcgccagtcctctgagcggtctctgacatttctgacatttctgacatttcttggcaaactgacatttctgacatttctgacatttcttggcaaactgacatttcttggcaaactgacatttctgacatttctgacatttctgacatttctgacatttcttggcaaactgacatttctgacatttccgactcggaccgatg

SEQ ID NO: 17072 - DNA, 203 bp, Homo sapiens
  source 1..203: mol_type = other DNA
ggcgcgccagtcctaagcggtacttctgacatttctgacatttctgacatttcttggcaaactgacatttctgacatttctgacatttcttggcaaactgacatttcttggcaaactgacatttctgacatttctgacatttcttggcaaactgacatttctgacatttctgacatttctgacatttccgactcggaccgatg

SEQ ID NO: 17073 - DNA, 203 bp, Homo sapiens
  source 1..203: mol_type = other DNA
ggcgcgccagtccttagaccgcattctgacatttctgacatttctgacatttcttggcaaactgacatttctgacatttctgacatttcttggcaaactgacatttcttggcaaactgacatttcttggcaaactgacatttcttggcaaactgacatttcttggcaaactgacatttctgacatttccgactcggaccgatg

SEQ ID NO: 17074 - DNA, 203 bp, Homo sapiens
  source 1..203: mol_type = other DNA
ggcgcgccagtcctggcctaccgctctgacatttctgacatttctgacatttcttggcaaactgacatttcttggcaaactgacatttctgacatttctgacatttctgacatttctgacatttctgacatttctgacatttctgacatttctgacatttctgacatttctgacatttctgacatttccgactcggaccgatg

SEQ ID NO: 17075 - DNA, 203 bp, Homo sapiens
  source 1..203: mol_type = other DNA
ggcgcgccagtcctaccgcaagattctgacatttctgacatttctgacatttcttggcaaactgacatttcttggcaaactgacatttctgacatttctgacatttctgacatttctgacatttcttggcaaactgacatttctgacatttctgacatttctgacatttctgacatttctgacatttccgactcggaccgatg

SEQ ID NO: 17076 - DNA, 203 bp, Homo sapiens
  source 1..203: mol_type = other DNA
ggcgcgccagtccttgagaccgcgtctgacatttctgacatttctgacatttcttggcaaactgacatttcttggcaaactgacatttctgacatttctgacatttctgacatttctgacatttcttggcaaactgacatttcttggcaaactgacatttctgacatttctgacatttctgacatttccgactcggaccgatg

SEQ ID NO: 17077 - DNA, 203 bp, Homo sapiens
  source 1..203: mol_type = other DNA
ggcgcgccagtccttaccgcactgtctgacatttctgacatttctgacatttcttggcaaactgacatttcttggcaaactgacatttctgacatttctgacatttcttggcaaactgacatttctgacatttctgacatttctgacatttctgacatttctgacatttctgacatttctgacatttccgactcggaccgatg

SEQ ID NO: 17078 - DNA, 203 bp, Homo sapiens
  source 1..203: mol_type = other DNA
ggcgcgccagtcctatcaccgctgtctgacatttctgacatttctgacatttcttggcaaactgacatttcttggcaaactgacatttctgacatttctgacatttcttggcaaactgacatttcttggcaaactgacatttctgacatttctgacatttctgacatttctgacatttctgacatttccgactcggaccgatg

SEQ ID NO: 17079 - DNA, 203 bp, Homo sapiens
  source 1..203: mol_type = other DNA
ggcgcgccagtcctagtcaccgcgtctgacatttctgacatttctgacatttcttggcaaactgacatttcttggcaaactgacatttctgacatttctgacatttcttggcaaactgacatttcttggcaaactgacatttctgacatttctgacatttcttggcaaactgacatttctgacatttccgactcggaccgatg

SEQ ID NO: 17080 - DNA, 203 bp, Homo sapiens
  source 1..203: mol_type = other DNA
ggcgcgccagtcctcgaccgcttttctgacatttctgacatttctgacatttcttggcaaactgacatttcttggcaaactgacatttctgacatttctgacatttcttggcaaactgacatttcttggcaaactgacatttcttggcaaactgacatttcttggcaaactgacatttctgacatttccgactcggaccgatg

SEQ ID NO: 17081 - DNA, 203 bp, Homo sapiens
  source 1..203: mol_type = other DNA
ggcgcgccagtcctgtaccgcacatctgacatttctgacatttctgacatttcttggcaaactgacatttcttggcaaactgacatttcttggcaaactgacatttctgacatttctgacatttcttggcaaactgacatttctgacatttctgacatttcttggcaaactgacatttctgacatttccgactcggaccgatg

SEQ ID NO: 17082 - DNA, 203 bp, Homo sapiens
  source 1..203: mol_type = other DNA
ggcgcgccagtcctcgaataccgctctgacatttctgacatttctgacatttcttggcaaactgacatttcttggcaaactgacatttcttggcaaactgacatttctgacatttctgacatttcttggcaaactgacatttcttggcaaactgacatttctgacatttctgacatttctgacatttccgactcggaccgatg

SEQ ID NO: 17083 - DNA, 203 bp, Homo sapiens
  source 1..203: mol_type = other DNA
ggcgcgccagtcctcgcaccttactctgacatttctgacatttctgacatttcttggcaaactgacatttcttggcaaactgacatttcttggcaaactgacatttcttggcaaactgacatttctgacatttctgacatttctgacatttctgacatttcttggcaaactgacatttctgacatttccgactcggaccgatg

SEQ ID NO: 17084 - DNA, 203 bp, Homo sapiens
  source 1..203: mol_type = other DNA
ggcgcgccagtcctccagaatgactctgacatttctgacatttctgacatttcttggcaaactgacatttcttggcaaactgacatttcttggcaaactgacatttcttggcaaactgacatttcttggcaaactgacatttcttggcaaactgacatttcttggcaaactgacatttctgacatttccgactcggaccgatg

SEQ ID NO: 17085 - DNA, 203 bp, Homo sapiens
  source 1..203: mol_type = other DNA
ggcgcgccagtccttaaagtctactctgacatttctgacatttctgacattttcttggcaaatgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17086 - DNA, 203 bp, Homo sapiens
  source 1..203: mol_type = other DNA
ggcgcgccagtcctgtcaaagtcttctgacatttctgacatttctgacattttcttggcaaatgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 17087 - DNA, 203 bp, Homo sapiens
  source 1..203: mol_type = other DNA
ggcgcgccagtcctttaagacttctctgacatttctgacatttctgaccacggaatcgagaatgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 17088 - DNA, 203 bp, Homo sapiens
  source 1..203: mol_type = other DNA
ggcgcgccagtccttgtaagtctctctgacatttctgacatttctgaccggccgtacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17089 - DNA, 203 bp, Homo sapiens
  source 1..203: mol_type = other DNA
ggcgcgccagtcctaagtctttggtctgacatttctgacatttctgaccggccgtacatttctgacatttctgacatttctgacatttctgacatttctgacatttctgacatttctgacatttctgacatttctgacatttctgacatttctgacatttctgacatttctgaccgtcaattcctttacgactcggaccgatg

SEQ ID NO: 17090 - DNA, 203 bp, Homo sapiens
  source 1..203: mol_type = other DNA
ggcgcgccagtcctgtagcgtacttctgacatttctgacatttctgactactcccacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17091 - DNA, 203 bp, Homo sapiens
  source 1..203: mol_type = other DNA
ggcgcgccagtcctgttagcaatttctgacatttctgacatttctgaggagaggagcgagcgaccaaaggaaccataactgatttaatgagccattcgcagtttcactgtaccggccgtgcgtactcagacatgcatggcttaatctttgagacaagcatatgctactggcaggatcaaccacatttccgactcggaccgatg

SEQ ID NO: 17092 - DNA, 203 bp, Homo sapiens
  source 1..203: mol_type = other DNA
ggcgcgccagtccttattgaacagtctgacatttctgacatttctgattcttggcaaatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17093 - DNA, 203 bp, Homo sapiens
  source 1..203: mol_type = other DNA
ggcgcgccagtcctatgcaatgcatctgacatttctgacatttctgcacggaatcgagaatctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17094 - DNA, 203 bp, Homo sapiens
  source 1..203: mol_type = other DNA
ggcgcgccagtcctcaatcatttttctgacatttctgacatttctgccggcgggtacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 17095 - DNA, 203 bp, Homo sapiens
  source 1..203: mol_type = other DNA
ggcgcgccagtcctgcattgaacttctgacatttctgacatttctgccggcgggtacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17096 - DNA, 203 bp, Homo sapiens
  source 1..203: mol_type = other DNA
ggcgcgccagtcctattgaaagaatctgacatttctgacatttctgcgtcaattcctttatctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17097 - DNA, 203 bp, Homo sapiens
  source 1..203: mol_type = other DNA
ggcgcgccagtcctattgcggtggtctgacatttctgacatttctgcgttatcggaattaaccagacaaatcgctccaccaactaagaacggccatgcaccaccacccacggaatcgagaaagagctatcaatctgtcaatcctgtccgtgtccgggccgggtgaggtttcccgtgttgagtcatttccgactcggaccgatg

SEQ ID NO: 17098 - DNA, 203 bp, Homo sapiens
  source 1..203: mol_type = other DNA
ggcgcgccagtcctcattgctgcgtctgacatttctgacatttctgtactccctgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17099 - DNA, 203 bp, Homo sapiens
  source 1..203: mol_type = other DNA
ggcgcgccagtcctgctcattgactctgacatttctgacatttctgtactccctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17100 - DNA, 203 bp, Homo sapiens
  source 1..203: mol_type = other DNA
ggcgcgccagtccttgcaatgcactctgacatttctgacatttcttaggagaggagcgagcgaccaaaggaaccataactgatttaatgagccattcgcagtttcactgtaccggccgtgcgtactcagacatgcatggcttaatctttgagacaagcatatgctactggcaggatcaaccagatttccgactcggaccgatg

SEQ ID NO: 17101 - DNA, 203 bp, Homo sapiens
  source 1..203: mol_type = other DNA
ggcgcgccagtcctaaaaccattgtctgacatttctgacatttcttcttggcaaaacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17102 - DNA, 203 bp, Homo sapiens
  source 1..203: mol_type = other DNA
ggcgcgccagtcctatcagaattgtctgacatttctgaccacggaatcgagaatgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17103 - DNA, 203 bp, Homo sapiens
  source 1..203: mol_type = other DNA
ggcgcgccagtccttgcatgcaattctgacatttctgacccggcgggtatttctgacatttctgacatttctgacatttctgacatttctgacatttctgacatttctgacatttctgacatttctgacatttctgacatttctgacatttctgacatttctgacatttctgacatttctgtactccccgactcggaccgatg

SEQ ID NO: 17104 - DNA, 203 bp, Homo sapiens
  source 1..203: mol_type = other DNA
ggcgcgccagtcctggtcaattcgtctgacatttctgaccggccgtacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17105 - DNA, 203 bp, Homo sapiens
  source 1..203: mol_type = other DNA
ggcgcgccagtcctacaatctaagtctgacatttctgactactcccacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17106 - DNA, 203 bp, Homo sapiens
  source 1..203: mol_type = other DNA
ggcgcgccagtcctccacattgattctgacatttctgcacggaatcgagaatctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17107 - DNA, 203 bp, Homo sapiens
  source 1..203: mol_type = other DNA
ggcgcgccagtcctcttcaaattgtctgacatttctgccggcgggtacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17108 - DNA, 203 bp, Homo sapiens
  source 1..203: mol_type = other DNA
ggcgcgccagtcctgtcaattcagtctgacatttctgtactccctgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17109 - DNA, 203 bp, Homo sapiens
  source 1..203: mol_type = other DNA
ggcgcgccagtcctgagcaatcattctgacatttcttcttggcaaaacatttctgacatttctgacatttctgacatttctgacatttctgacatttctgacatttctgacatttctgacatttctgacatttctgacatttctgacatttctgacatttctgacatttctgacatttcaccggccgtcgactcggaccgatg

SEQ ID NO: 17110 - DNA, 203 bp, Homo sapiens
  source 1..203: mol_type = other DNA
ggcgcgccagtcctggctgcaatatctgacatttcttggcaaactgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17111 - DNA, 203 bp, Homo sapiens
  source 1..203: mol_type = other DNA
ggcgcgccagtccttcaatggtattctgacatttcttggcaaactgacatttctgacatttctgacatttctgacatttctgacatttctgacatttctgacatttctgacatttctgacatttcttggcaaactgacatttctgacatttctgacatttctgacatttctgacatttctgacatttccgactcggaccgatg

SEQ ID NO: 17112 - DNA, 203 bp, Homo sapiens
  source 1..203: mol_type = other DNA
ggcgcgccagtcctcaatactacctctgacatttcttggcaaactgacatttctgacatttctgacatttctgacatttctgacatttctgacatttctgacatttctgacatttctgacatttcttggcaaactgacatttcttggcaaactgacatttctgacatttctgacatttctgacatttccgactcggaccgatg

SEQ ID NO: 17113 - DNA, 203 bp, Homo sapiens
  source 1..203: mol_type = other DNA
ggcgcgccagtccttcgctcaatgtctgacatttcttggcaaactgacatttctgacatttctgacatttctgacatttctgacatttctgacatttctgacatttcttggcaaactgacatttcttggcaaactgacatttcttggcaaactgacatttcttggcaaactgacatttctgacatttccgactcggaccgatg

SEQ ID NO: 17114 - DNA, 203 bp, Homo sapiens
  source 1..203: mol_type = other DNA
ggcgcgccagtcctttcattgatttctgacatttcttggcaaactgacatttctgacatttctgacatttctgacatttctgacatttcttggcaaactgacatttctgacatttctgacatttctgacatttctgacatttctgacatttctgacatttctgacatttctgacatttctgacatttccgactcggaccgatg

SEQ ID NO: 17115 - DNA, 203 bp, Homo sapiens
  source 1..203: mol_type = other DNA
ggcgcgccagtcctactgtattgctctgacatttcttggcaaactgacatttctgacatttctgacatttctgacatttctgacatttcttggcaaactgacatttctgacatttctgacatttctgacatttctgacatttcttggcaaactgacatttctgacatttctgacatttctgacatttccgactcggaccgatg

SEQ ID NO: 17116 - DNA, 203 bp, Homo sapiens
  source 1..203: mol_type = other DNA
ggcgcgccagtcctaaattgagtatctgacatttcttggcaaactgacatttctgacatttctgacatttctgacatttctgacatttcttggcaaactgacatttctgacatttctgacatttcttggcaaactgacatttctgacatttctgacatttcttggcaaactgacatttctgacatttccgactcggaccgatg

SEQ ID NO: 17117 - DNA, 203 bp, Homo sapiens
  source 1..203: mol_type = other DNA
ggcgcgccagtcctattgcacttgtctgacatttcttggcaaactgacatttctgacatttctgacatttctgacatttctgacatttcttggcaaactgacatttcttggcaaactgacatttctgacatttctgacatttctgacatttctgacatttcttggcaaactgacatttctgacatttccgactcggaccgatg

SEQ ID NO: 17118 - DNA, 203 bp, Homo sapiens
  source 1..203: mol_type = other DNA
ggcgcgccagtcctcaatcttgattctgacatttcttggcaaactgacatttctgacatttctgacatttctgacatttctgacatttcttggcaaactgacatttcttggcaaactgacatttcttggcaaactgacatttctgacatttctgacatttcttggcaaactgacatttctgacatttccgactcggaccgatg

SEQ ID NO: 17119 - DNA, 203 bp, Homo sapiens
  source 1..203: mol_type = other DNA
ggcgcgccagtcctcgcaatactctctgacatttcttggcaaactgacatttctgacatttctgacatttctgacatttctgacatttcttggcaaactgacatttcttggcaaactgacatttcttggcaaactgacatttcttggcaaactgacatttctgacatttctgacatttctgacatttccgactcggaccgatg

SEQ ID NO: 17120 - DNA, 203 bp, Homo sapiens
  source 1..203: mol_type = other DNA
ggcgcgccagtccttcgtgattgctctgacatttcttggcaaactgacatttctgacatttctgacatttcttggcaaactgacatttctgacatttctgacatttctgacatttctgacatttctgacatttctgacatttctgacatttctgacatttcttggcaaactgacatttctgacatttccgactcggaccgatg

SEQ ID NO: 17121 - DNA, 203 bp, Homo sapiens
  source 1..203: mol_type = other DNA
ggcgcgccagtcctaaacttcaattctgacatttcttggcaaactgacatttctgacatttctgacatttcttggcaaactgacatttctgacatttctgacatttctgacatttctgacatttctgacatttctgacatttcttggcaaactgacatttcttggcaaactgacatttctgacatttccgactcggaccgatg

SEQ ID NO: 17122 - DNA, 203 bp, Homo sapiens
  source 1..203: mol_type = other DNA
ggcgcgccagtcctcaatggatcctctgacatttcttggcaaactgacatttctgacatttctgacatttcttggcaaactgacatttctgacatttctgacatttctgacatttctgacatttcttggcaaactgacatttctgacatttctgacatttctgacatttctgacatttctgacatttccgactcggaccgatg

SEQ ID NO: 17123 - DNA, 203 bp, Homo sapiens
  source 1..203: mol_type = other DNA
ggcgcgccagtcctgatcgattgttctgacatttcttggcaaactgacatttctgacatttctgacatttcttggcaaactgacatttctgacatttctgacatttcttggcaaactgacatttctgacatttctgacatttctgacatttctgacatttctgacatttctgacatttctgacatttccgactcggaccgatg

SEQ ID NO: 17124 - DNA, 203 bp, Homo sapiens
  source 1..203: mol_type = other DNA
ggcgcgccagtcctcgattgcaagtctgacatttcttggcaaactgacatttctgacatttctgacatttcttggcaaactgacatttctgacatttctgacatttcttggcaaactgacatttctgacatttctgacatttctgacatttctgacatttcttggcaaactgacatttctgacatttccgactcggaccgatg

SEQ ID NO: 17125 - DNA, 203 bp, Homo sapiens
  source 1..203: mol_type = other DNA
ggcgcgccagtcctacattgaggttctgacatttcttggcaaactgacatttctgacatttctgacatttcttggcaaactgacatttctgacatttctgacatttcttggcaaactgacatttctgacatttctgacatttcttggcaaactgacatttctgacatttctgacatttctgacatttccgactcggaccgatg

SEQ ID NO: 17126 - DNA, 203 bp, Homo sapiens
  source 1..203: mol_type = other DNA
ggcgcgccagtcctttacattgcttctgacatttcttggcaaactgacatttctgacatttctgacatttcttggcaaactgacatttctgacatttctgacatttcttggcaaactgacatttctgacatttctgacatttcttggcaaactgacatttcttggcaaactgacatttctgacatttccgactcggaccgatg

SEQ ID NO: 17127 - DNA, 203 bp, Homo sapiens
  source 1..203: mol_type = other DNA
ggcgcgccagtcctaattgagatatctgacatttcttggcaaactgacatttctgacatttctgacatttcttggcaaactgacatttcttggcaaactgacatttctgacatttctgacatttctgacatttctgacatttctgacatttctgacatttctgacatttctgacatttctgacatttccgactcggaccgatg

SEQ ID NO: 17128 - DNA, 203 bp, Homo sapiens
  source 1..203: mol_type = other DNA
ggcgcgccagtcctcttgcaatcatctgacatttcttggcaaactgacatttctgacatttctgacatttcttggcaaactgacatttcttggcaaactgacatttctgacatttctgacatttctgacatttctgacatttctgacatttctgacatttcttggcaaactgacatttctgacatttccgactcggaccgatg

SEQ ID NO: 17129 - DNA, 203 bp, Homo sapiens
  source 1..203: mol_type = other DNA
ggcgcgccagtcctattgacggtatctgacatttcttggcaaactgacatttctgacatttctgacatttcttggcaaactgacatttcttggcaaactgacatttcttggcaaactgacatttctgacatttctgacatttctgacatttctgacatttctgacatttctgacatttctgacatttccgactcggaccgatg

SEQ ID NO: 17130 - DNA, 203 bp, Homo sapiens
  source 1..203: mol_type = other DNA
ggcgcgccagtcctgtcaatcgactctgacatttcttggcaaactgacatttctgacatttctgacatttcttggcaaactgacatttcttggcaaactgacatttcttggcaaactgacatttcttggcaaactgacatttctgacatttctgacatttcttggcaaactgacatttctgacatttccgactcggaccgatg

SEQ ID NO: 17131 - DNA, 203 bp, Homo sapiens
  source 1..203: mol_type = other DNA
ggcgcgccagtcctggtattgccatctgacatttcttggcaaactgacatttctgacatttctgacatttcttggcaaactgacatttcttggcaaactgacatttcttggcaaactgacatttcttggcaaactgacatttcttggcaaactgacatttctgacatttctgacatttctgacatttccgactcggaccgatg

SEQ ID NO: 17132 - DNA, 203 bp, Homo sapiens
  source 1..203: mol_type = other DNA
ggcgcgccagtcctttacacattgtctgacatttcttggcaaactgacatttctgacatttctgacatttcttggcaaactgacatttcttggcaaactgacatttcttggcaaactgacatttcttggcaaactgacatttcttggcaaactgacatttcttggcaaactgacatttctgacatttccgactcggaccgatg

SEQ ID NO: 17133 - DNA, 203 bp, Homo sapiens
  source 1..203: mol_type = other DNA
ggcgcgccagtcctcaatacacgatctgacatttcttggcaaactgacatttcttggcaaactgacatttctgacatttctgacatttctgacatttctgacatttctgacatttctgacatttctgacatttctgacatttcttggcaaactgacatttctgacatttctgacatttctgacatttccgactcggaccgatg

SEQ ID NO: 17134 - DNA, 203 bp, Homo sapiens
  source 1..203: mol_type = other DNA
ggcgcgccagtcctgggtcaattctctgacatttcttggcaaactgacatttcttggcaaactgacatttctgacatttctgacatttctgacatttctgacatttctgacatttctgacatttcttggcaaactgacatttctgacatttctgacatttctgacatttctgacatttctgacatttccgactcggaccgatg

SEQ ID NO: 17135 - DNA, 203 bp, Homo sapiens
  source 1..203: mol_type = other DNA
ggcgcgccagtcctaacagcaatatctgacatttcttggcaaactgacatttcttggcaaactgacatttctgacatttctgacatttctgacatttctgacatttcttggcaaactgacatttcttggcaaactgacatttctgacatttctgacatttcttggcaaactgacatttctgacatttccgactcggaccgatg

SEQ ID NO: 17136 - DNA, 203 bp, Homo sapiens
  source 1..203: mol_type = other DNA
ggcgcgccagtcctgctcaattgctctgacatttcttggcaaactgacatttcttggcaaactgacatttctgacatttctgacatttctgacatttctgacatttcttggcaaactgacatttcttggcaaactgacatttcttggcaaactgacatttcttggcaaactgacatttctgacatttccgactcggaccgatg

SEQ ID NO: 17137 - DNA, 203 bp, Homo sapiens
  source 1..203: mol_type = other DNA
ggcgcgccagtcctgcaatctctttctgacatttcttggcaaactgacatttcttggcaaactgacatttctgacatttctgacatttcttggcaaactgacatttctgacatttctgacatttctgacatttctgacatttctgacatttctgacatttctgacatttctgacatttctgacatttccgactcggaccgatg

SEQ ID NO: 17138 - DNA, 203 bp, Homo sapiens
  source 1..203: mol_type = other DNA
ggcgcgccagtcctattgaccagttctgacatttcttggcaaactgacatttcttggcaaactgacatttctgacatttctgacatttcttggcaaactgacatttctgacatttctgacatttctgacatttctgacatttctgacatttctgacatttcttggcaaactgacatttctgacatttccgactcggaccgatg

SEQ ID NO: 17139 - DNA, 203 bp, Homo sapiens
  source 1..203: mol_type = other DNA
ggcgcgccagtcctcaatcgttgctctgacatttcttggcaaactgacatttcttggcaaactgacatttctgacatttctgacatttcttggcaaactgacatttctgacatttctgacatttctgacatttctgacatttcttggcaaactgacatttcttggcaaactgacatttctgacatttccgactcggaccgatg

SEQ ID NO: 17140 - DNA, 203 bp, Homo sapiens
  source 1..203: mol_type = other DNA
ggcgcgccagtcctctcattgaactctgacatttcttggcaaactgacatttcttggcaaactgacatttctgacatttctgacatttcttggcaaactgacatttctgacatttctgacatttcttggcaaactgacatttctgacatttctgacatttctgacatttctgacatttctgacatttccgactcggaccgatg

SEQ ID NO: 17141 - DNA, 203 bp, Homo sapiens
  source 1..203: mol_type = other DNA
ggcgcgccagtcctacaagattgatctgacatttcttggcaaactgacatttcttggcaaactgacatttctgacatttctgacatttcttggcaaactgacatttcttggcaaactgacatttcttggcaaactgacatttctgacatttctgacatttctgacatttctgacatttctgacatttccgactcggaccgatg

SEQ ID NO: 17142 - DNA, 203 bp, Homo sapiens
  source 1..203: mol_type = other DNA
ggcgcgccagtcctaacaatctgatctgacatttcttggcaaactgacatttcttggcaaactgacatttctgacatttctgacatttcttggcaaactgacatttcttggcaaactgacatttcttggcaaactgacatttcttggcaaactgacatttctgacatttctgacatttctgacatttccgactcggaccgatg

SEQ ID NO: 17143 - DNA, 203 bp, Homo sapiens
  source 1..203: mol_type = other DNA
ggcgcgccagtccttatgtcattgtctgacatttcttggcaaactgacatttcttggcaaactgacatttctgacatttctgacatttcttggcaaactgacatttcttggcaaactgacatttcttggcaaactgacatttcttggcaaactgacatttcttggcaaactgacatttctgacatttccgactcggaccgatg

SEQ ID NO: 17144 - DNA, 203 bp, Homo sapiens
  source 1..203: mol_type = other DNA
ggcgcgccagtcctttcgtaaccctctgacatttcttggcaaactgacatttcttggcaaactgacatttcttggcaaactgacatttctgacatttctgacatttcttggcaaactgacatttctgacatttctgacatttctgacatttctgacatttcttggcaaactgacatttctgacatttccgactcggaccgatg

SEQ ID NO: 17145 - DNA, 203 bp, Homo sapiens
  source 1..203: mol_type = other DNA
ggcgcgccagtcctgggtcgtaaatctgacatttcttggcaaactgacatttcttggcaaactgacatttcttggcaaactgacatttctgacatttctgacatttcttggcaaactgacatttcttggcaaactgacatttctgacatttctgacatttctgacatttctgacatttctgacatttccgactcggaccgatg

SEQ ID NO: 17146 - DNA, 203 bp, Homo sapiens
  source 1..203: mol_type = other DNA
ggcgcgccagtccttcttacgaagtctgacatttcttggcaaactgacatttcttggcaaactgacatttcttggcaaactgacatttctgacatttctgacatttcttggcaaactgacatttcttggcaaactgacatttctgacatttctgacatttcttggcaaactgacatttctgacatttccgactcggaccgatg

SEQ ID NO: 17147 - DNA, 203 bp, Homo sapiens
  source 1..203: mol_type = other DNA
ggcgcgccagtcctgttacgagcatctgacatttcttggcaaactgacatttcttggcaaactgacatttcttggcaaactgacatttctgacatttctgacatttcttggcaaactgacatttcttggcaaactgacatttcttggcaaactgacatttctgacatttctgacatttctgacatttccgactcggaccgatg

SEQ ID NO: 17148 - DNA, 203 bp, Homo sapiens
  source 1..203: mol_type = other DNA
ggcgcgccagtcctcactttacgatctgacatttcttggcaaactgacatttcttggcaaactgacatttcttggcaaactgacatttcttggcaaactgacatttctgacatttctgacatttcttggcaaactgacatttcttggcaaactgacatttctgacatttctgacatttctgacatttccgactcggaccgatg

SEQ ID NO: 17149 - DNA, 203 bp, Homo sapiens
  source 1..203: mol_type = other DNA
ggcgcgccagtcctcccatgcagatctgacatttcttggcaaactgacatttcttggcaaactgacatttcttggcaaactgacatttcttggcaaactgacatttcttggcaaactgacatttctgacatttctgacatttctgacatttctgacatttctgacatttctgacatttctgacatttccgactcggaccgatg

SEQ ID NO: 17150 - DNA, 203 bp, Homo sapiens
  source 1..203: mol_type = other DNA
ggcgcgccagtcctaagatcaaggtctgacatttcttggcaaactgacatttcttggcaaactgacatttcttggcaaactgacatttcttggcaaactgacatttcttggcaaactgacatttctgacatttctgacatttctgacatttctgacatttcttggcaaactgacatttctgacatttccgactcggaccgatg

SEQ ID NO: 17151 - DNA, 203 bp, Homo sapiens
  source 1..203: mol_type = other DNA
ggcgcgccagtcctaaatcgacgttctgacatttcttggcaaactgacatttcttggcaaactgacatttcttggcaaactgacatttcttggcaaactgacatttcttggcaaactgacatttctgacatttctgacatttcttggcaaactgacatttctgacatttctgacatttctgacatttccgactcggaccgatg

SEQ ID NO: 17152 - DNA, 203 bp, Homo sapiens
  source 1..203: mol_type = other DNA
ggcgcgccagtcctacgtcgactctctgacatttcttggcaaactgacatttcttggcaaactgacatttcttggcaaactgacatttcttggcaaactgacatttcttggcaaactgacatttcttggcaaactgacatttcttggcaaactgacatttctgacatttctgacatttctgacatttccgactcggaccgatg

SEQ ID NO: 17153 - DNA, 203 bp, Homo sapiens
  source 1..203: mol_type = other DNA
ggcgcgccagtccttcgtcgattttctgacatttcttggcaaactgacatttcttggcaaactgacatttcttggcaaactgacatttcttggcaaactgacatttcttggcaaactgacatttcttggcaaactgacatttcttggcaaactgacatttcttggcaaactgacatttcttggcaaaccgactcggaccgatg

SEQ ID NO: 17154 - DNA, 203 bp, Homo sapiens
  source 1..203: mol_type = other DNA
ggcgcgccagtcctactaccgccttctgacattttactcccttctgacatttctgacatttctgacatttctgacatttctgacatttctgacatttctgacatttctgacatttctgacatttctgacatttctgacatttctgacatttctgacatttctgacatttctgacatttctgacatttccgactcggaccgatg

SEQ ID NO: 17155 - DNA, 203 bp, Homo sapiens
  source 1..203: mol_type = other DNA
ggcgcgccagtcctttgctttgattctgaccgtcaattcctttatgacatttctgacatttctgacatttctgacatttctgacatttctgacatttctgacatttctgacatttctgacatttctgacatttctgacatttctgacatttctgacatttctgacatttctgacattttcttggcaaacgactcggaccgatg

SEQ ID NO: 17156 - DNA, 203 bp, Homo sapiens
  source 1..203: mol_type = other DNA
ggcgcgccagtccttcatgtcgagtctgttcttggcaaaatttctgacatttctgacatttctgacatttctgacatttctgacatttctgacatttctgacatttctgacatttctgacatttctgacatttctgacatttctgacatttctgacatttctgacatttctgacatttcccggcgggtcgactcggaccgatg

SEQ ID NO: 17157 - DNA, 203 bp, Homo sapiens
  source 1..203: mol_type = other DNA
ggcgcgccagtcctctgtcgaccctcttactcccctgacatttctgacatttctgacatttctgacatttctgacatttctgacatttctgacatttctgacatttctgacatttctgacatttctgacatttctgacatttctgacatttctgacatttctgacatttctgaccacggaatcgagaacgactcggaccgatg

SEQ ID NO: 17158 - DNA, 203 bp, Homo sapiens
  source 1..203: mol_type = other DNA
ggcgcgccagtcctagtatgtcgatgtgtaaacacggaatcgagaattcacacggaatcgagaaggaacacggaatcgagaactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17159 - DNA, 203 bp, Homo sapiens
  source 1..203: mol_type = other DNA
ggcgcgccagtccttactcagccctgtgtaaagatgcagtgtaaggttcaagtgccaaatccctggaacacggaatcgagaactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17160 - DNA, 203 bp, Homo sapiens
  source 1..203: mol_type = other DNA
ggcgcgccagtcctacagcagccctgtgtaaagatgcagtgtaaggttcaagtgccaaatccctggaaccggcgggtctctactgcccggcgggtgctgtgcagccggcgggtacttcggttccggcgggtagcacaggcccggcgggtacgggtagtccggcgggtcatcctctcccggcgggtatccgactcggaccgatg

SEQ ID NO: 17161 - DNA, 203 bp, Homo sapiens
  source 1..203: mol_type = other DNA
ggcgcgccagtcctgtcgcagccctgtgtaaagatgcagtgtaaggttcaagtgccaaatccctggaaggagtgaccctctactgcaccggccgtgctgtgcagaccggccgtacttcggttaccggccgtagcacaggcaccggccgtacgggtagtaccggccgtcatcctctcaccggccgtatccgactcggaccgatg

SEQ ID NO: 17162 - DNA, 203 bp, Homo sapiens
  source 1..203: mol_type = other DNA
ggcgcgccagtcctgacaaggccctgtgtaaagatgcagtgtaaggttcaagtgccaaatccctggaaggagtgaccctctactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17163 - DNA, 203 bp, Homo sapiens
  source 1..203: mol_type = other DNA
ggcgcgccagtcctggttacgccctgtgtaaagatgcagtgtaaggttcaagtgccaaatccctggaaggagtgaccctctactgccctaggaatgctgtgcagaccggccgtacttcggttaccggccgtagcacaggcaccggccgtacgggtagtaccggccgtcatcctctcaccggccgtatccgactcggaccgatg

SEQ ID NO: 17164 - DNA, 203 bp, Homo sapiens
  source 1..203: mol_type = other DNA
ggcgcgccagtcctgggcctggtctgtgtaaagatgcagtgtaaggttcaagtgccaaatccctggaaggagtgaccctctactgccctaggaatgctgtgcaggtacccccaacttcggttcacggaatcgagaaaggccacggaatcgagaatagtcacggaatcgagaatctcttttttggcatccgactcggaccgatg

SEQ ID NO: 17165 - DNA, 203 bp, Homo sapiens
  source 1..203: mol_type = other DNA
ggcgcgccagtcctgggctcagcatgtgtaaagatgcagtgtaaggttcaagtgccaaatccctggaaggagtgaccctctactgccctaggaatgctgtgcaggtacccccaacttcggttccggcgggtagcacaggcccggcgggtacgggtagtccggcgggtcatcctctcccggcgggtatccgactcggaccgatg

SEQ ID NO: 17166 - DNA, 203 bp, Homo sapiens
  source 1..203: mol_type = other DNA
ggcgcgccagtcctgggctacgtctgtgtaaagatgcagtgtaaggttcaagtgccaaatccctggaaggagtgaccctctactgccctaggaatgctgtgcaggtacccccaacttcggttggggatctgagcacaggccacggaatcgagaatagtcacggaatcgagaatctcttttttggcatccgactcggaccgatg

SEQ ID NO: 17167 - DNA, 203 bp, Homo sapiens
  source 1..203: mol_type = other DNA
ggcgcgccagtcctgggctaggcttgtgtaaagatgcagtgtaaggttcaagtgccaaatccctggaaggagtgaccctctactgccctaggaatgctgtgcaggtacccccaacttcggttggggatctgagcacaggccgtcaattcctttatagtcgtcaattcctttatctcttttttggcatccgactcggaccgatg

SEQ ID NO: 17168 - DNA, 203 bp, Homo sapiens
  source 1..203: mol_type = other DNA
ggcgcgccagtcctccacgttaagtgtgtaaagatgcagtgtaaggttcaagtgccaaatccctggaaggagtgaccctctactgccctaggaatgctgtgcaggtacccccaacttcggttggggatctgagcacaggctaattgtctacgggtagtcacggaatcgagaatctcttttttggcatccgactcggaccgatg

SEQ ID NO: 17169 - DNA, 203 bp, Homo sapiens
  source 1..203: mol_type = other DNA
ggcgcgccagtcctaccacgttgttgtgtaaagatgcagtgtaaggttcaagtgccaaatccctggaaggagtgaccctctactgccctaggaatgctgtgcaggtacccccaacttcggttggggatctgagcacaggctaattgtctacgggtagtccggcgggtcatcctctcccggcgggtatccgactcggaccgatg

SEQ ID NO: 17170 - DNA, 203 bp, Homo sapiens
  source 1..203: mol_type = other DNA
ggcgcgccagtccttccagtttcatgtgtaaagatgcagtgtaaggttcaagtgccaaatccctggaaggagtgaccctctactgccctaggaatgctgtgcaggtacccccaacttcggttggggatctgagcacaggctaattgtctacgggtagtcgtcaattcctttatctcttttttggcatccgactcggaccgatg

SEQ ID NO: 17171 - DNA, 203 bp, Homo sapiens
  source 1..203: mol_type = other DNA
ggcgcgccagtccttgaaactttgtgtgtaaagatgcagtgtaaggttcaagtgccaaatccctggaaggagtgaccctctactgccctaggaatgctgtgcaggtacccccaacttcggttggggatctgagcacaggctaattgtctacgggtagttactccccccatcctctctactcccgcatccgactcggaccgatg

SEQ ID NO: 17172 - DNA, 203 bp, Homo sapiens
  source 1..203: mol_type = other DNA
ggcgcgccagtcctcattgaaacttgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcaccggccgtatccgactcggaccgatg

SEQ ID NO: 17173 - DNA, 203 bp, Homo sapiens
  source 1..203: mol_type = other DNA
ggcgcgccagtcctctgaaactcttgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcccggcgggtatccgactcggaccgatg

SEQ ID NO: 17174 - DNA, 203 bp, Homo sapiens
  source 1..203: mol_type = other DNA
ggcgcgccagtccttgaaatgacatgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctctactcccgcatccgactcggaccgatg

SEQ ID NO: 17175 - DNA, 203 bp, Homo sapiens
  source 1..203: mol_type = other DNA
ggcgcgccagtcctagcctgcacgtgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcttcttggcaaaccgactcggaccgatg

SEQ ID NO: 17176 - DNA, 203 bp, Homo sapiens
  source 1..203: mol_type = other DNA
ggcgcgccagtcctatccacgaagtgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcttttttggcatccgactcggaccgatg

SEQ ID NO: 17177 - DNA, 203 bp, Homo sapiens
  source 1..203: mol_type = other DNA
ggcgcgccagtcctagttcacgaatgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcttggcaaatcctctcttcttggcaaaccgactcggaccgatg

SEQ ID NO: 17178 - DNA, 203 bp, Homo sapiens
  source 1..203: mol_type = other DNA
ggcgcgccagtccttagttcgtgatgtgtaaagatgcagtgtaaggttcaagtgccaaatccctggaaggagtgaccctctactgccctaggaatgctgtgcaggtacccccaacttcggttggggatctgagcacaggctactcccctacgggtagttactccccccatcctctctactcccgcatccgactcggaccgatg

SEQ ID NO: 17179 - DNA, 203 bp, Homo sapiens
  source 1..203: mol_type = other DNA
ggcgcgccagtccttattcgtggatgtgtaaagatgcagtgtaaggttcaagtgccaaatccctggaaggagtgaccctctactgccctaggaatgctgtgcaggtacccccaacttcggttggggatctgagcacaggcttcttggcaaagggtagtttcttggcaaatcctctcttcttggcaaaccgactcggaccgatg

SEQ ID NO: 17180 - DNA, 203 bp, Homo sapiens
  source 1..203: mol_type = other DNA
ggcgcgccagtccttccacgaagatgtgtaaagatgcagtgtaaggttcaagtgccaaatccctggaaggagtgaccctctactgccctaggaatgctgtgcaggtacccccaacttcggtttactccctgagcacaggctactcccctacgggtagttactccccccatcctctctactcccgcatccgactcggaccgatg

SEQ ID NO: 17181 - DNA, 203 bp, Homo sapiens
  source 1..203: mol_type = other DNA
ggcgcgccagtcctcattcgtgcttgtgtaaagatgcagtgtaaggttcaagtgccaaatccctggaaggagtgaccctctactgccgtcaattcctttagcagcgtcaattcctttaggttcgtcaattcctttaaggccgtcaattcctttatagtcgtcaattcctttatctcttttttggcatccgactcggaccgatg

SEQ ID NO: 17182 - DNA, 203 bp, Homo sapiens
  source 1..203: mol_type = other DNA
ggcgcgccagtccttggcactaactgtgtaaagatgcagtgtaaggttcacacggaatcgagaaggaacacggaatcgagaactgccacggaatcgagaagcagcacggaatcgagaaggttcacggaatcgagaaaggccacggaatcgagaatagtcacggaatcgagaatctcttttttggcatccgactcggaccgatg

SEQ ID NO: 17183 - DNA, 203 bp, Homo sapiens
  source 1..203: mol_type = other DNA
ggcgcgccagtcctacgcaccagatgtgtaaagatgcagtgtaaggttcatactcccaatccctggaatactcccccctctactgctactcccatgctgtgcagtactccccaacttcggtttactccctgagcacaggctactcccctacgggtagttactccccccatcctctctactcccgcatccgactcggaccgatg

SEQ ID NO: 17184 - DNA, 203 bp, Homo sapiens
  source 1..203: mol_type = other DNA
ggcgcgccagtcctacgcactgcgtgtgtaaagatgcagtgtaaggttcattcttggcaaacctggaattcttggcaaactactgcttcttggcaaatgtgcagttcttggcaaattcggttttcttggcaaacacaggcttcttggcaaagggtagtttcttggcaaatcctctcttcttggcaaaccgactcggaccgatg

SEQ ID NO: 17185 - DNA, 203 bp, Homo sapiens
  source 1..203: mol_type = other DNA
ggcgcgccagtcctaacgcactagtgtgtaaatactccctgtaaggttcatactcccaatccctggaatactcccccctctactgctactcccatgctgtgcagtactccccaacttcggtttactccctgagcacaggctactcccctacgggtagttactccccccatcctctctactcccgcatccgactcggaccgatg

SEQ ID NO: 17186 - DNA, 203 bp, Homo sapiens
  source 1..203: mol_type = other DNA
ggcgcgccagtcctcttgttacacttacttcaaccggccgtcaggtcaaaaccggccgtggcgcacctaccggccgtctgacacataccggccgtgcaccagcaaccggccgtacgctgacaaccggccgtagcgacttgaccggccgtaatttggctaccggccgtgagagccccaccggccgtagacgactcggaccgatg

SEQ ID NO: 17187 - DNA, 203 bp, Homo sapiens
  source 1..203: mol_type = other DNA
ggcgcgccagtcctttcatacgctttacttcacactcagtccaggtcaaacgtcaattcctttaacctcgtcaattcctttaacatcgtcaattcctttaagcacgtcaattcctttagacacgtcaattcctttacttgcgtcaattcctttaggctcgtcaattcctttaccccgacaactgaagacgactcggaccgatg

SEQ ID NO: 17188 - DNA, 203 bp, Homo sapiens
  source 1..203: mol_type = other DNA
ggcgcgccagtccttacgtcaggtttacttcacactcagtccaggtcaaaggtaaatcaggcgcacctcgtcaattcctttaacatcgtcaattcctttaagcacgtcaattcctttagacacgtcaattcctttacttgcgtcaattcctttaggctcgtcaattcctttaccccgacaactgaagacgactcggaccgatg

SEQ ID NO: 17189 - DNA, 203 bp, Homo sapiens
  source 1..203: mol_type = other DNA
ggcgcgccagtcctacagtacgggttacttcacactcagtccaggtcaaaggtaaatcaggcgcaccttactcccacctgacacattactccccagcaccagcatactcccgaacgctgacatactcccgaagcgacttgtactcccccaatttggcttactcccctgagagcccctactcccgaagacgactcggaccgatg

SEQ ID NO: 17190 - DNA, 203 bp, Homo sapiens
  source 1..203: mol_type = other DNA
ggcgcgccagtccttgttaacgggttacttcacactcagtccaggtcaaaggtaaatcaggcgcaccttggcaccacctgacacatccggcgggtgcaccagcaccggcgggtacgctgacaccggcgggtagcgacttgccggcgggtaatttggctccggcgggtgagagccccccggcgggtagacgactcggaccgatg

SEQ ID NO: 17191 - DNA, 203 bp, Homo sapiens
  source 1..203: mol_type = other DNA
ggcgcgccagtcctagtcgacgggttacttcacactcagtccaggtcaaaggtaaatcaggcgcaccttggcaccacctgacacattgtacaccagcaccagcacacggaatcgagaagacacacggaatcgagaacttgcacggaatcgagaaggctcacggaatcgagaaccccgacaactgaagacgactcggaccgatg

SEQ ID NO: 17192 - DNA, 203 bp, Homo sapiens
  source 1..203: mol_type = other DNA
ggcgcgccagtcctcccgtagctgttacttcacactcagtccaggtcaaaggtaaatcaggcgcaccttggcaccacctgacacattgtacaccagcaccagcaccggcgggtacgctgacaccggcgggtagcgacttgccggcgggtaatttggctccggcgggtgagagccccccggcgggtagacgactcggaccgatg

SEQ ID NO: 17193 - DNA, 203 bp, Homo sapiens
  source 1..203: mol_type = other DNA
ggcgcgccagtcctcgtgcacgggttacttcacactcagtccaggtcaaaggtaaatcaggcgcaccttggcaccacctgacacattgtacaccagcaccagcacctgacagaacgctgacaaccggccgtagcgacttgaccggccgtaatttggctaccggccgtgagagccccaccggccgtagacgactcggaccgatg

SEQ ID NO: 17194 - DNA, 203 bp, Homo sapiens
  source 1..203: mol_type = other DNA
ggcgcgccagtcctgcctttagaattacttcacactcagtccaggtcaaaggtaaatcaggcgcaccttggcaccacctgacacattgtacaccagcaccagcacctgacagaacgctgacagaagtcagaagcgacttgatcgcctccaatttggctaccggccgtgagagccccaccggccgtagacgactcggaccgatg

SEQ ID NO: 17195 - DNA, 203 bp, Homo sapiens
  source 1..203: mol_type = other DNA
ggcgcgccagtcctcttctaactcttacttcacactcagtccaggtcaaaggtaaatcaggcgcaccttggcaccacctgacacattgtacaccagcaccagcacctgacagaacgctgacagaagtcagaagcgacttgatcgcctccaatttggctccggcgggtgagagccccccggcgggtagacgactcggaccgatg

SEQ ID NO: 17196 - DNA, 203 bp, Homo sapiens
  source 1..203: mol_type = other DNA
ggcgcgccagtcctatacttctaattacttcacactcagtccaggtcaaaggtaaatcaggcgcaccttggcaccacctgacacattgtacaccagcaccagcacctgacagaacgctgacagaagtcagaagcgacttgatcgcctccaatttggcttactcccctgagagcccctactcccgaagacgactcggaccgatg

SEQ ID NO: 17197 - DNA, 203 bp, Homo sapiens
  source 1..203: mol_type = other DNA
ggcgcgccagtcctttagaaggccttacttcacactcagtccaggtcaaaggtaaatcaggcgcaccttggcaccacctgacacattgtacaccagcaccagcacctgacagaacgctgacagaagtcagaagcgacttgatcgcctccaatttggctttcttggcaaagagccccttcttggcaaaacgactcggaccgatg

SEQ ID NO: 17198 - DNA, 203 bp, Homo sapiens
  source 1..203: mol_type = other DNA
ggcgcgccagtcctctggtgtgtattacttcacactcagtccaggtcaaaggtaaatcaggcgcaccttggcaccacctgacacattgtacaccagcaccagcacctgacagaacgctgacattcttggcaaacgacttgttcttggcaaatttggctttcttggcaaagagccccttcttggcaaaacgactcggaccgatg

SEQ ID NO: 17199 - DNA, 203 bp, Homo sapiens
  source 1..203: mol_type = other DNA
ggcgcgccagtcctagtgtgtacgttacttcacactcagtccaggtcaaaggtaaatcaggcgcaccttggcaccacctgacacattgtacaccagcaccagcacgtcaattcctttagacacgtcaattcctttacttgcgtcaattcctttaggctcgtcaattcctttaccccgacaactgaagacgactcggaccgatg

SEQ ID NO: 17200 - DNA, 203 bp, Homo sapiens
  source 1..203: mol_type = other DNA
ggcgcgccagtcctccacgacgtgttacttcacactcagtccaggtcaaatactccccaggcgcaccttactcccacctgacacattactccccagcaccagcatactcccgaacgctgacatactcccgaagcgacttgtactcccccaatttggcttactcccctgagagcccctactcccgaagacgactcggaccgatg

SEQ ID NO: 17201 - DNA, 203 bp, Homo sapiens
  source 1..203: mol_type = other DNA
ggcgcgccagtcctaaacaaggccttacttcacgtcaattcctttacaaacgtcaattcctttaacctcgtcaattcctttaacatcgtcaattcctttaagcacgtcaattcctttagacacgtcaattcctttacttgcgtcaattcctttaggctcgtcaattcctttaccccgacaactgaagacgactcggaccgatg

SEQ ID NO: 17202 - DNA, 20 bp, synthetic construct
  source 1..20: mol_type = other DNA
cgggtggagcccattgacgt

SEQ ID NO: 17203 - DNA, 20 bp, synthetic construct
  source 1..20: mol_type = other DNA
cttcactctcctgtaaaacg

SEQ ID NO: 17204 - DNA, 20 bp, synthetic construct
  source 1..20: mol_type = other DNA
gacaccaccatgaccggctc

SEQ ID NO: 17205 - DNA, 20 bp, synthetic construct
  source 1..20: mol_type = other DNA
gagagcgactttcaaactcg

SEQ ID NO: 17206 - DNA, 20 bp, synthetic construct
  source 1..20: mol_type = other DNA
cccgcgtgtgtgcgcctaat

SEQ ID NO: 17207 - DNA, 20 bp, synthetic construct
  source 1..20: mol_type = other DNA
ggctgaaggccgactgtgat

SEQ ID NO: 17208 - DNA, 20 bp, synthetic construct
  source 1..20: mol_type = other DNA
attggttggcggacggtgcg

SEQ ID NO: 17209 - DNA, 20 bp, synthetic construct
  source 1..20: mol_type = other DNA
cctccttcgccccggggccc

SEQ ID NO: 17210 - DNA, 20 bp, synthetic construct
  source 1..20: mol_type = other DNA
taagtgtttccggtggattc

SEQ ID NO: 17211 - DNA, 20 bp, synthetic construct
  source 1..20: mol_type = other DNA
aaccttgccgtgctggaatt

SEQ ID NO: 17212 - DNA, 20 bp, synthetic construct
  source 1..20: mol_type = other DNA
ctggcgtcacccctctgctc

SEQ ID NO: 17213 - DNA, 20 bp, synthetic construct
  source 1..20: mol_type = other DNA
cggctgaaggaggccccagg

SEQ ID NO: 17214 - DNA, 20 bp, synthetic construct
  source 1..20: mol_type = other DNA
catgttgagggggggaccgc

SEQ ID NO: 17215 - DNA, 20 bp, synthetic construct
  source 1..20: mol_type = other DNA
cttgaaactgcggctcggga

SEQ ID NO: 17216 - DNA, 20 bp, synthetic construct
  source 1..20: mol_type = other DNA
gcgcgctcgcatccccaaga

SEQ ID NO: 17217 - DNA, 20 bp, synthetic construct
  source 1..20: mol_type = other DNA
cctacggaggtggcagccat

SEQ ID NO: 17218 - DNA, 20 bp, synthetic construct
  source 1..20: mol_type = other DNA
ctggatggagcctttctctg

SEQ ID NO: 17219 - DNA, 20 bp, synthetic construct
  source 1..20: mol_type = other DNA
agattgtgggcggctgtgtc

SEQ ID NO: 17220 - DNA, 20 bp, synthetic construct
  source 1..20: mol_type = other DNA
tctgactccacatccagtcc

SEQ ID NO: 17221 - DNA, 20 bp, synthetic construct
  source 1..20: mol_type = other DNA
gtctcctgcgctcctgctgg

SEQ ID NO: 17222 - DNA, 20 bp, synthetic construct
  source 1..20: mol_type = other DNA
ctcatccgggttcccgggac

SEQ ID NO: 17223 - DNA, 20 bp, synthetic construct
  source 1..20: mol_type = other DNA
cctcacactcggtgcccgga

SEQ ID NO: 17224 - DNA, 20 bp, synthetic construct
  source 1..20: mol_type = other DNA
gcccgctgccctttgcctcc

SEQ ID NO: 17225 - DNA, 20 bp, synthetic construct
  source 1..20: mol_type = other DNA
aggggctgtgggcgcgcagc

SEQ ID NO: 17226 - DNA, 20 bp, synthetic construct
  source 1..20: mol_type = other DNA
acgctcccgggtcacgtgac

SEQ ID NO: 17227 - DNA, 20 bp, synthetic construct
  source 1..20: mol_type = other DNA
catgtacagtcctccccagt

SEQ ID NO: 17228 - DNA, 20 bp, synthetic construct
  source 1..20: mol_type = other DNA
aggcggcggcgcgaggcagt

SEQ ID NO: 17229 - DNA, 20 bp, synthetic construct
  source 1..20: mol_type = other DNA
aagcgatcccctcgccccag

SEQ ID NO: 17230 - DNA, 20 bp, synthetic construct
  source 1..20: mol_type = other DNA
ggacttggaacacctgtaac

SEQ ID NO: 17231 - DNA, 20 bp, synthetic construct
  source 1..20: mol_type = other DNA
cagaaggcgcagccatgaat

SEQ ID NO: 17232 - DNA, 20 bp, synthetic construct
  source 1..20: mol_type = other DNA
cagggcaggggtcctccgcc

SEQ ID NO: 17233 - DNA, 20 bp, synthetic construct
  source 1..20: mol_type = other DNA
cgagtgtggccaagggtgcc

SEQ ID NO: 17234 - DNA, 20 bp, synthetic construct
  source 1..20: mol_type = other DNA
tctggacccatccagctgag

SEQ ID NO: 17235 - DNA, 20 bp, synthetic construct
  source 1..20: mol_type = other DNA
ggcggcgccaccctccgggg

SEQ ID NO: 17236 - DNA, 20 bp, synthetic construct
  source 1..20: mol_type = other DNA
cggaggccaggagctcaacc

SEQ ID NO: 17237 - DNA, 20 bp, synthetic construct
  source 1..20: mol_type = other DNA
cggtcacctgtctccggtgg

SEQ ID NO: 17238 - DNA, 20 bp, synthetic construct
  source 1..20: mol_type = other DNA
gcttcgagcagggcatcgga

SEQ ID NO: 17239 - DNA, 20 bp, synthetic construct
  source 1..20: mol_type = other DNA
aagttgcacggtgaattggc

SEQ ID NO: 17240 - DNA, 20 bp, synthetic construct
  source 1..20: mol_type = other DNA
gtgcaggagtcctggggcat

SEQ ID NO: 17241 - DNA, 20 bp, synthetic construct
  source 1..20: mol_type = other DNA
cagttatcattagtctgcaa

SEQ ID NO: 17242 - DNA, 20 bp, synthetic construct
  source 1..20: mol_type = other DNA
agcgaaaagtattaaacaaa

SEQ ID NO: 17243 - DNA, 20 bp, synthetic construct
  source 1..20: mol_type = other DNA
ctgcctgctcccccgcccca

SEQ ID NO: 17244 - DNA, 20 bp, synthetic construct
  source 1..20: mol_type = other DNA
cagcgctgcgtcggcagtac

SEQ ID NO: 17245 - DNA, 20 bp, synthetic construct
  source 1..20: mol_type = other DNA
ccagctccttgcccagacca

SEQ ID NO: 17246 - DNA, 20 bp, synthetic construct
  source 1..20: mol_type = other DNA
gcatcttcttgcagattcca

SEQ ID NO: 17247 - DNA, 20 bp, synthetic construct
  source 1..20: mol_type = other DNA
gccagcccttttcccgaccc

SEQ ID NO: 17248 - DNA, 20 bp, synthetic construct
  source 1..20: mol_type = other DNA
ccaaccatggtgaacttggg

SEQ ID NO: 17249 - DNA, 20 bp, synthetic construct
  source 1..20: mol_type = other DNA
cccggacggcctcaccatga

SEQ ID NO: 17250 - DNA, 20 bp, synthetic construct
  source 1..20: mol_type = other DNA
aggctagaggctgcgcaagc

SEQ ID NO: 17251 - DNA, 20 bp, synthetic construct
  source 1..20: mol_type = other DNA
ccttgcgcaccaggaagtga

SEQ ID NO: 17252 - DNA, 20 bp, synthetic construct
  source 1..20: mol_type = other DNA
tcaccgtgttagccaagatg

SEQ ID NO: 17253 - DNA, 20 bp, synthetic construct
  source 1..20: mol_type = other DNA
tgtctggccttttgtccttg

SEQ ID NO: 17254 - DNA, 20 bp, synthetic construct
  source 1..20: mol_type = other DNA
cacacaccaccttacccctc

SEQ ID NO: 17255 - DNA, 20 bp, synthetic construct
  source 1..20: mol_type = other DNA
ccgcgttggctgggtggcct

SEQ ID NO: 17256 - DNA, 20 bp, synthetic construct
  source 1..20: mol_type = other DNA
aggtaacttccagggtgcgc

SEQ ID NO: 17257 - DNA, 20 bp, synthetic construct
  source 1..20: mol_type = other DNA
tctaagccgggcgcctcacc

SEQ ID NO: 17258 - DNA, 20 bp, synthetic construct
  source 1..20: mol_type = other DNA
tcggttggcgcgcaacgggt

SEQ ID NO: 17259 - DNA, 20 bp, synthetic construct
  source 1..20: mol_type = other DNA
tggcccgagagggatcccgg

SEQ ID NO: 17260 - DNA, 20 bp, synthetic construct
  source 1..20: mol_type = other DNA
cagccagggcagcgccagca

SEQ ID NO: 17261 - DNA, 20 bp, synthetic construct
  source 1..20: mol_type = other DNA
gctgctgcggttacctggat

SEQ ID NO: 17262 - DNA, 20 bp, synthetic construct
  source 1..20: mol_type = other DNA
ggcaagcggcgggaggggaa

SEQ ID NO: 17263 - DNA, 20 bp, synthetic construct
  source 1..20: mol_type = other DNA
aaggagaactacattcctca

SEQ ID NO: 17264 - DNA, 20 bp, synthetic construct
  source 1..20: mol_type = other DNA
ctggtgccacagcagctgag

SEQ ID NO: 17265 - DNA, 20 bp, synthetic construct
  source 1..20: mol_type = other DNA
ctggcagcggcgaggacccg

SEQ ID NO: 17266 - DNA, 20 bp, synthetic construct
  source 1..20: mol_type = other DNA
accgggtacccgggctatgg

SEQ ID NO: 17267 - DNA, 20 bp, synthetic construct
  source 1..20: mol_type = other DNA
aacagactccggcccactcc

SEQ ID NO: 17268 - DNA, 20 bp, synthetic construct
  source 1..20: mol_type = other DNA
agttcggggaagctgtacgc

SEQ ID NO: 17269 - DNA, 20 bp, synthetic construct
  source 1..20: mol_type = other DNA
cctttgctttcagccggact

SEQ ID NO: 17270 - DNA, 20 bp, synthetic construct
  source 1..20: mol_type = other DNA
caagatggcggcgcccgagg

SEQ ID NO: 17271 - DNA, 20 bp, synthetic construct
  source 1..20: mol_type = other DNA
gaggctctgtacctgcagtg

SEQ ID NO: 17272 - DNA, 20 bp, synthetic construct
  source 1..20: mol_type = other DNA
taaacaaggggcatccaaat

SEQ ID NO: 17273 - DNA, 20 bp, synthetic construct
  source 1..20: mol_type = other DNA
catcagtcttaccgaagcca

SEQ ID NO: 17274 - DNA, 20 bp, synthetic construct
  source 1..20: mol_type = other DNA
ggaagatggaactcattgtc

SEQ ID NO: 17275 - DNA, 20 bp, synthetic construct
  source 1..20: mol_type = other DNA
atccattttaatctgcgggg

SEQ ID NO: 17276 - DNA, 20 bp, synthetic construct
  source 1..20: mol_type = other DNA
catggcctagtaactgtccg

SEQ ID NO: 17277 - DNA, 20 bp, synthetic construct
  source 1..20: mol_type = other DNA
ccggttcgcgtctctctgct

SEQ ID NO: 17278 - DNA, 20 bp, synthetic construct
  source 1..20: mol_type = other DNA
gctcggctccgctccaatcc

SEQ ID NO: 17279 - DNA, 20 bp, synthetic construct
  source 1..20: mol_type = other DNA
ctgagagccatgtcggccag

SEQ ID NO: 17280 - DNA, 20 bp, synthetic construct
  source 1..20: mol_type = other DNA
agagaagtccggatcgtggt

SEQ ID NO: 17281 - DNA, 20 bp, synthetic construct
  source 1..20: mol_type = other DNA
gtgtggacgctgtgtatgaa

SEQ ID NO: 17282 - DNA, 20 bp, synthetic construct
  source 1..20: mol_type = other DNA
cccaaagccctgagattaca

SEQ ID NO: 17283 - DNA, 20 bp, synthetic construct
  source 1..20: mol_type = other DNA
ctgtgacactgctgctccct

SEQ ID NO: 17284 - DNA, 20 bp, synthetic construct
  source 1..20: mol_type = other DNA
gcttggcgatgcccagcaga

SEQ ID NO: 17285 - DNA, 20 bp, synthetic construct
  source 1..20: mol_type = other DNA
tcactccctgaggcagtggc

SEQ ID NO: 17286 - DNA, 20 bp, synthetic construct
  source 1..20: mol_type = other DNA
ctgcgccccggctgcgctcc

SEQ ID NO: 17287 - DNA, 20 bp, synthetic construct
  source 1..20: mol_type = other DNA
cagcctgggcggggccgcag

SEQ ID NO: 17288 - DNA, 20 bp, synthetic construct
  source 1..20: mol_type = other DNA
gcagagcgtcctagcagtgt

SEQ ID NO: 17289 - DNA, 20 bp, synthetic construct
  source 1..20: mol_type = other DNA
ctctgtgggcggccgccggg

SEQ ID NO: 17290 - DNA, 20 bp, synthetic construct
  source 1..20: mol_type = other DNA
cagcagagccgagccggccg

SEQ ID NO: 17291 - DNA, 20 bp, synthetic construct
  source 1..20: mol_type = other DNA
ggcatccggggcagtaaaac

SEQ ID NO: 17292 - DNA, 20 bp, synthetic construct
  source 1..20: mol_type = other DNA
ctgcgtccgacccccggccg

SEQ ID NO: 17293 - DNA, 20 bp, synthetic construct
  source 1..20: mol_type = other DNA
gcacctgatctttctcatcc

SEQ ID NO: 17294 - DNA, 20 bp, synthetic construct
  source 1..20: mol_type = other DNA
gcggctccaggcacccaaca

SEQ ID NO: 17295 - DNA, 20 bp, synthetic construct
  source 1..20: mol_type = other DNA
ccgggcggcaacctttgcag

SEQ ID NO: 17296 - DNA, 20 bp, synthetic construct
  source 1..20: mol_type = other DNA
ggccgcaggtgtatttacgg

SEQ ID NO: 17297 - DNA, 20 bp, synthetic construct
  source 1..20: mol_type = other DNA
aatggaatcggaaggaagaa

SEQ ID NO: 17298 - DNA, 20 bp, synthetic construct
  source 1..20: mol_type = other DNA
ggaagccagaccagagagcg

SEQ ID NO: 17299 - DNA, 20 bp, synthetic construct
  source 1..20: mol_type = other DNA
tgaggccctcaggtctctgc

SEQ ID NO: 17300 - DNA, 20 bp, synthetic construct
  source 1..20: mol_type = other DNA
gcgcaaccggaactagcctt

SEQ ID NO: 17301 - DNA, 20 bp, synthetic construct
  source 1..20: mol_type = other DNA
agaccatggcgaaagccggg

SEQ ID NO: 17302 - DNA, 20 bp, synthetic construct
  source 1..20: mol_type = other DNA
gcccctctcctgtctggagg

SEQ ID NO: 17303 - DNA, 20 bp, synthetic construct
  source 1..20: mol_type = other DNA
tgcacccacatccttctttc

SEQ ID NO: 17304 - DNA, 20 bp, synthetic construct
  source 1..20: mol_type = other DNA
tggttctaaagagtggtgag

SEQ ID NO: 17305 - DNA, 20 bp, synthetic construct
  source 1..20: mol_type = other DNA
gtctggagaaaaatgacctt

SEQ ID NO: 17306 - DNA, 20 bp, synthetic construct
  source 1..20: mol_type = other DNA
ttgtacggcggcttctcgcg

SEQ ID NO: 17307 - DNA, 20 bp, synthetic construct
  source 1..20: mol_type = other DNA
agctcccgccccggaagcgg

SEQ ID NO: 17308 - DNA, 20 bp, synthetic construct
  source 1..20: mol_type = other DNA
tgcgcgggtatctctgaagt

SEQ ID NO: 17309 - DNA, 20 bp, synthetic construct
  source 1..20: mol_type = other DNA
ttgtttgagtttcttcacac

SEQ ID NO: 17310 - DNA, 20 bp, synthetic construct
  source 1..20: mol_type = other DNA
caggaagatggcggcctctg

SEQ ID NO: 17311 - DNA, 20 bp, synthetic construct
  source 1..20: mol_type = other DNA
tgccaacccagcagccggct

SEQ ID NO: 17312 - DNA, 20 bp, synthetic construct
  source 1..20: mol_type = other DNA
tggtatattcaaggttggat

SEQ ID NO: 17313 - DNA, 20 bp, synthetic construct
  source 1..20: mol_type = other DNA
cccagcaacagttactcaaa

SEQ ID NO: 17314 - DNA, 20 bp, synthetic construct
  source 1..20: mol_type = other DNA
ggtggggtgtgtgtgtcaaa

SEQ ID NO: 17315 - DNA, 20 bp, synthetic construct
  source 1..20: mol_type = other DNA
gagcccatacttgctctttt

SEQ ID NO: 17316 - DNA, 20 bp, synthetic construct
  source 1..20: mol_type = other DNA
ggtgagagagtgagggggaa

SEQ ID NO: 17317 - DNA, 20 bp, synthetic construct
  source 1..20: mol_type = other DNA
tgccagctgagtcgtgggca

SEQ ID NO: 17318 - DNA, 20 bp, synthetic construct
  source 1..20: mol_type = other DNA
gagttacgattcaaactgaa

SEQ ID NO: 17319 - DNA, 20 bp, synthetic construct
  source 1..20: mol_type = other DNA
cagccccgactgctcctcct

SEQ ID NO: 17320 - DNA, 20 bp, synthetic construct
  source 1..20: mol_type = other DNA
tcttgggggctggaggacgt

SEQ ID NO: 17321 - DNA, 20 bp, synthetic construct
  source 1..20: mol_type = other DNA
gagcggagcccggtgacagg

SEQ ID NO: 17322 - DNA, 20 bp, synthetic construct
  source 1..20: mol_type = other DNA
ctacagcagcttcggcggcg

SEQ ID NO: 17323 - DNA, 20 bp, synthetic construct
  source 1..20: mol_type = other DNA
gccggactctatggggcggg

SEQ ID NO: 17324 - DNA, 20 bp, synthetic construct
  source 1..20: mol_type = other DNA
gaaagaggggaagagtatta

SEQ ID NO: 17325 - DNA, 20 bp, synthetic construct
  source 1..20: mol_type = other DNA
gtgaagcgatagcgttttgc

SEQ ID NO: 17326 - DNA, 20 bp, synthetic construct
  source 1..20: mol_type = other DNA
ccccggaagaggtagctcac

SEQ ID NO: 17327 - DNA, 20 bp, synthetic construct
  source 1..20: mol_type = other DNA
cagagccggtgtctccgcct

SEQ ID NO: 17328 - DNA, 20 bp, synthetic construct
  source 1..20: mol_type = other DNA
agctgtagtgcttctgggca

SEQ ID NO: 17329 - DNA, 20 bp, synthetic construct
  source 1..20: mol_type = other DNA
cggtcccggggccccctggg

SEQ ID NO: 17330 - DNA, 20 bp, synthetic construct
  source 1..20: mol_type = other DNA
cagtgaagccgccggcacct

SEQ ID NO: 17331 - DNA, 20 bp, synthetic construct
  source 1..20: mol_type = other DNA
cttcccgccaggcaagtgcc

SEQ ID NO: 17332 - DNA, 20 bp, synthetic construct
  source 1..20: mol_type = other DNA
cgagggaggtcttgctggag

SEQ ID NO: 17333 - DNA, 20 bp, synthetic construct
  source 1..20: mol_type = other DNA
cagccttcagctgcctgtgt

SEQ ID NO: 17334 - DNA, 20 bp, synthetic construct
  source 1..20: mol_type = other DNA
gctgaccgttttttgtggtg

SEQ ID NO: 17335 - DNA, 20 bp, synthetic construct
  source 1..20: mol_type = other DNA
ttgtcctgctggtccacgcc

SEQ ID NO: 17336 - DNA, 20 bp, synthetic construct
  source 1..20: mol_type = other DNA
agggagaatggcggcgcccg

SEQ ID NO: 17337 - DNA, 20 bp, synthetic construct
  source 1..20: mol_type = other DNA
gggggactctccaggaagaa

SEQ ID NO: 17338 - DNA, 20 bp, synthetic construct
  source 1..20: mol_type = other DNA
tgcgggggaggctgcccgga

SEQ ID NO: 17339 - DNA, 20 bp, synthetic construct
  source 1..20: mol_type = other DNA
gccacctttagccgccagga

SEQ ID NO: 17340 - DNA, 20 bp, synthetic construct
  source 1..20: mol_type = other DNA
gatgagaccggtgcgactca

SEQ ID NO: 17341 - DNA, 20 bp, synthetic construct
  source 1..20: mol_type = other DNA
gtgggcgcggccgggaagct

SEQ ID NO: 17342 - DNA, 20 bp, synthetic construct
  source 1..20: mol_type = other DNA
ccttcccgcggaatcggcgc

SEQ ID NO: 17343 - DNA, 20 bp, synthetic construct
  source 1..20: mol_type = other DNA
cccgcgctcccctcctcccc

SEQ ID NO: 17344 - DNA, 20 bp, synthetic construct
  source 1..20: mol_type = other DNA
gagggaatctgataaagaca

SEQ ID NO: 17345 - DNA, 20 bp, synthetic construct
  source 1..20: mol_type = other DNA
ccggtgcgttaccggcagct

SEQ ID NO: 17346 - DNA, 20 bp, synthetic construct
  source 1..20: mol_type = other DNA
aaagtttgaatcagcttctc

SEQ ID NO: 17347 - DNA, 20 bp, synthetic construct
  source 1..20: mol_type = other DNA
gtccttcctaggactgactt

SEQ ID NO: 17348 - DNA, 20 bp, synthetic construct
  source 1..20: mol_type = other DNA
ctccacaccccttgcgcccg

SEQ ID NO: 17349 - DNA, 20 bp, synthetic construct
  source 1..20: mol_type = other DNA
agtgccctctgcagctgaat

SEQ ID NO: 17350 - DNA, 20 bp, synthetic construct
  source 1..20: mol_type = other DNA
tgttgcagggagtgagggca

SEQ ID NO: 17351 - DNA, 20 bp, synthetic construct
  source 1..20: mol_type = other DNA
cgctgttcagtgccggtgtt

SEQ ID NO: 17352 - DNA, 20 bp, synthetic construct
  source 1..20: mol_type = other DNA
ccgggccctcccctcaggaa

SEQ ID NO: 17353 - DNA, 20 bp, synthetic construct
  source 1..20: mol_type = other DNA
ctccccaccaccaccatctc

SEQ ID NO: 17354 - DNA, 20 bp, synthetic construct
  source 1..20: mol_type = other DNA
atttcattttcctcaagttt

SEQ ID NO: 17355 - DNA, 20 bp, synthetic construct
  source 1..20: mol_type = other DNA
aaccgtcatgtttctgggga

SEQ ID NO: 17356 - DNA, 20 bp, synthetic construct
  source 1..20: mol_type = other DNA
cagcagaggagactgcagac

SEQ ID NO: 17357 - DNA, 20 bp, synthetic construct
  source 1..20: mol_type = other DNA
gacccaaccgcagtgaaggg

SEQ ID NO: 17358 - DNA, 20 bp, synthetic construct
  source 1..20: mol_type = other DNA
tcacctcaagctgtcccctc

SEQ ID NO: 17359 - DNA, 20 bp, synthetic construct
  source 1..20: mol_type = other DNA
cgaaggccccgcccctcaca

SEQ ID NO: 17360 - DNA, 20 bp, synthetic construct
  source 1..20: mol_type = other DNA
atttgttgtctgcccacttt

SEQ ID NO: 17361 - DNA, 20 bp, synthetic construct
  source 1..20: mol_type = other DNA
taccaagcgcctgtgtctgg

SEQ ID NO: 17362 - DNA, 20 bp, synthetic construct
  source 1..20: mol_type = other DNA
cttggtgaggtgactcgcgg

SEQ ID NO: 17363 - DNA, 20 bp, synthetic construct
  source 1..20: mol_type = other DNA
ttgaacccaaagtggatgat

SEQ ID NO: 17364 - DNA, 20 bp, synthetic construct
  source 1..20: mol_type = other DNA
ggcagccagggtggggccca

SEQ ID NO: 17365 - DNA, 20 bp, synthetic construct
  source 1..20: mol_type = other DNA
tgggccagcgggggcgccgc

SEQ ID NO: 17366 - DNA, 20 bp, synthetic construct
  source 1..20: mol_type = other DNA
tgcggcgccgcgcggtgagg

SEQ ID NO: 17367 - DNA, 20 bp, synthetic construct
  source 1..20: mol_type = other DNA
gaggcagtggaggctgaggc

SEQ ID NO: 17368 - DNA, 20 bp, synthetic construct
  source 1..20: mol_type = other DNA
aaatcaatataacctcttct

SEQ ID NO: 17369 - DNA, 20 bp, synthetic construct
  source 1..20: mol_type = other DNA
cctataccagcttccttaca

SEQ ID NO: 17370 - DNA, 20 bp, synthetic construct
  source 1..20: mol_type = other DNA
cagctacggcgaggaggggc

SEQ ID NO: 17371 - DNA, 20 bp, synthetic construct
  source 1..20: mol_type = other DNA
gccaccgagacgcgcagagg

SEQ ID NO: 17372 - DNA, 20 bp, synthetic construct
  source 1..20: mol_type = other DNA
ggaggacaacaaagggccgc

SEQ ID NO: 17373 - DNA, 20 bp, synthetic construct
  source 1..20: mol_type = other DNA
tcactctggaggatggggtg

SEQ ID NO: 17374 - DNA, 20 bp, synthetic construct
  source 1..20: mol_type = other DNA
gcgtatcatctgcgtttcta

SEQ ID NO: 17375 - DNA, 20 bp, synthetic construct
  source 1..20: mol_type = other DNA
ccctgtccggccagcccctc

SEQ ID NO: 17376 - DNA, 20 bp, synthetic construct
  source 1..20: mol_type = other DNA
ccagagatggcagtgagcga

SEQ ID NO: 17377 - DNA, 20 bp, synthetic construct
  source 1..20: mol_type = other DNA
ctaggaaaggctgcttcgcc

SEQ ID NO: 17378 - DNA, 20 bp, synthetic construct
  source 1..20: mol_type = other DNA
ttttctttgatacgggagtt

SEQ ID NO: 17379 - DNA, 20 bp, synthetic construct
  source 1..20: mol_type = other DNA
gccccgccagctgggccaaa

SEQ ID NO: 17380 - DNA, 20 bp, synthetic construct
  source 1..20: mol_type = other DNA
ctgtgaacactatagcgctg

SEQ ID NO: 17381 - DNA, 20 bp, synthetic construct
  source 1..20: mol_type = other DNA
tccttagccctgcccctctc

SEQ ID NO: 17382 - DNA, 20 bp, synthetic construct
  source 1..20: mol_type = other DNA
tcggcgctcaggaagcatgg

SEQ ID NO: 17383 - DNA, 20 bp, synthetic construct
  source 1..20: mol_type = other DNA
ctgatggcttcctccaaccc

SEQ ID NO: 17384 - DNA, 20 bp, synthetic construct
  source 1..20: mol_type = other DNA
ttcggtggtgaacgagtctc

SEQ ID NO: 17385 - DNA, 20 bp, synthetic construct
  source 1..20: mol_type = other DNA
gcctgcaccggtcaggcagt

SEQ ID NO: 17386 - DNA, 20 bp, synthetic construct
  source 1..20: mol_type = other DNA
cttgctgcccctttccagcc

SEQ ID NO: 17387 - DNA, 20 bp, synthetic construct
  source 1..20: mol_type = other DNA
gccaggaggaagggcagctt

SEQ ID NO: 17388 - DNA, 20 bp, synthetic construct
  source 1..20: mol_type = other DNA
ttgcggggcgcgcgccagcc

SEQ ID NO: 17389 - DNA, 20 bp, synthetic construct
  source 1..20: mol_type = other DNA
tgtgcagcaatggccaagat

SEQ ID NO: 17390 - DNA, 20 bp, synthetic construct
  source 1..20: mol_type = other DNA
gcagtcaccgcggagcagac

SEQ ID NO: 17391 - DNA, 20 bp, synthetic construct
  source 1..20: mol_type = other DNA
ccctgtcaactgagaattaa

SEQ ID NO: 17392 - DNA, 20 bp, synthetic construct
  source 1..20: mol_type = other DNA
agcgctgcaaggacaaccgg

SEQ ID NO: 17393 - DNA, 20 bp, synthetic construct
  source 1..20: mol_type = other DNA
gagagagaatgtcttttcga

SEQ ID NO: 17394 - DNA, 20 bp, synthetic construct
  source 1..20: mol_type = other DNA
cgcttctgtcagctctccct

SEQ ID NO: 17395 - DNA, 20 bp, synthetic construct
  source 1..20: mol_type = other DNA
tgctgaaaatccgaagtgcc

SEQ ID NO: 17396 - DNA, 20 bp, synthetic construct
  source 1..20: mol_type = other DNA
cccatgtgctgaaaatccga

SEQ ID NO: 17397 - DNA, 20 bp, synthetic construct
  source 1..20: mol_type = other DNA
tccaagtctccttggcaaga

SEQ ID NO: 17398 - DNA, 20 bp, synthetic construct
  source 1..20: mol_type = other DNA
ggtggtagtggcagtgttcg

SEQ ID NO: 17399 - DNA, 20 bp, synthetic construct
  source 1..20: mol_type = other DNA
taggaggggccgtcaggcgg

SEQ ID NO: 17400 - DNA, 20 bp, synthetic construct
  source 1..20: mol_type = other DNA
aaaaactttataaacccccc

SEQ ID NO: 17401 - DNA, 20 bp, synthetic construct
  source 1..20: mol_type = other DNA
tcactgccatccccgctgtc

SEQ ID NO: 17402 - DNA, 20 bp, synthetic construct
  source 1..20: mol_type = other DNA
gcgctagcgtccgggaccgg

SEQ ID NO: 17403 - DNA, 20 bp, synthetic construct
  source 1..20: mol_type = other DNA
agtcggcgcctcgggttcct

SEQ ID NO: 17404 - DNA, 20 bp, synthetic construct
  source 1..20: mol_type = other DNA
gtcctctcccgccctacagg

SEQ ID NO: 17405 - DNA, 20 bp, synthetic construct
  source 1..20: mol_type = other DNA
gaagagggcaccctccgcca

SEQ ID NO: 17406 - DNA, 20 bp, synthetic construct
  source 1..20: mol_type = other DNA
accatccccttgccccgccc

SEQ ID NO: 17407 - DNA, 20 bp, synthetic construct
  source 1..20: mol_type = other DNA
tacctcctgggcagtgagct

SEQ ID NO: 17408 - DNA, 20 bp, synthetic construct
  source 1..20: mol_type = other DNA
cgccttccgctcgtgggagt

SEQ ID NO: 17409 - DNA, 20 bp, synthetic construct
  source 1..20: mol_type = other DNA
cgggaagggatggatcgctg

SEQ ID NO: 17410 - DNA, 20 bp, synthetic construct
  source 1..20: mol_type = other DNA
catgctggtcctttatggac

SEQ ID NO: 17411 - DNA, 20 bp, synthetic construct
  source 1..20: mol_type = other DNA
aggaccgttacgtttcccgg

SEQ ID NO: 17412 - DNA, 20 bp, synthetic construct
  source 1..20: mol_type = other DNA
ccacggcggaggcgctgggt

SEQ ID NO: 17413 - DNA, 20 bp, synthetic construct
  source 1..20: mol_type = other DNA
ccaagggttggctgactgca

SEQ ID NO: 17414 - DNA, 20 bp, synthetic construct
  source 1..20: mol_type = other DNA
ccaagcttctgggtatttct

SEQ ID NO: 17415 - DNA, 20 bp, synthetic construct
  source 1..20: mol_type = other DNA
tcccggcgctccctccccga

SEQ ID NO: 17416 - DNA, 20 bp, synthetic construct
  source 1..20: mol_type = other DNA
atgcctagcccacaccagtt

SEQ ID NO: 17417 - DNA, 20 bp, synthetic construct
  source 1..20: mol_type = other DNA
cttcactggggcagtctctg

SEQ ID NO: 17418 - DNA, 20 bp, synthetic construct
  source 1..20: mol_type = other DNA
gcgggggtagttacggtgtt

SEQ ID NO: 17419 - DNA, 20 bp, synthetic construct
  source 1..20: mol_type = other DNA
aggacccggaggacgtccgg

SEQ ID NO: 17420 - DNA, 20 bp, synthetic construct
  source 1..20: mol_type = other DNA
cacagccacagcccctgact

SEQ ID NO: 17421 - DNA, 20 bp, synthetic construct
  source 1..20: mol_type = other DNA
gttaagtgactcacccaagg

SEQ ID NO: 17422 - DNA, 20 bp, synthetic construct
  source 1..20: mol_type = other DNA
acgggagcatcctgcaccgt

SEQ ID NO: 17423 - DNA, 20 bp, synthetic construct
  source 1..20: mol_type = other DNA
ctgggtggggtccgcgcagc

SEQ ID NO: 17424 - DNA, 20 bp, synthetic construct
  source 1..20: mol_type = other DNA
caggaggccatgtcgggtga

SEQ ID NO: 17425 - DNA, 20 bp, synthetic construct
  source 1..20: mol_type = other DNA
gcggcagcgccactcgggcg

SEQ ID NO: 17426 - DNA, 20 bp, synthetic construct
  source 1..20: mol_type = other DNA
gggtgggtggggccaggagg

SEQ ID NO: 17427 - DNA, 20 bp, synthetic construct
  source 1..20: mol_type = other DNA
aatgacagaggctcacagga

SEQ ID NO: 17428 - DNA, 20 bp, synthetic construct
  source 1..20: mol_type = other DNA
tcaccacattttagtgagaa

SEQ ID NO: 17429 - DNA, 20 bp, synthetic construct
  source 1..20: mol_type = other DNA
cacttcaccctctcgcctcg

SEQ ID NO: 17430 - DNA, 20 bp, synthetic construct
  source 1..20: mol_type = other DNA
cttctccctcccctccagaa

SEQ ID NO: 17431 - DNA, 20 bp, synthetic construct
  source 1..20: mol_type = other DNA
tgaagagaatttggattcat

SEQ ID NO: 17432 - DNA, 20 bp, synthetic construct
  source 1..20: mol_type = other DNA
gcgcagaccgagcatccgcg

SEQ ID NO: 17433 - DNA, 20 bp, synthetic construct
  source 1..20: mol_type = other DNA
taaactctcagagtaactgt

SEQ ID NO: 17434 - DNA, 20 bp, synthetic construct
  source 1..20: mol_type = other DNA
tgcaaaaagaaaaagagacg

SEQ ID NO: 17435 - DNA, 20 bp, synthetic construct
  source 1..20: mol_type = other DNA
gctaccgagcggtgccaggc

SEQ ID NO: 17436 - DNA, 20 bp, synthetic construct
  source 1..20: mol_type = other DNA
ggcaccttccactagcaaca

SEQ ID NO: 17437 - DNA, 20 bp, synthetic construct
  source 1..20: mol_type = other DNA
ctcgcagcgttgctcacaga

SEQ ID NO: 17438 - DNA, 20 bp, synthetic construct
  source 1..20: mol_type = other DNA
ccgcgcggagcccaccattg

SEQ ID NO: 17439 - DNA, 20 bp, synthetic construct
  source 1..20: mol_type = other DNA
cttgcggcgctggaggagct

SEQ ID NO: 17440 - DNA, 20 bp, synthetic construct
  source 1..20: mol_type = other DNA
ggtccaccacgccttccacc

SEQ ID NO: 17441 - DNA, 20 bp, synthetic construct
  source 1..20: mol_type = other DNA
cccacccctttctttttgag

SEQ ID NO: 17442 - DNA, 20 bp, synthetic construct
  source 1..20: mol_type = other DNA
tacaaataggaatagggtac

SEQ ID NO: 17443 - DNA, 20 bp, synthetic construct
  source 1..20: mol_type = other DNA
tgggcctcccaaaagacagt

SEQ ID NO: 17444 - DNA, 20 bp, synthetic construct
  source 1..20: mol_type = other DNA
ctctttccctgctgattcca

SEQ ID NO: 17445 - DNA, 20 bp, synthetic construct
  source 1..20: mol_type = other DNA
agcccggggcggcccagtcg

SEQ ID NO: 17446 - DNA, 20 bp, synthetic construct
  source 1..20: mol_type = other DNA
agcggggagtcgaggcggcg

SEQ ID NO: 17447 - DNA, 20 bp, synthetic construct
  source 1..20: mol_type = other DNA
tttgtctgtaggagcagcgg

SEQ ID NO: 17448 - DNA, 20 bp, synthetic construct
  source 1..20: mol_type = other DNA
caacaccaaaacgcatccac

SEQ ID NO: 17449 - DNA, 20 bp, synthetic construct
  source 1..20: mol_type = other DNA
gcacagctgggacctcctct

SEQ ID NO: 17450 - DNA, 20 bp, synthetic construct
  source 1..20: mol_type = other DNA
tgctccccgccgcttccgtt

SEQ ID NO: 17451 - DNA, 20 bp, synthetic construct
  source 1..20: mol_type = other DNA
gagcgcccgccgctgcattt

SEQ ID NO: 17452 - DNA, 20 bp, synthetic construct
  source 1..20: mol_type = other DNA
aggtcgagagagggatgcga

SEQ ID NO: 17453 - DNA, 20 bp, synthetic construct
  source 1..20: mol_type = other DNA
ctttccggacgccacgtgca

SEQ ID NO: 17454 - DNA, 20 bp, synthetic construct
  source 1..20: mol_type = other DNA
ccggcgttgctgtagcgcgt

SEQ ID NO: 17455 - DNA, 20 bp, synthetic construct
  source 1..20: mol_type = other DNA
gctaccgcgtctgctggacg

SEQ ID NO: 17456 - DNA, 20 bp, synthetic construct
  source 1..20: mol_type = other DNA
caggggcctctcacgtgacc

SEQ ID NO: 17457 - DNA, 20 bp, synthetic construct
  source 1..20: mol_type = other DNA
actccagtgcgcccccaacc

SEQ ID NO: 17458 - DNA, 20 bp, synthetic construct
  source 1..20: mol_type = other DNA
ttcactcctccattgtctgc

SEQ ID NO: 17459 - DNA, 20 bp, synthetic construct
  source 1..20: mol_type = other DNA
gtccttcactcctccattgt

SEQ ID NO: 17460 - DNA, 20 bp, synthetic construct
  source 1..20: mol_type = other DNA
gggcgtgtggccgcgggttt

SEQ ID NO: 17461 - DNA, 20 bp, synthetic construct
  source 1..20: mol_type = other DNA
cctgaccccctccccccgct

SEQ ID NO: 17462 - DNA, 20 bp, synthetic construct
  source 1..20: mol_type = other DNA
cacctgctgtggttatgatg

SEQ ID NO: 17463 - DNA, 20 bp, synthetic construct
  source 1..20: mol_type = other DNA
agaggccgagtctccgaggg

SEQ ID NO: 17464 - DNA, 20 bp, synthetic construct
  source 1..20: mol_type = other DNA
cggtagttccgccgggtctg

SEQ ID NO: 17465 - DNA, 20 bp, synthetic construct
  source 1..20: mol_type = other DNA
cgccaatgatgagctggatt

SEQ ID NO: 17466 - DNA, 20 bp, synthetic construct
  source 1..20: mol_type = other DNA
aagaatccaggttttgaggt

SEQ ID NO: 17467 - DNA, 20 bp, synthetic construct
  source 1..20: mol_type = other DNA
ctgccacctttgcctcctgg

SEQ ID NO: 17468 - DNA, 20 bp, synthetic construct
  source 1..20: mol_type = other DNA
ggggctgcccacgccccctt

SEQ ID NO: 17469 - DNA, 20 bp, synthetic construct
  source 1..20: mol_type = other DNA
agggtgtcgccgctgtgccg

SEQ ID NO: 17470 - DNA, 20 bp, synthetic construct
  source 1..20: mol_type = other DNA
gggacacggagccgcgagga

SEQ ID NO: 17471 - DNA, 20 bp, synthetic construct
  source 1..20: mol_type = other DNA
aatcttgggttgtatctccc

SEQ ID NO: 17472 - DNA, 20 bp, synthetic construct
  source 1..20: mol_type = other DNA
ctgggccaatatggcagcgc

SEQ ID NO: 17473 - DNA, 20 bp, synthetic construct
  source 1..20: mol_type = other DNA
taggggaggccacgggcttg

SEQ ID NO: 17474 - DNA, 20 bp, synthetic construct
  source 1..20: mol_type = other DNA
atggtgaattcgggcctctc

SEQ ID NO: 17475 - DNA, 20 bp, synthetic construct
  source 1..20: mol_type = other DNA
agccccagacacggaccccg

SEQ ID NO: 17476 - DNA, 20 bp, synthetic construct
  source 1..20: mol_type = other DNA
gagcagaccttccctggagc

SEQ ID NO: 17477 - DNA, 20 bp, synthetic construct
  source 1..20: mol_type = other DNA
gggccaaggccagggcctga

SEQ ID NO: 17478 - DNA, 20 bp, synthetic construct
  source 1..20: mol_type = other DNA
tctttccgccagtttttgta

SEQ ID NO: 17479 - DNA, 20 bp, synthetic construct
  source 1..20: mol_type = other DNA
ggctgaaccgcccggctgag

SEQ ID NO: 17480 - DNA, 20 bp, synthetic construct
  source 1..20: mol_type = other DNA
ccgtggcggggatgctgcga

SEQ ID NO: 17481 - DNA, 20 bp, synthetic construct
  source 1..20: mol_type = other DNA
ccctcggctgctgcagggat

SEQ ID NO: 17482 - DNA, 20 bp, synthetic construct
  source 1..20: mol_type = other DNA
gagctactgagggtctaagt

SEQ ID NO: 17483 - DNA, 20 bp, synthetic construct
  source 1..20: mol_type = other DNA
cggcggagagtgcggcatgc

SEQ ID NO: 17484 - DNA, 20 bp, synthetic construct
  source 1..20: mol_type = other DNA
tgaagctccctgtggcctgg

SEQ ID NO: 17485 - DNA, 20 bp, synthetic construct
  source 1..20: mol_type = other DNA
cgcagggagctggatggaga

SEQ ID NO: 17486 - DNA, 20 bp, synthetic construct
  source 1..20: mol_type = other DNA
gcgacccggcctcctagggg

SEQ ID NO: 17487 - DNA, 20 bp, synthetic construct
  source 1..20: mol_type = other DNA
gtcgtggtccagacagttta

SEQ ID NO: 17488 - DNA, 20 bp, synthetic construct
  source 1..20: mol_type = other DNA
gacaggaagcactttggtcc

SEQ ID NO: 17489 - DNA, 20 bp, synthetic construct
  source 1..20: mol_type = other DNA
agctgactcctgctgggccc

SEQ ID NO: 17490 - DNA, 20 bp, synthetic construct
  source 1..20: mol_type = other DNA
tagccgctgcctcctcctac

SEQ ID NO: 17491 - DNA, 20 bp, synthetic construct
  source 1..20: mol_type = other DNA
ctttttctcccgaaggaaga

SEQ ID NO: 17492 - DNA, 20 bp, synthetic construct
  source 1..20: mol_type = other DNA
gcgactctgtactccctgct

SEQ ID NO: 17493 - DNA, 20 bp, synthetic construct
  source 1..20: mol_type = other DNA
aactgtcatcgataggaata

SEQ ID NO: 17494 - DNA, 20 bp, synthetic construct
  source 1..20: mol_type = other DNA
caggctgagtgctgcggcgc

SEQ ID NO: 17495 - DNA, 20 bp, synthetic construct
  source 1..20: mol_type = other DNA
cggggagagcaggggttctg

SEQ ID NO: 17496 - DNA, 20 bp, synthetic construct
  source 1..20: mol_type = other DNA
ctcgccgtcggctctacctg

SEQ ID NO: 17497 - DNA, 20 bp, synthetic construct
  source 1..20: mol_type = other DNA
aggggaggagccgggtccac

SEQ ID NO: 17498 - DNA, 20 bp, synthetic construct
  source 1..20: mol_type = other DNA
gaggtgcaggtcgaagaggc

SEQ ID NO: 17499 - DNA, 20 bp, synthetic construct
  source 1..20: mol_type = other DNA
tccgaagcatggcgccggcg

SEQ ID NO: 17500 - DNA, 20 bp, synthetic construct
  source 1..20: mol_type = other DNA
gccactgtccggccacagcc

SEQ ID NO: 17501 - DNA, 20 bp, synthetic construct
  source 1..20: mol_type = other DNA
cttgggggatcgccgcggct

SEQ ID NO: 17502 - DNA, 20 bp, synthetic construct
  source 1..20: mol_type = other DNA
ttaaagtgcttccgcatggt

SEQ ID NO: 17503 - DNA, 20 bp, synthetic construct
  source 1..20: mol_type = other DNA
cagctctgctgagagagtgc

SEQ ID NO: 17504 - DNA, 20 bp, synthetic construct
  source 1..20: mol_type = other DNA
tccagctccagggacctgtc

SEQ ID NO: 17505 - DNA, 20 bp, synthetic construct
  source 1..20: mol_type = other DNA
tccctgcaacccggccggcg

SEQ ID NO: 17506 - DNA, 20 bp, synthetic construct
  source 1..20: mol_type = other DNA
caagactcccgtagtcccca

SEQ ID NO: 17507 - DNA, 20 bp, synthetic construct
  source 1..20: mol_type = other DNA
gtacaattggctgaggcgct

SEQ ID NO: 17508 - DNA, 20 bp, synthetic construct
  source 1..20: mol_type = other DNA
accagggcgcatgcgtaaca

SEQ ID NO: 17509 - DNA, 20 bp, synthetic construct
  source 1..20: mol_type = other DNA
ccggtgtacttcagtttccg

SEQ ID NO: 17510 - DNA, 20 bp, synthetic construct
  source 1..20: mol_type = other DNA
cgcgtcgactgcccagagtc

SEQ ID NO: 17511 - DNA, 20 bp, synthetic construct
  source 1..20: mol_type = other DNA
tttggggttgtccctggact

SEQ ID NO: 17512 - DNA, 20 bp, synthetic construct
  source 1..20: mol_type = other DNA
tgcagcccgttcgctcacac

SEQ ID NO: 17513 - DNA, 20 bp, synthetic construct
  source 1..20: mol_type = other DNA
gtcccggcatcggccaagat

SEQ ID NO: 17514 - DNA, 20 bp, synthetic construct
  source 1..20: mol_type = other DNA
acgctctgtccctgcgtgac

SEQ ID NO: 17515 - DNA, 20 bp, synthetic construct
  source 1..20: mol_type = other DNA
cgggcggcggtgaccccggc

SEQ ID NO: 17516 - DNA, 20 bp, synthetic construct
  source 1..20: mol_type = other DNA
ccgcacgggggccgcggcca

SEQ ID NO: 17517 - DNA, 20 bp, synthetic construct
  source 1..20: mol_type = other DNA
ggcctttcctaggaggtaac

SEQ ID NO: 17518 - DNA, 20 bp, synthetic construct
  source 1..20: mol_type = other DNA
ggacgccatggtaagcgcgg

SEQ ID NO: 17519 - DNA, 20 bp, synthetic construct
  source 1..20: mol_type = other DNA
ttaccggcggattaagctcg

SEQ ID NO: 17520 - DNA, 20 bp, synthetic construct
  source 1..20: mol_type = other DNA
tgtcgaaggaccaaaggcga

SEQ ID NO: 17521 - DNA, 20 bp, synthetic construct
  source 1..20: mol_type = other DNA
tggagcgcggcggaggtgag

SEQ ID NO: 17522 - DNA, 20 bp, synthetic construct
  source 1..20: mol_type = other DNA
tcaaccctcccggaagtgag

SEQ ID NO: 17523 - DNA, 20 bp, synthetic construct
  source 1..20: mol_type = other DNA
agaaatgaatgaaatgaaat

SEQ ID NO: 17524 - DNA, 20 bp, synthetic construct
  source 1..20: mol_type = other DNA
aagaagctgctgacatcctg

SEQ ID NO: 17525 - DNA, 20 bp, synthetic construct
  source 1..20: mol_type = other DNA
gccgcagtgacccagtaatg

SEQ ID NO: 17526 - DNA, 20 bp, synthetic construct
  source 1..20: mol_type = other DNA
tccggcgccagctacgccgc

SEQ ID NO: 17527 - DNA, 20 bp, synthetic construct
  source 1..20: mol_type = other DNA
gcgcttccctggtcaggcac

SEQ ID NO: 17528 - DNA, 20 bp, synthetic construct
  source 1..20: mol_type = other DNA
tagtttgcggcatcctgtgg

SEQ ID NO: 17529 - DNA, 20 bp, synthetic construct
  source 1..20: mol_type = other DNA
ggcagagaaacagctggaaa

SEQ ID NO: 17530 - DNA, 20 bp, synthetic construct
  source 1..20: mol_type = other DNA
aggcggtcagcctgcagcat

SEQ ID NO: 17531 - DNA, 20 bp, synthetic construct
  source 1..20: mol_type = other DNA
atcttcgggctgtcagagtt

SEQ ID NO: 17532 - DNA, 20 bp, synthetic construct
  source 1..20: mol_type = other DNA
ccgcggaagatgagcagcag

SEQ ID NO: 17533 - DNA, 20 bp, synthetic construct
  source 1..20: mol_type = other DNA
agcggcctggcgtcggcgct

SEQ ID NO: 17534 - DNA, 20 bp, synthetic construct
  source 1..20: mol_type = other DNA
cggcggtggtggctgagtcc

SEQ ID NO: 17535 - DNA, 20 bp, synthetic construct
  source 1..20: mol_type = other DNA
tgccacctccctctttcttc

SEQ ID NO: 17536 - DNA, 20 bp, synthetic construct
  source 1..20: mol_type = other DNA
gtgccctaggctcggccggc

SEQ ID NO: 17537 - DNA, 20 bp, synthetic construct
  source 1..20: mol_type = other DNA
ggcctctctgagcccggctt

SEQ ID NO: 17538 - DNA, 20 bp, synthetic construct
  source 1..20: mol_type = other DNA
ccgagctgcatcttagggag

SEQ ID NO: 17539 - DNA, 20 bp, synthetic construct
  source 1..20: mol_type = other DNA
aaaacgagtttttcacgact

SEQ ID NO: 17540 - DNA, 20 bp, synthetic construct
  source 1..20: mol_type = other DNA
ctggcggccgggtaagggtc

SEQ ID NO: 17541 - DNA, 20 bp, synthetic construct
  source 1..20: mol_type = other DNA
gccggccctgcgcctcccgc

SEQ ID NO: 17542 - DNA, 20 bp, synthetic construct
  source 1..20: mol_type = other DNA
cggtgcgggagaggggttgg

SEQ ID NO: 17543 - DNA, 20 bp, synthetic construct
  source 1..20: mol_type = other DNA
tggcctggagggagacctcg

SEQ ID NO: 17544 - DNA, 20 bp, synthetic construct
  source 1..20: mol_type = other DNA
cactcaccgccgctggggga

SEQ ID NO: 17545 - DNA, 20 bp, synthetic construct
  source 1..20: mol_type = other DNA
aagccccgggaccgccccgc

SEQ ID NO: 17546 - DNA, 20 bp, synthetic construct
  source 1..20: mol_type = other DNA
gaggctccatctccattctg

SEQ ID NO: 17547 - DNA, 20 bp, synthetic construct
  source 1..20: mol_type = other DNA
gtcccccagagtctccaact

SEQ ID NO: 17548 - DNA, 20 bp, synthetic construct
  source 1..20: mol_type = other DNA
gcaggggtggttggtgtcaa

SEQ ID NO: 17549 - DNA, 20 bp, synthetic construct
  source 1..20: mol_type = other DNA
gaggtgctgtgcaggaggcg

SEQ ID NO: 17550 - DNA, 20 bp, synthetic construct
  source 1..20: mol_type = other DNA
aaggggtcctccctgcgcca

SEQ ID NO: 17551 - DNA, 20 bp, synthetic construct
  source 1..20: mol_type = other DNA
ttgctgaggaggcggattag

SEQ ID NO: 17552 - DNA, 20 bp, synthetic construct
  source 1..20: mol_type = other DNA
tccccctcatttgcagatgc

SEQ ID NO: 17553 - DNA, 20 bp, synthetic construct
  source 1..20: mol_type = other DNA
tggcggcagtggcgtcactt

SEQ ID NO: 17554 - DNA, 20 bp, synthetic construct
  source 1..20: mol_type = other DNA
gtttcctgccagtcgggagg

SEQ ID NO: 17555 - DNA, 20 bp, synthetic construct
  source 1..20: mol_type = other DNA
cgtattgagaggagatacac

SEQ ID NO: 17556 - DNA, 20 bp, synthetic construct
  source 1..20: mol_type = other DNA
actccggccttccctgccct

SEQ ID NO: 17557 - DNA, 20 bp, synthetic construct
  source 1..20: mol_type = other DNA
agttcgacggtaaacgaccc

SEQ ID NO: 17558 - DNA, 20 bp, synthetic construct
  source 1..20: mol_type = other DNA
cccccgggggaggccatgaa

SEQ ID NO: 17559 - DNA, 20 bp, synthetic construct
  source 1..20: mol_type = other DNA
attcgaagctacttcacagt

SEQ ID NO: 17560 - DNA, 20 bp, synthetic construct
  source 1..20: mol_type = other DNA
gtgcacatggggtgttggag

SEQ ID NO: 17561 - DNA, 20 bp, synthetic construct
  source 1..20: mol_type = other DNA
agagctggggtcgtggcggc

SEQ ID NO: 17562 - DNA, 20 bp, synthetic construct
  source 1..20: mol_type = other DNA
gggtgaggagctggtggcgt

SEQ ID NO: 17563 - DNA, 20 bp, synthetic construct
  source 1..20: mol_type = other DNA
accctagtgacaggagccga

SEQ ID NO: 17564 - DNA, 20 bp, synthetic construct
  source 1..20: mol_type = other DNA
gaggcagcggagacagaggc

SEQ ID NO: 17565 - DNA, 20 bp, synthetic construct
  source 1..20: mol_type = other DNA
gcacgcagtccgacttggcc

SEQ ID NO: 17566 - DNA, 20 bp, synthetic construct
  source 1..20: mol_type = other DNA
gcgacccccgggcggggcca

SEQ ID NO: 17567 - DNA, 20 bp, synthetic construct
  source 1..20: mol_type = other DNA
agagccggagccgtggcctg

SEQ ID NO: 17568 - DNA, 20 bp, synthetic construct
  source 1..20: mol_type = other DNA
caagcgccggcgttctctgc

SEQ ID NO: 17569 - DNA, 20 bp, synthetic construct
  source 1..20: mol_type = other DNA
tgggcagagggattggcaag

SEQ ID NO: 17570 - DNA, 20 bp, synthetic construct
  source 1..20: mol_type = other DNA
ggcgcagtaaacagtctcct

SEQ ID NO: 17571 - DNA, 20 bp, synthetic construct
  source 1..20: mol_type = other DNA
tttgggattctggaattcga

SEQ ID NO: 17572 - DNA, 20 bp, synthetic construct
  source 1..20: mol_type = other DNA
ttgagtcgggcaaggaagag

SEQ ID NO: 17573 - DNA, 20 bp, synthetic construct
  source 1..20: mol_type = other DNA
cctttgtcaagtcatcccct

SEQ ID NO: 17574 - DNA, 20 bp, synthetic construct
  source 1..20: mol_type = other DNA
gatcctgaggaggcagctgc

SEQ ID NO: 17575 - DNA, 20 bp, synthetic construct
  source 1..20: mol_type = other DNA
ccgggagcggcggcggccat

SEQ ID NO: 17576 - DNA, 20 bp, synthetic construct
  source 1..20: mol_type = other DNA
aggagcatcagaccacagat

SEQ ID NO: 17577 - DNA, 20 bp, synthetic construct
  source 1..20: mol_type = other DNA
cgtccctcgcacacgcagag

SEQ ID NO: 17578 - DNA, 20 bp, synthetic construct
  source 1..20: mol_type = other DNA
gcgagctagccagcaggcat

SEQ ID NO: 17579 - DNA, 20 bp, synthetic construct
  source 1..20: mol_type = other DNA
ggggcgggccacagtctcca

SEQ ID NO: 17580 - DNA, 20 bp, synthetic construct
  source 1..20: mol_type = other DNA
tcggaagcctaggaggctgg

SEQ ID NO: 17581 - DNA, 20 bp, synthetic construct
  source 1..20: mol_type = other DNA
ggagcctctagaactatgag

SEQ ID NO: 17582 - DNA, 20 bp, synthetic construct
  source 1..20: mol_type = other DNA
attgcctattggcctgtgct

SEQ ID NO: 17583 - DNA, 20 bp, synthetic construct
  source 1..20: mol_type = other DNA
ctgaaataacagaagctgtg

SEQ ID NO: 17584 - DNA, 20 bp, synthetic construct
  source 1..20: mol_type = other DNA
gtcactgcgccggggtagtg

SEQ ID NO: 17585 - DNA, 20 bp, synthetic construct
  source 1..20: mol_type = other DNA
cgtaagtccctctcgtgcgc

SEQ ID NO: 17586 - DNA, 20 bp, synthetic construct
  source 1..20: mol_type = other DNA
gcgtccctctctccacgagg

SEQ ID NO: 17587 - DNA, 20 bp, synthetic construct
  source 1..20: mol_type = other DNA
ctggagccagactgtggtct

SEQ ID NO: 17588 - DNA, 20 bp, synthetic construct
  source 1..20: mol_type = other DNA
gcctcagtctccccagctct

SEQ ID NO: 17589 - DNA, 20 bp, synthetic construct
  source 1..20: mol_type = other DNA
cctttgccccctcacacctc

SEQ ID NO: 17590 - DNA, 20 bp, synthetic construct
  source 1..20: mol_type = other DNA
agcctggacccttagcggtg

SEQ ID NO: 17591 - DNA, 20 bp, synthetic construct
  source 1..20: mol_type = other DNA
aaccaattagtgacaacact

SEQ ID NO: 17592 - DNA, 20 bp, synthetic construct
  source 1..20: mol_type = other DNA
caggactttagccggttgag

SEQ ID NO: 17593 - DNA, 20 bp, synthetic construct
  source 1..20: mol_type = other DNA
tggacttgcagaccggaatg

SEQ ID NO: 17594 - DNA, 20 bp, synthetic construct
  source 1..20: mol_type = other DNA
caacccactttccgcgggga

SEQ ID NO: 17595 - DNA, 20 bp, synthetic construct
  source 1..20: mol_type = other DNA
tgctccccgcgccaccctcc

SEQ ID NO: 17596 - DNA, 20 bp, synthetic construct
  source 1..20: mol_type = other DNA
actgcagcccagtgctgaat

SEQ ID NO: 17597 - DNA, 20 bp, synthetic construct
  source 1..20: mol_type = other DNA
taaaggcttgtctttcccct

SEQ ID NO: 17598 - DNA, 20 bp, synthetic construct
  source 1..20: mol_type = other DNA
ctgagtgactgccaaggaag

SEQ ID NO: 17599 - DNA, 20 bp, synthetic construct
  source 1..20: mol_type = other DNA
ctctcggcgctcactgctct

SEQ ID NO: 17600 - DNA, 20 bp, synthetic construct
  source 1..20: mol_type = other DNA
ccggcgggcccagtgttgga

SEQ ID NO: 17601 - DNA, 20 bp, synthetic construct
  source 1..20: mol_type = other DNA
cagcccaaaagggcccggtc

SEQ ID NO: 17602 - DNA, 20 bp, synthetic construct
  source 1..20: mol_type = other DNA
caggtctctgacttcgggct

SEQ ID NO: 17603 - DNA, 20 bp, synthetic construct
  source 1..20: mol_type = other DNA
tttgccgggtgcttcagatc

SEQ ID NO: 17604 - DNA, 20 bp, synthetic construct
  source 1..20: mol_type = other DNA
cctcgccagccaggtgctcg

SEQ ID NO: 17605 - DNA, 20 bp, synthetic construct
  source 1..20: mol_type = other DNA
actgtgaaccaggagtgagt

SEQ ID NO: 17606 - DNA, 20 bp, synthetic construct
  source 1..20: mol_type = other DNA
tagtcgaccgtgtccgcgcg

SEQ ID NO: 17607 - DNA, 20 bp, synthetic construct
  source 1..20: mol_type = other DNA
cttctttgcggctcggccat

SEQ ID NO: 17608 - DNA, 20 bp, synthetic construct
  source 1..20: mol_type = other DNA
tctccagtcctgacgacacc

SEQ ID NO: 17609 - DNA, 20 bp, synthetic construct
  source 1..20: mol_type = other DNA
tcgcaagctgaaaatcttgc

SEQ ID NO: 17610 - DNA, 20 bp, synthetic construct
  source 1..20: mol_type = other DNA
ttccctcttgtcgcccaggc

SEQ ID NO: 17611 - DNA, 20 bp, synthetic construct
  source 1..20: mol_type = other DNA
cccgcggtggcgggggttgg

SEQ ID NO: 17612 - DNA, 20 bp, synthetic construct
  source 1..20: mol_type = other DNA
aattttatttcagggtaaac

SEQ ID NO: 17613 - DNA, 20 bp, synthetic construct
  source 1..20: mol_type = other DNA
agaagcttataaaatagctt

SEQ ID NO: 17614 - DNA, 20 bp, synthetic construct
  source 1..20: mol_type = other DNA
cgggcggcggctgtgttgcg

SEQ ID NO: 17615 - DNA, 20 bp, synthetic construct
  source 1..20: mol_type = other DNA
ggagccagcgcggagcacct

SEQ ID NO: 17616 - DNA, 20 bp, synthetic construct
  source 1..20: mol_type = other DNA
gggagggagagagagcgcgc

SEQ ID NO: 17617 - DNA, 20 bp, synthetic construct
  source 1..20: mol_type = other DNA
cccttgcttaaaaaatttta

SEQ ID NO: 17618 - DNA, 20 bp, synthetic construct
  source 1..20: mol_type = other DNA
agatggcagccccgggggac

SEQ ID NO: 17619 - DNA, 20 bp, synthetic construct
  source 1..20: mol_type = other DNA
tcccgcaacccgataccatc

SEQ ID NO: 17620 - DNA, 20 bp, synthetic construct
  source 1..20: mol_type = other DNA
cctccaccgggccttgcagg

SEQ ID NO: 17621 - DNA, 20 bp, synthetic construct
  source 1..20: mol_type = other DNA
tgacccccgagaaggaggct

SEQ ID NO: 17622 - DNA, 20 bp, synthetic construct
  source 1..20: mol_type = other DNA
accccttcctcgggtttagg

SEQ ID NO: 17623 - DNA, 20 bp, synthetic construct
  source 1..20: mol_type = other DNA
ggcctgaggctgctcccgga

SEQ ID NO: 17624 - DNA, 20 bp, synthetic construct
  source 1..20: mol_type = other DNA
cccgaccgcattttacgtgg

SEQ ID NO: 17625 - DNA, 20 bp, synthetic construct
  source 1..20: mol_type = other DNA
ctcctctcagatttgtgtgc

SEQ ID NO: 17626 - DNA, 20 bp, synthetic construct
  source 1..20: mol_type = other DNA
ctgctttcatgccctttctt

SEQ ID NO: 17627 - DNA, 20 bp, synthetic construct
  source 1..20: mol_type = other DNA
gcgctggccagagatgcctg

SEQ ID NO: 17628 - DNA, 20 bp, synthetic construct
  source 1..20: mol_type = other DNA
tactgggattctctgaccga

SEQ ID NO: 17629 - DNA, 20 bp, synthetic construct
  source 1..20: mol_type = other DNA
ccctgctttctgcattcttc

SEQ ID NO: 17630 - DNA, 20 bp, synthetic construct
  source 1..20: mol_type = other DNA
gttagcccgtcagtccctgc

SEQ ID NO: 17631 - DNA, 20 bp, synthetic construct
  source 1..20: mol_type = other DNA
gcgacactatccgtgcggcc

SEQ ID NO: 17632 - DNA, 20 bp, synthetic construct
  source 1..20: mol_type = other DNA
ggcggcgacctggtcgcaag

SEQ ID NO: 17633 - DNA, 20 bp, synthetic construct
  source 1..20: mol_type = other DNA
ctgctgtttctcagacagca

SEQ ID NO: 17634 - DNA, 20 bp, synthetic construct
  source 1..20: mol_type = other DNA
caggcggttgcgttccccgt

SEQ ID NO: 17635 - DNA, 20 bp, synthetic construct
  source 1..20: mol_type = other DNA
gcgtcgcgccctggggccgg

SEQ ID NO: 17636 - DNA, 20 bp, synthetic construct
  source 1..20: mol_type = other DNA
gagtggaatggccgcgggcg

SEQ ID NO: 17637 - DNA, 20 bp, synthetic construct
  source 1..20: mol_type = other DNA
gctgtctccctcggcctgtg

SEQ ID NO: 17638 - DNA, 20 bp, synthetic construct
  source 1..20: mol_type = other DNA
cgcttccgcccgctgtcctg

SEQ ID NO: 17639 - DNA, 20 bp, synthetic construct
  source 1..20: mol_type = other DNA
ggaggatatacctttttttc

SEQ ID NO: 17640 - DNA, 20 bp, synthetic construct
  source 1..20: mol_type = other DNA
cgagtccgaccccgcccttc

SEQ ID NO: 17641 - DNA, 20 bp, synthetic construct
  source 1..20: mol_type = other DNA
ggtgcttgcgtgtggtggtg

SEQ ID NO: 17642 - DNA, 20 bp, synthetic construct
  source 1..20: mol_type = other DNA
gaagacttacaggcagagag

SEQ ID NO: 17643 - DNA, 20 bp, synthetic construct
  source 1..20: mol_type = other DNA
actaatggaagaaatctgct

SEQ ID NO: 17644 - DNA, 20 bp, synthetic construct
  source 1..20: mol_type = other DNA
ccccgagaagccgtccagga

SEQ ID NO: 17645 - DNA, 20 bp, synthetic construct
  source 1..20: mol_type = other DNA
ctgagaagtaaatggtattt

SEQ ID NO: 17646 - DNA, 20 bp, synthetic construct
  source 1..20: mol_type = other DNA
aagcgagccgggctacgggg

SEQ ID NO: 17647 - DNA, 20 bp, synthetic construct
  source 1..20: mol_type = other DNA
tctcgggagatgcaggatgt

SEQ ID NO: 17648 - DNA, 20 bp, synthetic construct
  source 1..20: mol_type = other DNA
ttggcatcgccactctgggc

SEQ ID NO: 17649 - DNA, 20 bp, synthetic construct
  source 1..20: mol_type = other DNA
gtaacggcttggtaattatg

SEQ ID NO: 17650 - DNA, 20 bp, synthetic construct
  source 1..20: mol_type = other DNA
cccaaggggttttaggaaag

SEQ ID NO: 17651 - DNA, 20 bp, synthetic construct
  source 1..20: mol_type = other DNA
gggccggccttcaagcaaga

SEQ ID NO: 17652 - DNA, 20 bp, synthetic construct
  source 1..20: mol_type = other DNA
tcctaagcttctggcaagta

SEQ ID NO: 17653 - DNA, 20 bp, synthetic construct
  source 1..20: mol_type = other DNA
gaagcctgcgagttccggaa

SEQ ID NO: 17654 - DNA, 20 bp, synthetic construct
  source 1..20: mol_type = other DNA
ctcggcgctcgggttacccc

SEQ ID NO: 17655 - DNA, 20 bp, synthetic construct
  source 1..20: mol_type = other DNA
gcccttctccgagctgtgcg

SEQ ID NO: 17656 - DNA, 20 bp, synthetic construct
  source 1..20: mol_type = other DNA
tgtgacggcgcgtttctatt

SEQ ID NO: 17657 - DNA, 20 bp, synthetic construct
  source 1..20: mol_type = other DNA
gatggcggcctcatgcttgg

SEQ ID NO: 17658 - DNA, 20 bp, synthetic construct
  source 1..20: mol_type = other DNA
cgcgcccctagaacgctttg

SEQ ID NO: 17659 - DNA, 20 bp, synthetic construct
  source 1..20: mol_type = other DNA
aaacagaaattccaccagcc

SEQ ID NO: 17660 - DNA, 20 bp, synthetic construct
  source 1..20: mol_type = other DNA
gggtccctgagcctcagctg

SEQ ID NO: 17661 - DNA, 20 bp, synthetic construct
  source 1..20: mol_type = other DNA
catgaggggtgacagaggcc

SEQ ID NO: 17662 - DNA, 20 bp, synthetic construct
  source 1..20: mol_type = other DNA
cggtggaaccgaggagaacg

SEQ ID NO: 17663 - DNA, 20 bp, synthetic construct
  source 1..20: mol_type = other DNA
ccctcccgggctgcggctgc

SEQ ID NO: 17664 - DNA, 20 bp, synthetic construct
  source 1..20: mol_type = other DNA
ccagcagcggcagcgggagc

SEQ ID NO: 17665 - DNA, 20 bp, synthetic construct
  source 1..20: mol_type = other DNA
cccttagtgagctgtatttt

SEQ ID NO: 17666 - DNA, 20 bp, synthetic construct
  source 1..20: mol_type = other DNA
gcgattctctgctgccagag

SEQ ID NO: 17667 - DNA, 20 bp, synthetic construct
  source 1..20: mol_type = other DNA
ggttttgctcagattggtgt

SEQ ID NO: 17668 - DNA, 20 bp, synthetic construct
  source 1..20: mol_type = other DNA
cagggaactaccttgagtat

SEQ ID NO: 17669 - DNA, 20 bp, synthetic construct
  source 1..20: mol_type = other DNA
ctccctttctcctcctcctc

SEQ ID NO: 17670 - DNA, 20 bp, synthetic construct
  source 1..20: mol_type = other DNA
gtgacttcccccaaccgcag

SEQ ID NO: 17671 - DNA, 20 bp, synthetic construct
  source 1..20: mol_type = other DNA
tcacagctgctgttgtctgc

SEQ ID NO: 17672 - DNA, 20 bp, synthetic construct
  source 1..20: mol_type = other DNA
ctgggacgggggaaaggaga

SEQ ID NO: 17673 - DNA, 20 bp, synthetic construct
  source 1..20: mol_type = other DNA
gggagtgtctgggcgctcag

SEQ ID NO: 17674 - DNA, 20 bp, synthetic construct
  source 1..20: mol_type = other DNA
gggactgccagtgtgtggag

SEQ ID NO: 17675 - DNA, 20 bp, synthetic construct
  source 1..20: mol_type = other DNA
ccttccgggtcactgccatg

SEQ ID NO: 17676 - DNA, 20 bp, synthetic construct
  source 1..20: mol_type = other DNA
tcctgcctggattccacagc

SEQ ID NO: 17677 - DNA, 20 bp, synthetic construct
  source 1..20: mol_type = other DNA
tggtgatcactaggtgccaa

SEQ ID NO: 17678 - DNA, 20 bp, synthetic construct
  source 1..20: mol_type = other DNA
cagatctcgcgaggttcagg

SEQ ID NO: 17679 - DNA, 20 bp, synthetic construct
  source 1..20: mol_type = other DNA
gcggtagtgacggtggcgtt

SEQ ID NO: 17680 - DNA, 20 bp, synthetic construct
  source 1..20: mol_type = other DNA
tctcggaacgcgccgcagaa

SEQ ID NO: 17681 - DNA, 20 bp, synthetic construct
  source 1..20: mol_type = other DNA
caagtttagggaagtgaaag

SEQ ID NO: 17682 - DNA, 20 bp, synthetic construct
  source 1..20: mol_type = other DNA
caatcttcgctcctccaatc

SEQ ID NO: 17683 - DNA, 20 bp, synthetic construct
  source 1..20: mol_type = other DNA
ccatcatggcggatcaaggt

SEQ ID NO: 17684 - DNA, 20 bp, synthetic construct
  source 1..20: mol_type = other DNA
cgcgccggagcgggaccgac

SEQ ID NO: 17685 - DNA, 20 bp, synthetic construct
  source 1..20: mol_type = other DNA
acccacataaaatctacgag

SEQ ID NO: 17686 - DNA, 20 bp, synthetic construct
  source 1..20: mol_type = other DNA
tctccaggagcaacctctac

SEQ ID NO: 17687 - DNA, 20 bp, synthetic construct
  source 1..20: mol_type = other DNA
acagaatggctgcacattaa

SEQ ID NO: 17688 - DNA, 20 bp, synthetic construct
  source 1..20: mol_type = other DNA
cccgggtctcggacaggcgg

SEQ ID NO: 17689 - DNA, 20 bp, synthetic construct
  source 1..20: mol_type = other DNA
cctcgggagtaaatatcttc

SEQ ID NO: 17690 - DNA, 20 bp, synthetic construct
  source 1..20: mol_type = other DNA
tgcaagcctagttccaaccc

SEQ ID NO: 17691 - DNA, 20 bp, synthetic construct
  source 1..20: mol_type = other DNA
gccttgtctacctcttgccc

SEQ ID NO: 17692 - DNA, 20 bp, synthetic construct
  source 1..20: mol_type = other DNA
ttcccttccgcccccttctc

SEQ ID NO: 17693 - DNA, 20 bp, synthetic construct
  source 1..20: mol_type = other DNA
cggagtgttggtgagtgacg

SEQ ID NO: 17694 - DNA, 20 bp, synthetic construct
  source 1..20: mol_type = other DNA
gactctatatatacagaggg

SEQ ID NO: 17695 - DNA, 20 bp, synthetic construct
  source 1..20: mol_type = other DNA
gagggagcttcctagctggg

SEQ ID NO: 17696 - DNA, 20 bp, synthetic construct
  source 1..20: mol_type = other DNA
cccgggaggagagggcggag

SEQ ID NO: 17697 - DNA, 20 bp, synthetic construct
  source 1..20: mol_type = other DNA
ggacgggagccggaccctgg

SEQ ID NO: 17698 - DNA, 20 bp, synthetic construct
  source 1..20: mol_type = other DNA
acctcccccagaggctgcag

SEQ ID NO: 17699 - DNA, 20 bp, synthetic construct
  source 1..20: mol_type = other DNA
cccggacatgatggcacatg

SEQ ID NO: 17700 - DNA, 20 bp, synthetic construct
  source 1..20: mol_type = other DNA
gggcacgacgagaaagtccg

SEQ ID NO: 17701 - DNA, 20 bp, synthetic construct
  source 1..20: mol_type = other DNA
gcacacagagcaccagctcc

SEQ ID NO: 17702 - DNA, 20 bp, synthetic construct
  source 1..20: mol_type = other DNA
ctcccagggcgatgcaaagc

SEQ ID NO: 17703 - DNA, 20 bp, synthetic construct
  source 1..20: mol_type = other DNA
agcggagagcaaagtgggct

SEQ ID NO: 17704 - DNA, 20 bp, synthetic construct
  source 1..20: mol_type = other DNA
accctgtgcagccaggagcc

SEQ ID NO: 17705 - DNA, 20 bp, synthetic construct
  source 1..20: mol_type = other DNA
tcatgctcgcttcacggagg

SEQ ID NO: 17706 - DNA, 20 bp, synthetic construct
  source 1..20: mol_type = other DNA
ggacagggaagggttaaagg

SEQ ID NO: 17707 - DNA, 20 bp, synthetic construct
  source 1..20: mol_type = other DNA
ttctcggagagcacggaact

SEQ ID NO: 17708 - DNA, 20 bp, synthetic construct
  source 1..20: mol_type = other DNA
cacgcctgccaggagcaagc

SEQ ID NO: 17709 - DNA, 20 bp, synthetic construct
  source 1..20: mol_type = other DNA
ggcaatggggaactctgagg

SEQ ID NO: 17710 - DNA, 20 bp, synthetic construct
  source 1..20: mol_type = other DNA
cacagacatctcctttcccg

SEQ ID NO: 17711 - DNA, 20 bp, synthetic construct
  source 1..20: mol_type = other DNA
ctgtaggacgacctcgggtc

SEQ ID NO: 17712 - DNA, 20 bp, synthetic construct
  source 1..20: mol_type = other DNA
taacggcaatgcggctgcaa

SEQ ID NO: 17713 - DNA, 20 bp, synthetic construct
  source 1..20: mol_type = other DNA
ccagcatcttggcctctgtg

SEQ ID NO: 17714 - DNA, 20 bp, synthetic construct
  source 1..20: mol_type = other DNA
gatagctgcttggtctgaag

SEQ ID NO: 17715 - DNA, 20 bp, synthetic construct
  source 1..20: mol_type = other DNA
aggaggagatcatcgagctc

SEQ ID NO: 17716 - DNA, 20 bp, synthetic construct
  source 1..20: mol_type = other DNA
gtcagcagaagagataaaag

SEQ ID NO: 17717 - DNA, 20 bp, synthetic construct
  source 1..20: mol_type = other DNA
tcaggctccgtgctgttgga

SEQ ID NO: 17718 - DNA, 20 bp, synthetic construct
  source 1..20: mol_type = other DNA
gaagaaggcaggggccctta

SEQ ID NO: 17719 - DNA, 20 bp, synthetic construct
  source 1..20: mol_type = other DNA
acggccctgaccgcccgcgg

SEQ ID NO: 17720 - DNA, 20 bp, synthetic construct
  source 1..20: mol_type = other DNA
ggcgccgacatcgcgacagc

SEQ ID NO: 17721 - DNA, 20 bp, synthetic construct
  source 1..20: mol_type = other DNA
cccgggtgctactttatggg

SEQ ID NO: 17722 - DNA, 20 bp, synthetic construct
  source 1..20: mol_type = other DNA
ataagtaatgactttcagtg

SEQ ID NO: 17723 - DNA, 20 bp, synthetic construct
  source 1..20: mol_type = other DNA
cctcgcagctcgcattcgga

SEQ ID NO: 17724 - DNA, 20 bp, synthetic construct
  source 1..20: mol_type = other DNA
acccctcggtggagataaag

SEQ ID NO: 17725 - DNA, 20 bp, synthetic construct
  source 1..20: mol_type = other DNA
tgtcgctgaagcagatgagt

SEQ ID NO: 17726 - DNA, 20 bp, synthetic construct
  source 1..20: mol_type = other DNA
gcgtagcgccagggcctgag

SEQ ID NO: 17727 - DNA, 20 bp, synthetic construct
  source 1..20: mol_type = other DNA
gctgggcggatggagcagga

SEQ ID NO: 17728 - DNA, 20 bp, synthetic construct
  source 1..20: mol_type = other DNA
ccgggaagatggcggccgtg

SEQ ID NO: 17729 - DNA, 20 bp, synthetic construct
  source 1..20: mol_type = other DNA
gtggggtacgagcttcctgc

SEQ ID NO: 17730 - DNA, 20 bp, synthetic construct
  source 1..20: mol_type = other DNA
gtccagagtccagggactcg

SEQ ID NO: 17731 - DNA, 20 bp, synthetic construct
  source 1..20: mol_type = other DNA
ggagagactaccgtcctgga

SEQ ID NO: 17732 - DNA, 20 bp, synthetic construct
  source 1..20: mol_type = other DNA
cccagcaaagagcaacacag

SEQ ID NO: 17733 - DNA, 20 bp, synthetic construct
  source 1..20: mol_type = other DNA
ctgatttttagaactccaca

SEQ ID NO: 17734 - DNA, 20 bp, synthetic construct
  source 1..20: mol_type = other DNA
aaaaatcaactgccctgctg

SEQ ID NO: 17735 - DNA, 20 bp, synthetic construct
  source 1..20: mol_type = other DNA
ctatcgcctccctctagtct

SEQ ID NO: 17736 - DNA, 20 bp, synthetic construct
  source 1..20: mol_type = other DNA
taaatgaacttgtctggttt

SEQ ID NO: 17737 - DNA, 20 bp, synthetic construct
  source 1..20: mol_type = other DNA
gggtgaccttggttaatatt

SEQ ID NO: 17738 - DNA, 20 bp, synthetic construct
  source 1..20: mol_type = other DNA
gcgggccgcgcggcgcattt

SEQ ID NO: 17739 - DNA, 20 bp, synthetic construct
  source 1..20: mol_type = other DNA
gaggggcggcaacctcctgc

SEQ ID NO: 17740 - DNA, 20 bp, synthetic construct
  source 1..20: mol_type = other DNA
ctgctgctgctcactcagtt

SEQ ID NO: 17741 - DNA, 20 bp, synthetic construct
  source 1..20: mol_type = other DNA
ttctgagccaggtacaatga

SEQ ID NO: 17742 - DNA, 20 bp, synthetic construct
  source 1..20: mol_type = other DNA
ttgaggagagcttgaggaga

SEQ ID NO: 17743 - DNA, 20 bp, synthetic construct
  source 1..20: mol_type = other DNA
gcacattcggcccccgcgac

SEQ ID NO: 17744 - DNA, 20 bp, synthetic construct
  source 1..20: mol_type = other DNA
tggctttgtgagtgcgggca

SEQ ID NO: 17745 - DNA, 20 bp, synthetic construct
  source 1..20: mol_type = other DNA
gcattccccacacaacaccc

SEQ ID NO: 17746 - DNA, 20 bp, synthetic construct
  source 1..20: mol_type = other DNA
cccccgagcacgaagttggc

SEQ ID NO: 17747 - DNA, 20 bp, synthetic construct
  source 1..20: mol_type = other DNA
aaactgggctcccactcagc

SEQ ID NO: 17748 - DNA, 20 bp, synthetic construct
  source 1..20: mol_type = other DNA
ctgcacctcaaccgtgcgga

SEQ ID NO: 17749 - DNA, 20 bp, synthetic construct
  source 1..20: mol_type = other DNA
cagacccgccgccatgacgc

SEQ ID NO: 17750 - DNA, 20 bp, synthetic construct
  source 1..20: mol_type = other DNA
agggcgaggggcggggagcg

SEQ ID NO: 17751 - DNA, 20 bp, synthetic construct
  source 1..20: mol_type = other DNA
acacctgaaagcagcaccaa

SEQ ID NO: 17752 - DNA, 20 bp, synthetic construct
  source 1..20: mol_type = other DNA
cagcgacagagccaaaatca

SEQ ID NO: 17753 - DNA, 20 bp, synthetic construct
  source 1..20: mol_type = other DNA
cttggtgcccacctgtgcgc

SEQ ID NO: 17754 - DNA, 20 bp, synthetic construct
  source 1..20: mol_type = other DNA
cccaggccgcggcccagctg

SEQ ID NO: 17755 - DNA, 20 bp, synthetic construct
  source 1..20: mol_type = other DNA
gacgtcgccgagcgcgaggg

SEQ ID NO: 17756 - DNA, 20 bp, synthetic construct
  source 1..20: mol_type = other DNA
cgtcacgggcctcagctggg

SEQ ID NO: 17757 - DNA, 20 bp, synthetic construct
  source 1..20: mol_type = other DNA
cccgagggacgagtgacagc

SEQ ID NO: 17758 - DNA, 20 bp, synthetic construct
  source 1..20: mol_type = other DNA
accgccgctccggcctcccg

SEQ ID NO: 17759 - DNA, 20 bp, synthetic construct
  source 1..20: mol_type = other DNA
gggtctgactgacttgcagc

SEQ ID NO: 17760 - DNA, 20 bp, synthetic construct
  source 1..20: mol_type = other DNA
ggaaaatcctgttgtgaata

SEQ ID NO: 17761 - DNA, 20 bp, synthetic construct
  source 1..20: mol_type = other DNA
tcatttatctttattcttaa

SEQ ID NO: 17762 - DNA, 20 bp, synthetic construct
  source 1..20: mol_type = other DNA
cactgtgagcgattcggaaa

SEQ ID NO: 17763 - DNA, 20 bp, synthetic construct
  source 1..20: mol_type = other DNA
cgggtgtcgagggcgggttg

SEQ ID NO: 17764 - DNA, 20 bp, synthetic construct
  source 1..20: mol_type = other DNA
aggctgagaagatcgtgagg

SEQ ID NO: 17765 - DNA, 20 bp, synthetic construct
  source 1..20: mol_type = other DNA
gaggagctaagcgtcatcgc

SEQ ID NO: 17766 - DNA, 20 bp, synthetic construct
  source 1..20: mol_type = other DNA
acgcagcgagcgatcggccg

SEQ ID NO: 17767 - DNA, 20 bp, synthetic construct
  source 1..20: mol_type = other DNA
tgcgctcggctccgcctggt

SEQ ID NO: 17768 - DNA, 20 bp, synthetic construct
  source 1..20: mol_type = other DNA
ctggtgactcggctgcagaa

SEQ ID NO: 17769 - DNA, 20 bp, synthetic construct
  source 1..20: mol_type = other DNA
ggctgtgggtgccgctgagc

SEQ ID NO: 17770 - DNA, 20 bp, synthetic construct
  source 1..20: mol_type = other DNA
agatgaagctgaacatctcc

SEQ ID NO: 17771 - DNA, 20 bp, synthetic construct
  source 1..20: mol_type = other DNA
gccccccgtcccggcccccc

SEQ ID NO: 17772 - DNA, 20 bp, synthetic construct
  source 1..20: mol_type = other DNA
ttttcgctcgtcgactgcgg

SEQ ID NO: 17773 - DNA, 20 bp, synthetic construct
  source 1..20: mol_type = other DNA
actgcttacccacaatctgc

SEQ ID NO: 17774 - DNA, 20 bp, synthetic construct
  source 1..20: mol_type = other DNA
cccggaagtggcctgaaggc

SEQ ID NO: 17775 - DNA, 20 bp, synthetic construct
  source 1..20: mol_type = other DNA
gcctctctcttgctgcctag

SEQ ID NO: 17776 - DNA, 20 bp, synthetic construct
  source 1..20: mol_type = other DNA
ccgccatgagggagatcgtg

SEQ ID NO: 17777 - DNA, 20 bp, synthetic construct
  source 1..20: mol_type = other DNA
gtctgtggtggcgcgggcga

SEQ ID NO: 17778 - DNA, 20 bp, synthetic construct
  source 1..20: mol_type = other DNA
tcctctcaccggcccctgga

SEQ ID NO: 17779 - DNA, 20 bp, synthetic construct
  source 1..20: mol_type = other DNA
gactcaagttcttcagttca

SEQ ID NO: 17780 - DNA, 20 bp, synthetic construct
  source 1..20: mol_type = other DNA
tctgcttagcgacttggggt

SEQ ID NO: 17781 - DNA, 20 bp, synthetic construct
  source 1..20: mol_type = other DNA
cccacgacatcttcgcaggg

SEQ ID NO: 17782 - DNA, 20 bp, synthetic construct
  source 1..20: mol_type = other DNA
ccggcgccggaagtgagctg

SEQ ID NO: 17783 - DNA, 20 bp, synthetic construct
  source 1..20: mol_type = other DNA
ttgcgacataggccgagcag

SEQ ID NO: 17784 - DNA, 20 bp, synthetic construct
  source 1..20: mol_type = other DNA
gttcgcggagttcgcccgct

SEQ ID NO: 17785 - DNA, 20 bp, synthetic construct
  source 1..20: mol_type = other DNA
agggagctgagtgtttacag

SEQ ID NO: 17786 - DNA, 20 bp, synthetic construct
  source 1..20: mol_type = other DNA
gggccaaacgccggcctaga

SEQ ID NO: 17787 - DNA, 20 bp, synthetic construct
  source 1..20: mol_type = other DNA
gtctttctcaacggcaaatt

SEQ ID NO: 17788 - DNA, 20 bp, synthetic construct
  source 1..20: mol_type = other DNA
cgcgctgagaccgggaccgg

SEQ ID NO: 17789 - DNA, 20 bp, synthetic construct
  source 1..20: mol_type = other DNA
gaagctaaggctgcgttggg

SEQ ID NO: 17790 - DNA, 20 bp, synthetic construct
  source 1..20: mol_type = other DNA
agctcagcccagcccagccc

SEQ ID NO: 17791 - DNA, 20 bp, synthetic construct
  source 1..20: mol_type = other DNA
gagcggctgcttcctccggg

SEQ ID NO: 17792 - DNA, 20 bp, synthetic construct
  source 1..20: mol_type = other DNA
cctatgcagcctggtttcta

SEQ ID NO: 17793 - DNA, 20 bp, synthetic construct
  source 1..20: mol_type = other DNA
ggcccacagtcaccgccgct

SEQ ID NO: 17794 - DNA, 20 bp, synthetic construct
  source 1..20: mol_type = other DNA
agctggaacccatctcccgt

SEQ ID NO: 17795 - DNA, 20 bp, synthetic construct
  source 1..20: mol_type = other DNA
cgccgctgtccccgctgcgc

SEQ ID NO: 17796 - DNA, 20 bp, synthetic construct
  source 1..20: mol_type = other DNA
actctctttgtgggcaacct

SEQ ID NO: 17797 - DNA, 20 bp, synthetic construct
  source 1..20: mol_type = other DNA
gggcctgggaggcggcccgg

SEQ ID NO: 17798 - DNA, 20 bp, synthetic construct
  source 1..20: mol_type = other DNA
ctccccgcctcgcagagttg

SEQ ID NO: 17799 - DNA, 20 bp, synthetic construct
  source 1..20: mol_type = other DNA
ctccagacccgcacgccgcg

SEQ ID NO: 17800 - DNA, 20 bp, synthetic construct
  source 1..20: mol_type = other DNA
ctcccaaccccaagagccca

SEQ ID NO: 17801 - DNA, 20 bp, synthetic construct
  source 1..20: mol_type = other DNA
acccgctttcctcaactctc

SEQ ID NO: 17802 - DNA, 20 bp, synthetic construct
  source 1..20: mol_type = other DNA
gtggtggcggctgaggcggc

SEQ ID NO: 17803 - DNA, 20 bp, synthetic construct
  source 1..20: mol_type = other DNA
gcagcggctagggcggcggt

SEQ ID NO: 17804 - DNA, 20 bp, synthetic construct
  source 1..20: mol_type = other DNA
agcagccaacacaccagccc

SEQ ID NO: 17805 - DNA, 20 bp, synthetic construct
  source 1..20: mol_type = other DNA
ttaaagttcctcgtaatttt

SEQ ID NO: 17806 - DNA, 20 bp, synthetic construct
  source 1..20: mol_type = other DNA
gcagcacacatcggtccacc

SEQ ID NO: 17807 - DNA, 20 bp, synthetic construct
  source 1..20: mol_type = other DNA
gaacttttgctgaagcgaag

SEQ ID NO: 17808 - DNA, 20 bp, synthetic construct
  source 1..20: mol_type = other DNA
acacgggctcattgcggtgt

SEQ ID NO: 17809 - DNA, 20 bp, synthetic construct
  source 1..20: mol_type = other DNA
ggttccaagaaggctgtgac

SEQ ID NO: 17810 - DNA, 20 bp, synthetic construct
  source 1..20: mol_type = other DNA
aaatggcgcctccggccccc

SEQ ID NO: 17811 - DNA, 20 bp, synthetic construct
  source 1..20: mol_type = other DNA
tgcctggagggcgggaggga

SEQ ID NO: 17812 - DNA, 20 bp, synthetic construct
  source 1..20: mol_type = other DNA
gagccagagtctgtcaggcg

SEQ ID NO: 17813 - DNA, 20 bp, synthetic construct
  source 1..20: mol_type = other DNA
ccttcgcggtgcccactcca

SEQ ID NO: 17814 - DNA, 20 bp, synthetic construct
  source 1..20: mol_type = other DNA
ccagctcccaggaaagctgg

SEQ ID NO: 17815 - DNA, 20 bp, synthetic construct
  source 1..20: mol_type = other DNA
caactggcacaagcgccgca

SEQ ID NO: 17816 - DNA, 20 bp, synthetic construct
  source 1..20: mol_type = other DNA
gtcggaagggcgtcgcgcgg

SEQ ID NO: 17817 - DNA, 20 bp, synthetic construct
  source 1..20: mol_type = other DNA
gatggacgtactggtgtctg

SEQ ID NO: 17818 - DNA, 20 bp, synthetic construct
  source 1..20: mol_type = other DNA
ggatgtgggcggtcgcagct

SEQ ID NO: 17819 - DNA, 20 bp, synthetic construct
  source 1..20: mol_type = other DNA
cagctggttgtgggagagtt

SEQ ID NO: 17820 - DNA, 20 bp, synthetic construct
  source 1..20: mol_type = other DNA
ggtcccgggcgcgtttcggg

SEQ ID NO: 17821 - DNA, 20 bp, synthetic construct
  source 1..20: mol_type = other DNA
caccacagtaggtccctcgg

SEQ ID NO: 17822 - DNA, 20 bp, synthetic construct
  source 1..20: mol_type = other DNA
catgcatgctcccgggaagg

SEQ ID NO: 17823 - DNA, 20 bp, synthetic construct
  source 1..20: mol_type = other DNA
ctttcctcgcacagccaggc

SEQ ID NO: 17824 - DNA, 20 bp, synthetic construct
  source 1..20: mol_type = other DNA
aaaacgcgcggggggcgtcc

SEQ ID NO: 17825 - DNA, 20 bp, synthetic construct
  source 1..20: mol_type = other DNA
ccgagctgtcgccgccgccg

SEQ ID NO: 17826 - DNA, 20 bp, synthetic construct
  source 1..20: mol_type = other DNA
acgaccacgcctgtgccgct

SEQ ID NO: 17827 - DNA, 20 bp, synthetic construct
  source 1..20: mol_type = other DNA
gctccgaccgcgagcgtctc

SEQ ID NO: 17828 - DNA, 20 bp, synthetic construct
  source 1..20: mol_type = other DNA
tccagaggccatggacaggc

SEQ ID NO: 17829 - DNA, 20 bp, synthetic construct
  source 1..20: mol_type = other DNA
gcggacgccatggcgaccaa

SEQ ID NO: 17830 - DNA, 20 bp, synthetic construct
  source 1..20: mol_type = other DNA
cgacttccctaagggcattt

SEQ ID NO: 17831 - DNA, 20 bp, synthetic construct
  source 1..20: mol_type = other DNA
ccatgaagttcaatcccttc

SEQ ID NO: 17832 - DNA, 20 bp, synthetic construct
  source 1..20: mol_type = other DNA
cagccatgtctctagtgatc

SEQ ID NO: 17833 - DNA, 20 bp, synthetic construct
  source 1..20: mol_type = other DNA
ggatccctagatcccgtggg

SEQ ID NO: 17834 - DNA, 20 bp, synthetic construct
  source 1..20: mol_type = other DNA
tgggtttggctggcctcgat

SEQ ID NO: 17835 - DNA, 20 bp, synthetic construct
  source 1..20: mol_type = other DNA
ggaaacggggaagtcaggtg

SEQ ID NO: 17836 - DNA, 20 bp, synthetic construct
  source 1..20: mol_type = other DNA
aggccaagtcgcgctcgtcc

SEQ ID NO: 17837 - DNA, 20 bp, synthetic construct
  source 1..20: mol_type = other DNA
actctcttccagcctccgac

SEQ ID NO: 17838 - DNA, 20 bp, synthetic construct
  source 1..20: mol_type = other DNA
tggaaggaggggccgtgagg

SEQ ID NO: 17839 - DNA, 20 bp, synthetic construct
  source 1..20: mol_type = other DNA
cggttgctgcttgctgtgag

SEQ ID NO: 17840 - DNA, 20 bp, synthetic construct
  source 1..20: mol_type = other DNA
tctcgcggggcggctgcggt

SEQ ID NO: 17841 - DNA, 20 bp, synthetic construct
  source 1..20: mol_type = other DNA
gggcggagaggcggcggtgg

SEQ ID NO: 17842 - DNA, 20 bp, synthetic construct
  source 1..20: mol_type = other DNA
gttcatttgagtagatcgga

SEQ ID NO: 17843 - DNA, 20 bp, synthetic construct
  source 1..20: mol_type = other DNA
cccaatccttcgccatccga

SEQ ID NO: 17844 - DNA, 20 bp, synthetic construct
  source 1..20: mol_type = other DNA
agggttggtgggagttgcga

SEQ ID NO: 17845 - DNA, 20 bp, synthetic construct
  source 1..20: mol_type = other DNA
agtcagagttgagagacaga

SEQ ID NO: 17846 - DNA, 20 bp, synthetic construct
  source 1..20: mol_type = other DNA
tccgacccccatttcggctg

SEQ ID NO: 17847 - DNA, 20 bp, synthetic construct
  source 1..20: mol_type = other DNA
ccctgtcgccaccgaggtcg

SEQ ID NO: 17848 - DNA, 20 bp, synthetic construct
  source 1..20: mol_type = other DNA
cggacgccgggaggaggaga

SEQ ID NO: 17849 - DNA, 20 bp, synthetic construct
  source 1..20: mol_type = other DNA
gctattccgctgtaacagct

SEQ ID NO: 17850 - DNA, 20 bp, synthetic construct
  source 1..20: mol_type = other DNA
tagcgagcgagctcccaggc

SEQ ID NO: 17851 - DNA, 20 bp, synthetic construct
  source 1..20: mol_type = other DNA
cgacctcgcgagccttccgc

SEQ ID NO: 17852 - DNA, 20 bp, synthetic construct
  source 1..20: mol_type = other DNA
gcttgtggcgtctccgccgc

SEQ ID NO: 17853 - DNA, 20 bp, synthetic construct
  source 1..20: mol_type = other DNA
tcccgacccctgggagcgcc

SEQ ID NO: 17854 - DNA, 20 bp, synthetic construct
  source 1..20: mol_type = other DNA
tgatcagatccgccccggct

SEQ ID NO: 17855 - DNA, 20 bp, synthetic construct
  source 1..20: mol_type = other DNA
tctcaaactgtgagtaacta

SEQ ID NO: 17856 - DNA, 20 bp, synthetic construct
  source 1..20: mol_type = other DNA
ccgttagcggcgttggggtt

SEQ ID NO: 17857 - DNA, 20 bp, synthetic construct
  source 1..20: mol_type = other DNA
caaggttgaggccgagttcc

SEQ ID NO: 17858 - DNA, 20 bp, synthetic construct
  source 1..20: mol_type = other DNA
tcctcgcttcctccgcggtc

SEQ ID NO: 17859 - DNA, 20 bp, synthetic construct
  source 1..20: mol_type = other DNA
tgatgcttccctgctccctc

SEQ ID NO: 17860 - DNA, 20 bp, synthetic construct
  source 1..20: mol_type = other DNA
gcaccctcgcgggcggaccc

SEQ ID NO: 17861 - DNA, 20 bp, synthetic construct
  source 1..20: mol_type = other DNA
gaagcggcgtcggcggctgg

SEQ ID NO: 17862 - DNA, 20 bp, synthetic construct
  source 1..20: mol_type = other DNA
aaatggcggcctacctgcag

SEQ ID NO: 17863 - DNA, 20 bp, synthetic construct
  source 1..20: mol_type = other DNA
ctgcagcgcggagcagaaag

SEQ ID NO: 17864 - DNA, 20 bp, synthetic construct
  source 1..20: mol_type = other DNA
cggtgtgggcgcaggctgca

SEQ ID NO: 17865 - DNA, 20 bp, synthetic construct
  source 1..20: mol_type = other DNA
tcccttcttcctctcccttt

SEQ ID NO: 17866 - DNA, 20 bp, synthetic construct
  source 1..20: mol_type = other DNA
cccgactctgtcctggacag

SEQ ID NO: 17867 - DNA, 20 bp, synthetic construct
  source 1..20: mol_type = other DNA
ggttctggaaacgccgggag

SEQ ID NO: 17868 - DNA, 20 bp, synthetic construct
  source 1..20: mol_type = other DNA
cgccggtgtccgcccgtgtc

SEQ ID NO: 17869 - DNA, 20 bp, synthetic construct
  source 1..20: mol_type = other DNA
ttcaggaaagcaagcagccc

SEQ ID NO: 17870 - DNA, 20 bp, synthetic construct
  source 1..20: mol_type = other DNA
gcgattgagtggccgaggaa

SEQ ID NO: 17871 - DNA, 20 bp, synthetic construct
  source 1..20: mol_type = other DNA
aaaatgacgaacacaaaggg

SEQ ID NO: 17872 - DNA, 20 bp, synthetic construct
  source 1..20: mol_type = other DNA
gattgtggtgttcagcatta

SEQ ID NO: 17873 - DNA, 20 bp, synthetic construct
  source 1..20: mol_type = other DNA
ctgtggagagccgggtgcga

SEQ ID NO: 17874 - DNA, 20 bp, synthetic construct
  source 1..20: mol_type = other DNA
ggaggacttgcaacactccg

SEQ ID NO: 17875 - DNA, 20 bp, synthetic construct
  source 1..20: mol_type = other DNA
tccatccatcttaaaggaag

SEQ ID NO: 17876 - DNA, 20 bp, synthetic construct
  source 1..20: mol_type = other DNA
ggcggcggcggcggtggctg

SEQ ID NO: 17877 - DNA, 20 bp, synthetic construct
  source 1..20: mol_type = other DNA
cccggatgtcagccccccgc

SEQ ID NO: 17878 - DNA, 20 bp, synthetic construct
  source 1..20: mol_type = other DNA
agtgttagcggggaacgctg

SEQ ID NO: 17879 - DNA, 20 bp, synthetic construct
  source 1..20: mol_type = other DNA
gcctccgccgcggctcgtgg

SEQ ID NO: 17880 - DNA, 20 bp, synthetic construct
  source 1..20: mol_type = other DNA
tctagacttcagtttcagtt

SEQ ID NO: 17881 - DNA, 20 bp, synthetic construct
  source 1..20: mol_type = other DNA
gaactgagaattacaccatc

SEQ ID NO: 17882 - DNA, 20 bp, synthetic construct
  source 1..20: mol_type = other DNA
ctggaacttccgcctggcag

SEQ ID NO: 17883 - DNA, 20 bp, synthetic construct
  source 1..20: mol_type = other DNA
cgcctcttgtgaggcgcgcg

SEQ ID NO: 17884 - DNA, 20 bp, synthetic construct
  source 1..20: mol_type = other DNA
aggcccgggtgcgaggaggg

SEQ ID NO: 17885 - DNA, 20 bp, synthetic construct
  source 1..20: mol_type = other DNA
tgctcaaaccgagttctgga

SEQ ID NO: 17886 - DNA, 20 bp, synthetic construct
  source 1..20: mol_type = other DNA
gtcgcaaatcctcctaagcc

SEQ ID NO: 17887 - DNA, 20 bp, synthetic construct
  source 1..20: mol_type = other DNA
tctagaaccgtagccagaca

SEQ ID NO: 17888 - DNA, 20 bp, synthetic construct
  source 1..20: mol_type = other DNA
ggctccttcctgcggtgctt

SEQ ID NO: 17889 - DNA, 20 bp, synthetic construct
  source 1..20: mol_type = other DNA
tcgcaccaaaaccgtgaaga

SEQ ID NO: 17890 - DNA, 20 bp, synthetic construct
  source 1..20: mol_type = other DNA
caaccagctagcgtgcaagg

SEQ ID NO: 17891 - DNA, 20 bp, synthetic construct
  source 1..20: mol_type = other DNA
tctccgcgcctgacccctcc

SEQ ID NO: 17892 - DNA, 20 bp, synthetic construct
  source 1..20: mol_type = other DNA
cgtgctctcgcgagatttgg

SEQ ID NO: 17893 - DNA, 20 bp, synthetic construct
  source 1..20: mol_type = other DNA
tccctcgggtccagttcagc

SEQ ID NO: 17894 - DNA, 20 bp, synthetic construct
  source 1..20: mol_type = other DNA
agtagctcctgggacatcgc

SEQ ID NO: 17895 - DNA, 20 bp, synthetic construct
  source 1..20: mol_type = other DNA
atttcaagagtggccaggtg

SEQ ID NO: 17896 - DNA, 20 bp, synthetic construct
  source 1..20: mol_type = other DNA
gagctccgcgtgtagctacg

SEQ ID NO: 17897 - DNA, 20 bp, synthetic construct
  source 1..20: mol_type = other DNA
agaaacataagtcccgcgcg

SEQ ID NO: 17898 - DNA, 20 bp, synthetic construct
  source 1..20: mol_type = other DNA
atgctttgttaacagtgaag

SEQ ID NO: 17899 - DNA, 20 bp, synthetic construct
  source 1..20: mol_type = other DNA
atggcgacggagcatcccga

SEQ ID NO: 17900 - DNA, 20 bp, synthetic construct
  source 1..20: mol_type = other DNA
ccgcgctcggcacgacatga

SEQ ID NO: 17901 - DNA, 20 bp, synthetic construct
  source 1..20: mol_type = other DNA
gtgagggacaagcgtttgcc

SEQ ID NO: 17902 - DNA, 20 bp, synthetic construct
  source 1..20: mol_type = other DNA
gctggcgaggcgcgtgggac

SEQ ID NO: 17903 - DNA, 20 bp, synthetic construct
  source 1..20: mol_type = other DNA
ggaactgggactccctgtgg

SEQ ID NO: 17904 - DNA, 20 bp, synthetic construct
  source 1..20: mol_type = other DNA
tctctcgccaggcgtcctcg

SEQ ID NO: 17905 - DNA, 20 bp, synthetic construct
  source 1..20: mol_type = other DNA
gcggcggcggcggctgcagc

SEQ ID NO: 17906 - DNA, 20 bp, synthetic construct
  source 1..20: mol_type = other DNA
ttgtgtagcctgaggcggcg

SEQ ID NO: 17907 - DNA, 20 bp, synthetic construct
  source 1..20: mol_type = other DNA
gaacctcaagagagggaggt

SEQ ID NO: 17908 - DNA, 20 bp, synthetic construct
  source 1..20: mol_type = other DNA
cccaggggccggcgcacgaa

SEQ ID NO: 17909 - DNA, 20 bp, synthetic construct
  source 1..20: mol_type = other DNA
agagaaggtctcattcggtg

SEQ ID NO: 17910 - DNA, 20 bp, synthetic construct
  source 1..20: mol_type = other DNA
caccatcgagccgggaagat

SEQ ID NO: 17911 - DNA, 20 bp, synthetic construct
  source 1..20: mol_type = other DNA
ggccgcaccgtgtgggctgt

SEQ ID NO: 17912 - DNA, 20 bp, synthetic construct
  source 1..20: mol_type = other DNA
ggcgcctggctgccaggcta

SEQ ID NO: 17913 - DNA, 20 bp, synthetic construct
  source 1..20: mol_type = other DNA
ccgagcgaacttggcccagg

SEQ ID NO: 17914 - DNA, 20 bp, synthetic construct
  source 1..20: mol_type = other DNA
gagccggggtcccggtagct

SEQ ID NO: 17915 - DNA, 20 bp, synthetic construct
  source 1..20: mol_type = other DNA
tggcacgggttcgcacaccc

SEQ ID NO: 17916 - DNA, 20 bp, synthetic construct
  source 1..20: mol_type = other DNA
aacattgaccaccacacact

SEQ ID NO: 17917 - DNA, 20 bp, synthetic construct
  source 1..20: mol_type = other DNA
gcgagccggaggaggccgcg

SEQ ID NO: 17918 - DNA, 20 bp, synthetic construct
  source 1..20: mol_type = other DNA
cccctcgcccttggcagcct

SEQ ID NO: 17919 - DNA, 20 bp, synthetic construct
  source 1..20: mol_type = other DNA
ccccgggagccgcactccag

SEQ ID NO: 17920 - DNA, 20 bp, synthetic construct
  source 1..20: mol_type = other DNA
ctgacggattcgtactacaa

SEQ ID NO: 17921 - DNA, 20 bp, synthetic construct
  source 1..20: mol_type = other DNA
cagagaggcgctgctgacac

SEQ ID NO: 17922 - DNA, 20 bp, synthetic construct
  source 1..20: mol_type = other DNA
agggccggggtcttgggagt

SEQ ID NO: 17923 - DNA, 20 bp, synthetic construct
  source 1..20: mol_type = other DNA
ctgaactggctcctggggcc

SEQ ID NO: 17924 - DNA, 20 bp, synthetic construct
  source 1..20: mol_type = other DNA
ctccctagccgatgggaaat

SEQ ID NO: 17925 - DNA, 20 bp, synthetic construct
  source 1..20: mol_type = other DNA
tacactggctttttgattct

SEQ ID NO: 17926 - DNA, 20 bp, synthetic construct
  source 1..20: mol_type = other DNA
gaggaagggagggggagaga

SEQ ID NO: 17927 - DNA, 20 bp, synthetic construct
  source 1..20: mol_type = other DNA
ccttgcttgctcgcgctttc

SEQ ID NO: 17928 - DNA, 20 bp, synthetic construct
  source 1..20: mol_type = other DNA
agtggactccggggctccta

SEQ ID NO: 17929 - DNA, 20 bp, synthetic construct
  source 1..20: mol_type = other DNA
ggagacccccacattcaaga

SEQ ID NO: 17930 - DNA, 20 bp, synthetic construct
  source 1..20: mol_type = other DNA
ctgtgaggtgttcagcatta

SEQ ID NO: 17931 - DNA, 20 bp, synthetic construct
  source 1..20: mol_type = other DNA
ctctcctccttccccgctgc

SEQ ID NO: 17932 - DNA, 20 bp, synthetic construct
  source 1..20: mol_type = other DNA
gtccggactctttttcctct

SEQ ID NO: 17933 - DNA, 20 bp, synthetic construct
  source 1..20: mol_type = other DNA
ggaggctgcccttcggggtc

SEQ ID NO: 17934 - DNA, 20 bp, synthetic construct
  source 1..20: mol_type = other DNA
atatttgagtaaagtgagtt

SEQ ID NO: 17935 - DNA, 20 bp, synthetic construct
  source 1..20: mol_type = other DNA
gcgtgggccaaacctgcgcc

SEQ ID NO: 17936 - DNA, 20 bp, synthetic construct
  source 1..20: mol_type = other DNA
cccagataatcttccaatgg

SEQ ID NO: 17937 - DNA, 20 bp, synthetic construct
  source 1..20: mol_type = other DNA
accgggagacaggagcgggg

SEQ ID NO: 17938 - DNA, 20 bp, synthetic construct
  source 1..20: mol_type = other DNA
accttccaggactgggccca

SEQ ID NO: 17939 - DNA, 20 bp, synthetic construct
  source 1..20: mol_type = other DNA
gcgggtgacgcgacgacggc

SEQ ID NO: 17940 - DNA, 20 bp, synthetic construct
  source 1..20: mol_type = other DNA
catcgcgggaggcgcatggc

SEQ ID NO: 17941 - DNA, 20 bp, synthetic construct
  source 1..20: mol_type = other DNA
agctcagctgatcggttgcc

SEQ ID NO: 17942 - DNA, 20 bp, synthetic construct
  source 1..20: mol_type = other DNA
actgccgtgatgctgaagtt

SEQ ID NO: 17943 - DNA, 20 bp, synthetic construct
  source 1..20: mol_type = other DNA
ggcgacggcgaggagatagt

SEQ ID NO: 17944 - DNA, 20 bp, synthetic construct
  source 1..20: mol_type = other DNA
cgcctcctgacaagcgggag

SEQ ID NO: 17945 - DNA, 20 bp, synthetic construct
  source 1..20: mol_type = other DNA
tgcgaccgtatccgctagcg

SEQ ID NO: 17946 - DNA, 20 bp, synthetic construct
  source 1..20: mol_type = other DNA
aatcaggtaggtaactctct

SEQ ID NO: 17947 - DNA, 20 bp, synthetic construct
  source 1..20: mol_type = other DNA
gtgggagtggagtggagcgg

SEQ ID NO: 17948 - DNA, 20 bp, synthetic construct
  source 1..20: mol_type = other DNA
aacaactgctcagagtgcga

SEQ ID NO: 17949 - DNA, 20 bp, synthetic construct
  source 1..20: mol_type = other DNA
ggtgtgtttatatgcctgac

SEQ ID NO: 17950 - DNA, 20 bp, synthetic construct
  source 1..20: mol_type = other DNA
cgcctcgctcctcttcaggg

SEQ ID NO: 17951 - DNA, 20 bp, synthetic construct
  source 1..20: mol_type = other DNA
cacgctctgcgaggccttga

SEQ ID NO: 17952 - DNA, 20 bp, synthetic construct
  source 1..20: mol_type = other DNA
gccccgcctgagctcaggag

SEQ ID NO: 17953 - DNA, 20 bp, synthetic construct
  source 1..20: mol_type = other DNA
ctcgagcagtctctggaaca

SEQ ID NO: 17954 - DNA, 20 bp, synthetic construct
  source 1..20: mol_type = other DNA
aagaagaagagggggaggag

SEQ ID NO: 17955 - DNA, 20 bp, synthetic construct
  source 1..20: mol_type = other DNA
cgcgtcacgcggtggtgaat

SEQ ID NO: 17956 - DNA, 20 bp, synthetic construct
  source 1..20: mol_type = other DNA
gaagtggtcccgcagaggcg

SEQ ID NO: 17957 - DNA, 20 bp, synthetic construct
  source 1..20: mol_type = other DNA
cagcgctgccatggctgggg

SEQ ID NO: 17958 - DNA, 20 bp, synthetic construct
  source 1..20: mol_type = other DNA
ccagatcttttctcggatcc

SEQ ID NO: 17959 - DNA, 20 bp, synthetic construct
  source 1..20: mol_type = other DNA
gagacatccaggagggcgac

SEQ ID NO: 17960 - DNA, 20 bp, synthetic construct
  source 1..20: mol_type = other DNA
ccaccgtccgggagccgccg

SEQ ID NO: 17961 - DNA, 20 bp, synthetic construct
  source 1..20: mol_type = other DNA
tttgggggcttggcttagcg

SEQ ID NO: 17962 - DNA, 20 bp, synthetic construct
  source 1..20: mol_type = other DNA
ttggtctcaggtgtggactc

SEQ ID NO: 17963 - DNA, 20 bp, synthetic construct
  source 1..20: mol_type = other DNA
ggctgccgggagagatgctg

SEQ ID NO: 17964 - DNA, 20 bp, synthetic construct
  source 1..20: mol_type = other DNA
gaaggcagagtatgtgcatc

SEQ ID NO: 17965 - DNA, 20 bp, synthetic construct
  source 1..20: mol_type = other DNA
gcgccagcgctgcatccctg

SEQ ID NO: 17966 - DNA, 20 bp, synthetic construct
  source 1..20: mol_type = other DNA
agatccttgttgccgtccct

SEQ ID NO: 17967 - DNA, 20 bp, synthetic construct
  source 1..20: mol_type = other DNA
agccttcgtccctgcggtgc

SEQ ID NO: 17968 - DNA, 20 bp, synthetic construct
  source 1..20: mol_type = other DNA
ccagcgtccgaacgggcaga

SEQ ID NO: 17969 - DNA, 20 bp, synthetic construct
  source 1..20: mol_type = other DNA
gccccctagttcccaaaggg

SEQ ID NO: 17970 - DNA, 20 bp, synthetic construct
  source 1..20: mol_type = other DNA
ctgtttctttctttcttcct

SEQ ID NO: 17971 - DNA, 20 bp, synthetic construct
  source 1..20: mol_type = other DNA
tggagccctgacattgctgc

SEQ ID NO: 17972 - DNA, 20 bp, synthetic construct
  source 1..20: mol_type = other DNA
tccgtcttccttctgactgg

SEQ ID NO: 17973 - DNA, 20 bp, synthetic construct
  source 1..20: mol_type = other DNA
cctgtctgtggcaccagaca

SEQ ID NO: 17974 - DNA, 20 bp, synthetic construct
  source 1..20: mol_type = other DNA
tcccgggcagaaaggcgaca

SEQ ID NO: 17975 - DNA, 20 bp, synthetic construct
  source 1..20: mol_type = other DNA
ccagcgtcctgtcgcctcct

SEQ ID NO: 17976 - DNA, 20 bp, synthetic construct
  source 1..20: mol_type = other DNA
ctgcctcatggaaatgcctt

SEQ ID NO: 17977 - DNA, 20 bp, synthetic construct
  source 1..20: mol_type = other DNA
accggccgcgggcataaaag

SEQ ID NO: 17978 - DNA, 20 bp, synthetic construct
  source 1..20: mol_type = other DNA
cacggcccatgtgtcgcact

SEQ ID NO: 17979 - DNA, 20 bp, synthetic construct
  source 1..20: mol_type = other DNA
ggaggccgcgcccgggaccc

SEQ ID NO: 17980 - DNA, 20 bp, synthetic construct
  source 1..20: mol_type = other DNA
aggtgcggaccttaaactca

SEQ ID NO: 17981 - DNA, 20 bp, synthetic construct
  source 1..20: mol_type = other DNA
agccacgggcccacgcccgc

SEQ ID NO: 17982 - DNA, 20 bp, synthetic construct
  source 1..20: mol_type = other DNA
gctcggggcgacgcggcgct

SEQ ID NO: 17983 - DNA, 20 bp, synthetic construct
  source 1..20: mol_type = other DNA
tctttcttaaaggactgatt

SEQ ID NO: 17984 - DNA, 20 bp, synthetic construct
  source 1..20: mol_type = other DNA
ctcgcaggcgccctcagatc

SEQ ID NO: 17985 - DNA, 20 bp, synthetic construct
  source 1..20: mol_type = other DNA
ctccaactccagttctttcc

SEQ ID NO: 17986 - DNA, 20 bp, synthetic construct
  source 1..20: mol_type = other DNA
ggagccagacgtgtggagtc

SEQ ID NO: 17987 - DNA, 20 bp, synthetic construct
  source 1..20: mol_type = other DNA
ggcaactcccacgcaggccg

SEQ ID NO: 17988 - DNA, 20 bp, synthetic construct
  source 1..20: mol_type = other DNA
gcgccgccccgcctcctgtc

SEQ ID NO: 17989 - DNA, 20 bp, synthetic construct
  source 1..20: mol_type = other DNA
gctggaggcatgcccacagc

SEQ ID NO: 17990 - DNA, 20 bp, synthetic construct
  source 1..20: mol_type = other DNA
gagtgcggcgcagcgcagct

SEQ ID NO: 17991 - DNA, 20 bp, synthetic construct
  source 1..20: mol_type = other DNA
gtccttccgaggtgaaggaa

SEQ ID NO: 17992 - DNA, 20 bp, synthetic construct
  source 1..20: mol_type = other DNA
gagtagtctgcctgaccacc

SEQ ID NO: 17993 - DNA, 20 bp, synthetic construct
  source 1..20: mol_type = other DNA
ctcaggcgttgctgtttctt

SEQ ID NO: 17994 - DNA, 20 bp, synthetic construct
  source 1..20: mol_type = other DNA
cctcgcagagttgtttctcg

SEQ ID NO: 17995 - DNA, 20 bp, synthetic construct
  source 1..20: mol_type = other DNA
cctccagccagtgctgacca

SEQ ID NO: 17996 - DNA, 20 bp, synthetic construct
  source 1..20: mol_type = other DNA
gcgcctatcgctggctcttg

SEQ ID NO: 17997 - DNA, 20 bp, synthetic construct
  source 1..20: mol_type = other DNA
ctcagtccatcagggggggg

SEQ ID NO: 17998 - DNA, 20 bp, synthetic construct
  source 1..20: mol_type = other DNA
ccagaactagtggcgggctg

SEQ ID NO: 17999 - DNA, 20 bp, synthetic construct
  source 1..20: mol_type = other DNA
tcaggggacaggccaaccca

SEQ ID NO: 18000 - DNA, 20 bp, synthetic construct
  source 1..20: mol_type = other DNA
tggcggcggtggcggctgcg

SEQ ID NO: 18001 - DNA, 20 bp, synthetic construct
  source 1..20: mol_type = other DNA
gtcctcccgggcagaaaggc

SEQ ID NO: 18002 - DNA, 20 bp, synthetic construct
  source 1..20: mol_type = other DNA
ttctgaggccttcccagcta

SEQ ID NO: 18003 - DNA, 20 bp, synthetic construct
  source 1..20: mol_type = other DNA
gaaggcggacggcgagcgcc

SEQ ID NO: 18004 - DNA, 20 bp, synthetic construct
  source 1..20: mol_type = other DNA
gagggaggagaactgggggc

SEQ ID NO: 18005 - DNA, 20 bp, synthetic construct
  source 1..20: mol_type = other DNA
tcgaggctcctcccgctgcg

SEQ ID NO: 18006 - DNA, 20 bp, synthetic construct
  source 1..20: mol_type = other DNA
cacagctggttggcgtcgcc

SEQ ID NO: 18007 - DNA, 20 bp, synthetic construct
  source 1..20: mol_type = other DNA
tcctgcctcccggcctggtc

SEQ ID NO: 18008 - DNA, 20 bp, synthetic construct
  source 1..20: mol_type = other DNA
gtcctggtccacgagttgga

SEQ ID NO: 18009 - DNA, 20 bp, synthetic construct
  source 1..20: mol_type = other DNA
ttccccgtaggcagcccgcc

SEQ ID NO: 18010 - DNA, 20 bp, synthetic construct
  source 1..20: mol_type = other DNA
ttccagtggctcgcaagcct

SEQ ID NO: 18011 - DNA, 20 bp, synthetic construct
  source 1..20: mol_type = other DNA
agccctcaggcgaacctctc

SEQ ID NO: 18012 - DNA, 20 bp, synthetic construct
  source 1..20: mol_type = other DNA
aaaagctcctaggtgcgcgg

SEQ ID NO: 18013 - DNA, 20 bp, synthetic construct
  source 1..20: mol_type = other DNA
gttgtgcatccagaggtgga

SEQ ID NO: 18014 - DNA, 20 bp, synthetic construct
  source 1..20: mol_type = other DNA
gtccctgactttatatggct

SEQ ID NO: 18015 - DNA, 20 bp, synthetic construct
  source 1..20: mol_type = other DNA
ccgtttgtcccttgcggtac

SEQ ID NO: 18016 - DNA, 20 bp, synthetic construct
  source 1..20: mol_type = other DNA
cgagccctgcgagggccgat

SEQ ID NO: 18017 - DNA, 20 bp, synthetic construct
  source 1..20: mol_type = other DNA
gcaccttcttgccaagcctc

SEQ ID NO: 18018 - DNA, 20 bp, synthetic construct
  source 1..20: mol_type = other DNA
acaaaccccacccacaaagc

SEQ ID NO: 18019 - DNA, 20 bp, synthetic construct
  source 1..20: mol_type = other DNA
ggcgagcaacgctggagcat

SEQ ID NO: 18020 - DNA, 20 bp, synthetic construct
  source 1..20: mol_type = other DNA
tgccggcagctcttgacccg

SEQ ID NO: 18021 - DNA, 20 bp, synthetic construct
  source 1..20: mol_type = other DNA
ggccggtgagctcactagct

SEQ ID NO: 18022 - DNA, 20 bp, synthetic construct
  source 1..20: mol_type = other DNA
ggcgctggtgtaggctccaa

SEQ ID NO: 18023 - DNA, 20 bp, synthetic construct
  source 1..20: mol_type = other DNA
ctctgggccgccacctccgc

SEQ ID NO: 18024 - DNA, 20 bp, synthetic construct
  source 1..20: mol_type = other DNA
cactccgaagtggcagcagc

SEQ ID NO: 18025 - DNA, 20 bp, synthetic construct
  source 1..20: mol_type = other DNA
tcaatttggtactctgtaac

SEQ ID NO: 18026 - DNA, 20 bp, synthetic construct
  source 1..20: mol_type = other DNA
gcttctttgtttcgtgaaga

SEQ ID NO: 18027 - DNA, 20 bp, synthetic construct
  source 1..20: mol_type = other DNA
aggaacgccggctcttcgcc

SEQ ID NO: 18028 - DNA, 20 bp, synthetic construct
  source 1..20: mol_type = other DNA
gacagggaacagccagacga

SEQ ID NO: 18029 - DNA, 20 bp, synthetic construct
  source 1..20: mol_type = other DNA
tggcagtgcgggcagagccc

SEQ ID NO: 18030 - DNA, 20 bp, synthetic construct
  source 1..20: mol_type = other DNA
ccatccccgtaatcagtgaa

SEQ ID NO: 18031 - DNA, 20 bp, synthetic construct
  source 1..20: mol_type = other DNA
agagctgtccccggttctcc

SEQ ID NO: 18032 - DNA, 20 bp, synthetic construct
  source 1..20: mol_type = other DNA
tgcactgcagcgtagccgct

SEQ ID NO: 18033 - DNA, 20 bp, synthetic construct
  source 1..20: mol_type = other DNA
ttaatgcgaagagggggagg

SEQ ID NO: 18034 - DNA, 20 bp, synthetic construct
  source 1..20: mol_type = other DNA
cactctcagaaatcagactt

SEQ ID NO: 18035 - DNA, 20 bp, synthetic construct
  source 1..20: mol_type = other DNA
ggatctttgtcgctagctcc

SEQ ID NO: 18036 - DNA, 20 bp, synthetic construct
  source 1..20: mol_type = other DNA
gtagttccacctcccgccgc

SEQ ID NO: 18037 - DNA, 20 bp, synthetic construct
  source 1..20: mol_type = other DNA
ggaggggaaggcgcgaggtt

SEQ ID NO: 18038 - DNA, 20 bp, synthetic construct
  source 1..20: mol_type = other DNA
tcttgctgctcccctgaggt

SEQ ID NO: 18039 - DNA, 20 bp, synthetic construct
  source 1..20: mol_type = other DNA
cgccgcgtcgccggtgcctg

SEQ ID NO: 18040 - DNA, 20 bp, synthetic construct
  source 1..20: mol_type = other DNA
ccccagtcgtcgtcacacac

SEQ ID NO: 18041 - DNA, 20 bp, synthetic construct
  source 1..20: mol_type = other DNA
ctcctgctctggggtagtac

SEQ ID NO: 18042 - DNA, 20 bp, synthetic construct
  source 1..20: mol_type = other DNA
ccgtctcctgcgcctcccag

SEQ ID NO: 18043 - DNA, 20 bp, synthetic construct
  source 1..20: mol_type = other DNA
acatcgggctggggagtgac

SEQ ID NO: 18044 - DNA, 20 bp, synthetic construct
  source 1..20: mol_type = other DNA
acgcaaacgtggggccgcct

SEQ ID NO: 18045 - DNA, 20 bp, synthetic construct
  source 1..20: mol_type = other DNA
aggccctgcttagcccttcc

SEQ ID NO: 18046 - DNA, 20 bp, synthetic construct
  source 1..20: mol_type = other DNA
gcggggtcgcagggttggga

SEQ ID NO: 18047 - DNA, 20 bp, synthetic construct
  source 1..20: mol_type = other DNA
ctgcctcagccactgcctcc

SEQ ID NO: 18048 - DNA, 20 bp, synthetic construct
  source 1..20: mol_type = other DNA
gcctaaccctccttctcttc

SEQ ID NO: 18049 - DNA, 20 bp, synthetic construct
  source 1..20: mol_type = other DNA
ggcggccgaaccctccgcaa

SEQ ID NO: 18050 - DNA, 20 bp, synthetic construct
  source 1..20: mol_type = other DNA
cttcgccccggagctggccc

SEQ ID NO: 18051 - DNA, 20 bp, synthetic construct
  source 1..20: mol_type = other DNA
ttcaaaaaacccgcacacac

SEQ ID NO: 18052 - DNA, 20 bp, synthetic construct
  source 1..20: mol_type = other DNA
cctgctgcgggggaccgcgc

SEQ ID NO: 18053 - DNA, 20 bp, synthetic construct
  source 1..20: mol_type = other DNA
ggccgggctcggggacgccc

SEQ ID NO: 18054 - DNA, 20 bp, synthetic construct
  source 1..20: mol_type = other DNA
tccgcgcaaactctggcttc

SEQ ID NO: 18055 - DNA, 20 bp, synthetic construct
  source 1..20: mol_type = other DNA
agtgctgcgcgggaaggcac

SEQ ID NO: 18056 - DNA, 20 bp, synthetic construct
  source 1..20: mol_type = other DNA
cgcgaggagctagagagagc

SEQ ID NO: 18057 - DNA, 20 bp, synthetic construct
  source 1..20: mol_type = other DNA
ccccaggacttctgtgactc

SEQ ID NO: 18058 - DNA, 20 bp, synthetic construct
  source 1..20: mol_type = other DNA
gccgtagggcggtcagaagg

SEQ ID NO: 18059 - DNA, 20 bp, synthetic construct
  source 1..20: mol_type = other DNA
ggcggtgagagaggcggggg

SEQ ID NO: 18060 - DNA, 20 bp, synthetic construct
  source 1..20: mol_type = other DNA
gatggcggctgcgtcggggt

SEQ ID NO: 18061 - DNA, 20 bp, synthetic construct
  source 1..20: mol_type = other DNA
cgccccccggcaaactttcg

SEQ ID NO: 18062 - DNA, 20 bp, synthetic construct
  source 1..20: mol_type = other DNA
ccaaaatggcgcgggtgctg

SEQ ID NO: 18063 - DNA, 20 bp, synthetic construct
  source 1..20: mol_type = other DNA
gactctcaaaaggaaatagg

SEQ ID NO: 18064 - DNA, 20 bp, synthetic construct
  source 1..20: mol_type = other DNA
tccgccctcacagccaccgc

SEQ ID NO: 18065 - DNA, 20 bp, synthetic construct
  source 1..20: mol_type = other DNA
ggggaccgaacgagcagccc

SEQ ID NO: 18066 - DNA, 20 bp, synthetic construct
  source 1..20: mol_type = other DNA
gattctctcccaggccacaa

SEQ ID NO: 18067 - DNA, 20 bp, synthetic construct
  source 1..20: mol_type = other DNA
tccggcagctactggtcatg

SEQ ID NO: 18068 - DNA, 20 bp, synthetic construct
  source 1..20: mol_type = other DNA
tggctgctgtgattgcacat

SEQ ID NO: 18069 - DNA, 20 bp, synthetic construct
  source 1..20: mol_type = other DNA
gtgcgcgcctgggacctgaa

SEQ ID NO: 18070 - DNA, 20 bp, synthetic construct
  source 1..20: mol_type = other DNA
tggcccgagccagcatgatc

SEQ ID NO: 18071 - DNA, 20 bp, synthetic construct
  source 1..20: mol_type = other DNA
ccacgtgcgaaagccccgga

SEQ ID NO: 18072 - DNA, 20 bp, synthetic construct
  source 1..20: mol_type = other DNA
acggcttccccacgggagga

SEQ ID NO: 18073 - DNA, 20 bp, synthetic construct
  source 1..20: mol_type = other DNA
gctggccgccttggcgctgc

SEQ ID NO: 18074 - DNA, 20 bp, synthetic construct
  source 1..20: mol_type = other DNA
gctttctgccccttctctcg

SEQ ID NO: 18075 - DNA, 20 bp, synthetic construct
  source 1..20: mol_type = other DNA
caggggcacgagccgggggc

SEQ ID NO: 18076 - DNA, 20 bp, synthetic construct
  source 1..20: mol_type = other DNA
tcccgcgacagcaagaggcc

SEQ ID NO: 18077 - DNA, 20 bp, synthetic construct
  source 1..20: mol_type = other DNA
ttctgccaagatcggaactg

SEQ ID NO: 18078 - DNA, 20 bp, synthetic construct
  source 1..20: mol_type = other DNA
ctgccttatgctgtctcatc

SEQ ID NO: 18079 - DNA, 20 bp, synthetic construct
  source 1..20: mol_type = other DNA
cctcgcctggctcccagctg

SEQ ID NO: 18080 - DNA, 20 bp, synthetic construct
  source 1..20: mol_type = other DNA
actgcctcccttcctctttc

SEQ ID NO: 18081 - DNA, 20 bp, synthetic construct
  source 1..20: mol_type = other DNA
gaccgcctcgcggctgcttc

SEQ ID NO: 18082 - DNA, 20 bp, synthetic construct
  source 1..20: mol_type = other DNA
ggcgttctagcgcatcgcgg

SEQ ID NO: 18083 - DNA, 20 bp, synthetic construct
  source 1..20: mol_type = other DNA
gaagcggaggttccgggctc

SEQ ID NO: 18084 - DNA, 20 bp, synthetic construct
  source 1..20: mol_type = other DNA
ccgacgcttccgccgggtcc

SEQ ID NO: 18085 - DNA, 20 bp, synthetic construct
  source 1..20: mol_type = other DNA
cacgccggctcttcccgggg

SEQ ID NO: 18086 - DNA, 20 bp, synthetic construct
  source 1..20: mol_type = other DNA
catgtataagctggcctcct

SEQ ID NO: 18087 - DNA, 20 bp, synthetic construct
  source 1..20: mol_type = other DNA
gggaatcgcagtggccgagg

SEQ ID NO: 18088 - DNA, 20 bp, synthetic construct
  source 1..20: mol_type = other DNA
cagcagggtccaggggtaga

SEQ ID NO: 18089 - DNA, 20 bp, synthetic construct
  source 1..20: mol_type = other DNA
gcaggttttcctagtcccta

SEQ ID NO: 18090 - DNA, 20 bp, synthetic construct
  source 1..20: mol_type = other DNA
gcgaacccgcgtgcaacctg

SEQ ID NO: 18091 - DNA, 20 bp, synthetic construct
  source 1..20: mol_type = other DNA
cgcttccgtctccgccgggg

SEQ ID NO: 18092 - DNA, 20 bp, synthetic construct
  source 1..20: mol_type = other DNA
gtggcgcgcgggtccggcgg

SEQ ID NO: 18093 - DNA, 20 bp, synthetic construct
  source 1..20: mol_type = other DNA
caaattttgccacattaaca

SEQ ID NO: 18094 - DNA, 20 bp, synthetic construct
  source 1..20: mol_type = other DNA
gacctgctcggctggaacgt

SEQ ID NO: 18095 - DNA, 20 bp, synthetic construct
  source 1..20: mol_type = other DNA
ccgaggtgctaggagttgcc

SEQ ID NO: 18096 - DNA, 20 bp, synthetic construct
  source 1..20: mol_type = other DNA
gcttcacttgtggcaagatc

SEQ ID NO: 18097 - DNA, 20 bp, synthetic construct
  source 1..20: mol_type = other DNA
tctggcggagggaggtgttt

SEQ ID NO: 18098 - DNA, 20 bp, synthetic construct
  source 1..20: mol_type = other DNA
cctaattcgggaaacgtgca

SEQ ID NO: 18099 - DNA, 20 bp, synthetic construct
  source 1..20: mol_type = other DNA
tgggcctccttgcgtttccg

SEQ ID NO: 18100 - DNA, 20 bp, synthetic construct
  source 1..20: mol_type = other DNA
ccgccatggaagacacgccg

SEQ ID NO: 18101 - DNA, 20 bp, synthetic construct
  source 1..20: mol_type = other DNA
tgctgcctgccgggcagatg

SEQ ID NO: 18102 - DNA, 20 bp, synthetic construct
  source 1..20: mol_type = other DNA
attttgacaatgtcaagatt

SEQ ID NO: 18103 - DNA, 20 bp, synthetic construct
  source 1..20: mol_type = other DNA
ccggacgaggctcgctgcgc

SEQ ID NO: 18104 - DNA, 20 bp, synthetic construct
  source 1..20: mol_type = other DNA
tctccggtagctcctacccc

SEQ ID NO: 18105 - DNA, 20 bp, synthetic construct
  source 1..20: mol_type = other DNA
gcgcgcgcgaggccttggga

SEQ ID NO: 18106 - DNA, 20 bp, synthetic construct
  source 1..20: mol_type = other DNA
gtggcgttggtgggaagcgc

SEQ ID NO: 18107 - DNA, 20 bp, synthetic construct
  source 1..20: mol_type = other DNA
cgattggaacgcctccccat

SEQ ID NO: 18108 - DNA, 20 bp, synthetic construct
  source 1..20: mol_type = other DNA
ggaaaggcctggccgagagc

SEQ ID NO: 18109 - DNA, 20 bp, synthetic construct
  source 1..20: mol_type = other DNA
gccgtggctccgacttgggc

SEQ ID NO: 18110 - DNA, 20 bp, synthetic construct
  source 1..20: mol_type = other DNA
gattacgtacagagcgagtc

SEQ ID NO: 18111 - DNA, 20 bp, synthetic construct
  source 1..20: mol_type = other DNA
gcgcagcttgcagaggtctc

SEQ ID NO: 18112 - DNA, 20 bp, synthetic construct
  source 1..20: mol_type = other DNA
acatgcgcaatagcgagacg

SEQ ID NO: 18113 - DNA, 20 bp, synthetic construct
  source 1..20: mol_type = other DNA
gaaaatttcagctgtagccc

SEQ ID NO: 18114 - DNA, 20 bp, synthetic construct
  source 1..20: mol_type = other DNA
cccctccggctagctcgctg

SEQ ID NO: 18115 - DNA, 20 bp, synthetic construct
  source 1..20: mol_type = other DNA
gtcaaactcccgcagacttc

SEQ ID NO: 18116 - DNA, 20 bp, synthetic construct
  source 1..20: mol_type = other DNA
actatctttctagacaaggc

SEQ ID NO: 18117 - DNA, 20 bp, synthetic construct
  source 1..20: mol_type = other DNA
gggagcgcgagagccccccg

SEQ ID NO: 18118 - DNA, 20 bp, synthetic construct
  source 1..20: mol_type = other DNA
cccaggaggcctggcgggcc

SEQ ID NO: 18119 - DNA, 20 bp, synthetic construct
  source 1..20: mol_type = other DNA
agactcggcggtcgccacct

SEQ ID NO: 18120 - DNA, 20 bp, synthetic construct
  source 1..20: mol_type = other DNA
ccaggggatttcaaagagct

SEQ ID NO: 18121 - DNA, 20 bp, synthetic construct
  source 1..20: mol_type = other DNA
cgccaatcttcgaacgcagg

SEQ ID NO: 18122 - DNA, 20 bp, synthetic construct
  source 1..20: mol_type = other DNA
gtgtcttctggttggagtct

SEQ ID NO: 18123 - DNA, 20 bp, synthetic construct
  source 1..20: mol_type = other DNA
ggaggaggaggagatgactg

SEQ ID NO: 18124 - DNA, 20 bp, synthetic construct
  source 1..20: mol_type = other DNA
gccccgcgccgcttctccct

SEQ ID NO: 18125 - DNA, 20 bp, synthetic construct
  source 1..20: mol_type = other DNA
caaagaagaaccatgaggct

SEQ ID NO: 18126 - DNA, 20 bp, synthetic construct
  source 1..20: mol_type = other DNA
tcgttaactaattcaacaaa

SEQ ID NO: 18127 - DNA, 20 bp, synthetic construct
  source 1..20: mol_type = other DNA
tcgcagtcggctggcggcga

SEQ ID NO: 18128 - DNA, 20 bp, synthetic construct
  source 1..20: mol_type = other DNA
ccccgagtggaggtcggctg

SEQ ID NO: 18129 - DNA, 20 bp, synthetic construct
  source 1..20: mol_type = other DNA
gactcgcgctccggctgctg

SEQ ID NO: 18130 - DNA, 20 bp, synthetic construct
  source 1..20: mol_type = other DNA
tcaaccagctactcattgga

SEQ ID NO: 18131 - DNA, 20 bp, synthetic construct
  source 1..20: mol_type = other DNA
ttttttctccccccttctct

SEQ ID NO: 18132 - DNA, 20 bp, synthetic construct
  source 1..20: mol_type = other DNA
ctgtctgggtactgccagcc

SEQ ID NO: 18133 - DNA, 20 bp, synthetic construct
  source 1..20: mol_type = other DNA
ccacctgccctgcgccatct

SEQ ID NO: 18134 - DNA, 20 bp, synthetic construct
  source 1..20: mol_type = other DNA
ggggacagccgggcaagcag

SEQ ID NO: 18135 - DNA, 20 bp, synthetic construct
  source 1..20: mol_type = other DNA
ccctttcgggaggaagtttt

SEQ ID NO: 18136 - DNA, 20 bp, synthetic construct
  source 1..20: mol_type = other DNA
gcaaacacagcttccaaacc

SEQ ID NO: 18137 - DNA, 20 bp, synthetic construct
  source 1..20: mol_type = other DNA
tctatttccggtgtattgta

SEQ ID NO: 18138 - DNA, 20 bp, synthetic construct
  source 1..20: mol_type = other DNA
ttagcgccatctgctcgcgg

SEQ ID NO: 18139 - DNA, 20 bp, synthetic construct
  source 1..20: mol_type = other DNA
gcggttagggctgtgtaggg

SEQ ID NO: 18140 - DNA, 20 bp, synthetic construct
  source 1..20: mol_type = other DNA
tgtctcaagaatcagagtcg

SEQ ID NO: 18141 - DNA, 20 bp, synthetic construct
  source 1..20: mol_type = other DNA
aaccccggcagccctacaca

SEQ ID NO: 18142 - DNA, 20 bp, synthetic construct
  source 1..20: mol_type = other DNA
ccggagccgactacggagga

SEQ ID NO: 18143 - DNA, 20 bp, synthetic construct
  source 1..20: mol_type = other DNA
ccaagcatgccctgctctct

SEQ ID NO: 18144 - DNA, 20 bp, synthetic construct
  source 1..20: mol_type = other DNA
gacctggatgccctgctctc

SEQ ID NO: 18145 - DNA, 20 bp, synthetic construct
  source 1..20: mol_type = other DNA
tagacttcgggctccttgag

SEQ ID NO: 18146 - DNA, 20 bp, synthetic construct
  source 1..20: mol_type = other DNA
ctaccacctcgcacatgcca

SEQ ID NO: 18147 - DNA, 20 bp, synthetic construct
  source 1..20: mol_type = other DNA
taacagcagcctgcctgcag

SEQ ID NO: 18148 - DNA, 20 bp, synthetic construct
  source 1..20: mol_type = other DNA
gggccgcccccgaggaggtg

SEQ ID NO: 18149 - DNA, 20 bp, synthetic construct
  source 1..20: mol_type = other DNA
tctgggaacgaggcactagg

SEQ ID NO: 18150 - DNA, 20 bp, synthetic construct
  source 1..20: mol_type = other DNA
gtgctgctgctgcttctgag

SEQ ID NO: 18151 - DNA, 20 bp, synthetic construct
  source 1..20: mol_type = other DNA
caaccccctcagaccactct

SEQ ID NO: 18152 - DNA, 20 bp, synthetic construct
  source 1..20: mol_type = other DNA
ccaatcaggcgcggagggcg

SEQ ID NO: 18153 - DNA, 20 bp, synthetic construct
  source 1..20: mol_type = other DNA
cgtccttcctcagccgcggg

SEQ ID NO: 18154 - DNA, 20 bp, synthetic construct
  source 1..20: mol_type = other DNA
taaagtagtcgcggagacgg

SEQ ID NO: 18155 - DNA, 20 bp, synthetic construct
  source 1..20: mol_type = other DNA
acagctgtcggaaggtggcg

SEQ ID NO: 18156 - DNA, 20 bp, synthetic construct
  source 1..20: mol_type = other DNA
tttccttcggcttccgttct

SEQ ID NO: 18157 - DNA, 20 bp, synthetic construct
  source 1..20: mol_type = other DNA
agagcctgaaaaaggactgc

SEQ ID NO: 18158 - DNA, 20 bp, synthetic construct
  source 1..20: mol_type = other DNA
catgcaggcgcagcagctgc

SEQ ID NO: 18159 - DNA, 20 bp, synthetic construct
  source 1..20: mol_type = other DNA
tttgtgtagtgccttggagc

SEQ ID NO: 18160 - DNA, 20 bp, synthetic construct
  source 1..20: mol_type = other DNA
ttggagacccgaggaaagcc

SEQ ID NO: 18161 - DNA, 20 bp, synthetic construct
  source 1..20: mol_type = other DNA
gctctggctgtttaaaagct

SEQ ID NO: 18162 - DNA, 20 bp, synthetic construct
  source 1..20: mol_type = other DNA
cccttctcggcagtggtacc

SEQ ID NO: 18163 - DNA, 20 bp, synthetic construct
  source 1..20: mol_type = other DNA
ctccagagacctcctagagc

SEQ ID NO: 18164 - DNA, 20 bp, synthetic construct
  source 1..20: mol_type = other DNA
gctgtgggaataagatggcg

SEQ ID NO: 18165 - DNA, 20 bp, synthetic construct
  source 1..20: mol_type = other DNA
ttcggctggtgtcatcggtg

SEQ ID NO: 18166 - DNA, 20 bp, synthetic construct
  source 1..20: mol_type = other DNA
ggcgcggcaggaggacgagg

SEQ ID NO: 18167 - DNA, 20 bp, synthetic construct
  source 1..20: mol_type = other DNA
gtctgcgcggggccgctgac

SEQ ID NO: 18168 - DNA, 20 bp, synthetic construct
  source 1..20: mol_type = other DNA
accctccgacatgatatctc

SEQ ID NO: 18169 - DNA, 20 bp, synthetic construct
  source 1..20: mol_type = other DNA
tccgccccgcagcgccggag

SEQ ID NO: 18170 - DNA, 20 bp, synthetic construct
  source 1..20: mol_type = other DNA
gaccatggctgacgttttcc

SEQ ID NO: 18171 - DNA, 20 bp, synthetic construct
  source 1..20: mol_type = other DNA
aaatctcgtttctcttggac

SEQ ID NO: 18172 - DNA, 20 bp, synthetic construct
  source 1..20: mol_type = other DNA
tcccgccccgcggcagccct

SEQ ID NO: 18173 - DNA, 20 bp, synthetic construct
  source 1..20: mol_type = other DNA
tcctgagctgcgccgtgcca

SEQ ID NO: 18174 - DNA, 20 bp, synthetic construct
  source 1..20: mol_type = other DNA
caccgtggagagcgcggtcc

SEQ ID NO: 18175 - DNA, 20 bp, synthetic construct
  source 1..20: mol_type = other DNA
caatcactttcttcatcatc

SEQ ID NO: 18176 - DNA, 20 bp, synthetic construct
  source 1..20: mol_type = other DNA
gggggaaaggctgtttccaa

SEQ ID NO: 18177 - DNA, 20 bp, synthetic construct
  source 1..20: mol_type = other DNA
tccggcgaagttaaaccctc

SEQ ID NO: 18178 - DNA, 20 bp, synthetic construct
  source 1..20: mol_type = other DNA
gtagatccctcccgttagct

SEQ ID NO: 18179 - DNA, 20 bp, synthetic construct
  source 1..20: mol_type = other DNA
gctggccggtctgcctccgg

SEQ ID NO: 18180 - DNA, 20 bp, synthetic construct
  source 1..20: mol_type = other DNA
agccgctcgccttcctttca

SEQ ID NO: 18181 - DNA, 20 bp, synthetic construct
  source 1..20: mol_type = other DNA
aaaggtgaagcaggacatgc

SEQ ID NO: 18182 - DNA, 20 bp, synthetic construct
  source 1..20: mol_type = other DNA
gaaggtctcattcggtgttt

SEQ ID NO: 18183 - DNA, 20 bp, synthetic construct
  source 1..20: mol_type = other DNA
tccgcgggtggcaagcgggc

SEQ ID NO: 18184 - DNA, 20 bp, synthetic construct
  source 1..20: mol_type = other DNA
gctagtttctctaagccatc

SEQ ID NO: 18185 - DNA, 20 bp, synthetic construct
  source 1..20: mol_type = other DNA
cctaaatccaggcagggaaa

SEQ ID NO: 18186 - DNA, 20 bp, synthetic construct
  source 1..20: mol_type = other DNA
taaacccgcgcgcccgccag

SEQ ID NO: 18187 - DNA, 20 bp, synthetic construct
  source 1..20: mol_type = other DNA
tcgctccgaggtccccgcgc

SEQ ID NO: 18188 - DNA, 20 bp, synthetic construct
  source 1..20: mol_type = other DNA
taaggcggcacagggccgag

SEQ ID NO: 18189 - DNA, 20 bp, synthetic construct
  source 1..20: mol_type = other DNA
cttgttcagggctggtgggg

SEQ ID NO: 18190 - DNA, 20 bp, synthetic construct
  source 1..20: mol_type = other DNA
ccctaaagacgctagcgctg

SEQ ID NO: 18191 - DNA, 20 bp, synthetic construct
  source 1..20: mol_type = other DNA
cgcagtttgccggccgccat

SEQ ID NO: 18192 - DNA, 20 bp, synthetic construct
  source 1..20: mol_type = other DNA
ggagctgtgaggcagtgctg

SEQ ID NO: 18193 - DNA, 20 bp, synthetic construct
  source 1..20: mol_type = other DNA
ggattgaggcgccgccattt

SEQ ID NO: 18194 - DNA, 20 bp, synthetic construct
  source 1..20: mol_type = other DNA
cctcgtgcgcccccgccccc

SEQ ID NO: 18195 - DNA, 20 bp, synthetic construct
  source 1..20: mol_type = other DNA
tctcggcccttgacttctac

SEQ ID NO: 18196 - DNA, 20 bp, synthetic construct
  source 1..20: mol_type = other DNA
tatcagcacagcacttcttg

SEQ ID NO: 18197 - DNA, 20 bp, synthetic construct
  source 1..20: mol_type = other DNA
acaatctgtggcctcagccc

SEQ ID NO: 18198 - DNA, 20 bp, synthetic construct
  source 1..20: mol_type = other DNA
tccgagtttggtgttttgca

SEQ ID NO: 18199 - DNA, 20 bp, synthetic construct
  source 1..20: mol_type = other DNA
gggccacgtgataagcccgg

SEQ ID NO: 18200 - DNA, 20 bp, synthetic construct
  source 1..20: mol_type = other DNA
acctgggcttggtcgcctcc

SEQ ID NO: 18201 - DNA, 20 bp, synthetic construct
  source 1..20: mol_type = other DNA
acccctccccccgccttccc

SEQ ID NO: 18202 - DNA, 20 bp, synthetic construct
  source 1..20: mol_type = other DNA
agctaaggcaccccagccgg

SEQ ID NO: 18203 - DNA, 20 bp, synthetic construct
  source 1..20: mol_type = other DNA
gcagcgcttgagggtagcgg

SEQ ID NO: 18204 - DNA, 20 bp, synthetic construct
  source 1..20: mol_type = other DNA
ccgcgcgcgtcgcaacggag

SEQ ID NO: 18205 - DNA, 20 bp, synthetic construct
  source 1..20: mol_type = other DNA
gggaccaccgggggtggtga

SEQ ID NO: 18206 - DNA, 20 bp, synthetic construct
  source 1..20: mol_type = other DNA
caggaggcgtgcgtggcagg

SEQ ID NO: 18207 - DNA, 20 bp, synthetic construct
  source 1..20: mol_type = other DNA
cgtgcgtgaggcgtttactg

SEQ ID NO: 18208 - DNA, 20 bp, synthetic construct
  source 1..20: mol_type = other DNA
tccctccgggctcaagttgc

SEQ ID NO: 18209 - DNA, 20 bp, synthetic construct
  source 1..20: mol_type = other DNA
tgctctgcggctcagggagc

SEQ ID NO: 18210 - DNA, 20 bp, synthetic construct
  source 1..20: mol_type = other DNA
cgccacgcgcatatccctgc

SEQ ID NO: 18211 - DNA, 20 bp, synthetic construct
  source 1..20: mol_type = other DNA
cgagaagtcaagttctcatg

SEQ ID NO: 18212 - DNA, 20 bp, synthetic construct
  source 1..20: mol_type = other DNA
cctctttccctaagcagcct

SEQ ID NO: 18213 - DNA, 20 bp, synthetic construct
  source 1..20: mol_type = other DNA
agggcctgactttgggagcc

SEQ ID NO: 18214 - DNA, 20 bp, synthetic construct
  source 1..20: mol_type = other DNA
agacccagagggagggagga

SEQ ID NO: 18215 - DNA, 20 bp, synthetic construct
  source 1..20: mol_type = other DNA
agttctcccaaaatccaccg

SEQ ID NO: 18216 - DNA, 20 bp, synthetic construct
  source 1..20: mol_type = other DNA
gcctttgtgccatccgggtc

SEQ ID NO: 18217 - DNA, 20 bp, synthetic construct
  source 1..20: mol_type = other DNA
tctacccaagctccctcagc

SEQ ID NO: 18218 - DNA, 20 bp, synthetic construct
  source 1..20: mol_type = other DNA
gtgtcggtcgcctagtctgg

SEQ ID NO: 18219 - DNA, 20 bp, synthetic construct
  source 1..20: mol_type = other DNA
tcgcctagtctggagaacta

SEQ ID NO: 18220 - DNA, 20 bp, synthetic construct
  source 1..20: mol_type = other DNA
tgaacaagctgagtggaggc

SEQ ID NO: 18221 - DNA, 20 bp, synthetic construct
  source 1..20: mol_type = other DNA
tcctcccccctgttccccgc

SEQ ID NO: 18222 - DNA, 20 bp, synthetic construct
  source 1..20: mol_type = other DNA
ctttttgaacccacttattg

SEQ ID NO: 18223 - DNA, 20 bp, synthetic construct
  source 1..20: mol_type = other DNA
ctgtgtctggtacacattgt

SEQ ID NO: 18224 - DNA, 20 bp, synthetic construct
  source 1..20: mol_type = other DNA
ccgcttctcgactctgttgt

SEQ ID NO: 18225 - DNA, 20 bp, synthetic construct
  source 1..20: mol_type = other DNA
ctgtactgacgcgccctcgc

SEQ ID NO: 18226 - DNA, 20 bp, synthetic construct
  source 1..20: mol_type = other DNA
ctgcttggtcgcgtctgagg

SEQ ID NO: 18227 - DNA, 20 bp, synthetic construct
  source 1..20: mol_type = other DNA
gtgttctacgaagtctcttt

SEQ ID NO: 18228 - DNA, 20 bp, synthetic construct
  source 1..20: mol_type = other DNA
tccggcgatgccgccccagc

SEQ ID NO: 18229 - DNA, 20 bp, synthetic construct
  source 1..20: mol_type = other DNA
gcagctcggagcctgtggcg

SEQ ID NO: 18230 - DNA, 20 bp, synthetic construct
  source 1..20: mol_type = other DNA
gagtgagaaagagaaatctg

SEQ ID NO: 18231 - DNA, 20 bp, synthetic construct
  source 1..20: mol_type = other DNA
tagacctgcccttcgcctgg

SEQ ID NO: 18232 - DNA, 20 bp, synthetic construct
  source 1..20: mol_type = other DNA
gccagtcctttggctccgtt

SEQ ID NO: 18233 - DNA, 20 bp, synthetic construct
  source 1..20: mol_type = other DNA
tctcccgctccgtctcacac

SEQ ID NO: 18234 - DNA, 20 bp, synthetic construct
  source 1..20: mol_type = other DNA
ccaggcgccgcgaggcactg

SEQ ID NO: 18235 - DNA, 20 bp, synthetic construct
  source 1..20: mol_type = other DNA
catggtctcgccctagggag

SEQ ID NO: 18236 - DNA, 20 bp, synthetic construct
  source 1..20: mol_type = other DNA
ctctacgctcggcctcgatc

SEQ ID NO: 18237 - DNA, 20 bp, synthetic construct
  source 1..20: mol_type = other DNA
gggccgcagtgaccaacccc

SEQ ID NO: 18238 - DNA, 20 bp, synthetic construct
  source 1..20: mol_type = other DNA
acagcgccaagagcggcggc

SEQ ID NO: 18239 - DNA, 20 bp, synthetic construct
  source 1..20: mol_type = other DNA
aggggtgttcggccaggggc

SEQ ID NO: 18240 - DNA, 20 bp, synthetic construct
  source 1..20: mol_type = other DNA
ggagtaagcggcgcggtagc

SEQ ID NO: 18241 - DNA, 20 bp, synthetic construct
  source 1..20: mol_type = other DNA
agctgggggcccagctccgg

SEQ ID NO: 18242 - DNA, 20 bp, synthetic construct
  source 1..20: mol_type = other DNA
tggtgggcgggcgggagctg

SEQ ID NO: 18243 - DNA, 20 bp, synthetic construct
  source 1..20: mol_type = other DNA
ggctgcagcggggtgagcgg

SEQ ID NO: 18244 - DNA, 20 bp, synthetic construct
  source 1..20: mol_type = other DNA
tgccgggaagtgatccccaa

SEQ ID NO: 18245 - DNA, 20 bp, synthetic construct
  source 1..20: mol_type = other DNA
aggcagggtgagagttcccc

SEQ ID NO: 18246 - DNA, 20 bp, synthetic construct
  source 1..20: mol_type = other DNA
tgtgtttccaaaatggcggc

SEQ ID NO: 18247 - DNA, 20 bp, synthetic construct
  source 1..20: mol_type = other DNA
ggggctggcaggaggggagg

SEQ ID NO: 18248 - DNA, 20 bp, synthetic construct
  source 1..20: mol_type = other DNA
gtgaacagtggctgacaaca

SEQ ID NO: 18249 - DNA, 20 bp, synthetic construct
  source 1..20: mol_type = other DNA
ctgctgtgacgcgcggacag

SEQ ID NO: 18250 - DNA, 20 bp, synthetic construct
  source 1..20: mol_type = other DNA
gaagcgctggtcggcgtctg

SEQ ID NO: 18251 - DNA, 20 bp, synthetic construct
  source 1..20: mol_type = other DNA
cggcggcggcggcgtcggcg

SEQ ID NO: 18252 - DNA, 20 bp, synthetic construct
  source 1..20: mol_type = other DNA
gggcgaggaggttcccgtgg

SEQ ID NO: 18253 - DNA, 20 bp, synthetic construct
  source 1..20: mol_type = other DNA
acctcagcgcgagcgccagg

SEQ ID NO: 18254 - DNA, 20 bp, synthetic construct
  source 1..20: mol_type = other DNA
cgctctgagccctgccacca

SEQ ID NO: 18255 - DNA, 20 bp, synthetic construct
  source 1..20: mol_type = other DNA
gagatgaaatgcgaccgggt

SEQ ID NO: 18256 - DNA, 20 bp, synthetic construct
  source 1..20: mol_type = other DNA
ccgccgcaccgctgggggcc

SEQ ID NO: 18257 - DNA, 20 bp, synthetic construct
  source 1..20: mol_type = other DNA
tgtgggcgcggcagggcgca

SEQ ID NO: 18258 - DNA, 20 bp, synthetic construct
  source 1..20: mol_type = other DNA
ctggggagggctgtgcctga

SEQ ID NO: 18259 - DNA, 20 bp, synthetic construct
  source 1..20: mol_type = other DNA
tccggacatctccctgggag

SEQ ID NO: 18260 - DNA, 20 bp, synthetic construct
  source 1..20: mol_type = other DNA
ggccgcccgggacgagctcg

SEQ ID NO: 18261 - DNA, 20 bp, synthetic construct
  source 1..20: mol_type = other DNA
tgtcccctgcctctggggcc

SEQ ID NO: 18262 - DNA, 20 bp, synthetic construct
  source 1..20: mol_type = other DNA
tctctcgttttcggacggct

SEQ ID NO: 18263 - DNA, 20 bp, synthetic construct
  source 1..20: mol_type = other DNA
cgcgacggctgcagaacatc

SEQ ID NO: 18264 - DNA, 20 bp, synthetic construct
  source 1..20: mol_type = other DNA
atctcctgtctccgccgcct

SEQ ID NO: 18265 - DNA, 20 bp, synthetic construct
  source 1..20: mol_type = other DNA
cgtgctgttctgcggcaagg

SEQ ID NO: 18266 - DNA, 20 bp, synthetic construct
  source 1..20: mol_type = other DNA
cttgttcagcagaacaggtg

SEQ ID NO: 18267 - DNA, 20 bp, synthetic construct
  source 1..20: mol_type = other DNA
gcgggtatcatgggtgctgt

SEQ ID NO: 18268 - DNA, 20 bp, synthetic construct
  source 1..20: mol_type = other DNA
tgagattggcgaggggagag

SEQ ID NO: 18269 - DNA, 20 bp, synthetic construct
  source 1..20: mol_type = other DNA
aatggccgtggagcagcccc

SEQ ID NO: 18270 - DNA, 20 bp, synthetic construct
  source 1..20: mol_type = other DNA
gtggcctcgctccccgcccg

SEQ ID NO: 18271 - DNA, 20 bp, synthetic construct
  source 1..20: mol_type = other DNA
agagctacaagagcctggaa

SEQ ID NO: 18272 - DNA, 20 bp, synthetic construct
  source 1..20: mol_type = other DNA
taggctcccctgtgacagcc

SEQ ID NO: 18273 - DNA, 20 bp, synthetic construct
  source 1..20: mol_type = other DNA
aatttgcaacctccgctgcc

SEQ ID NO: 18274 - DNA, 20 bp, synthetic construct
  source 1..20: mol_type = other DNA
ggtagatccatggcttcctg

SEQ ID NO: 18275 - DNA, 20 bp, synthetic construct
  source 1..20: mol_type = other DNA
gagcgccgcgtcgggagcgg

SEQ ID NO: 18276 - DNA, 20 bp, synthetic construct
  source 1..20: mol_type = other DNA
tcatgctgtgcaaaaacttg

SEQ ID NO: 18277 - DNA, 20 bp, synthetic construct
  source 1..20: mol_type = other DNA
tggccgccgagcgggatctg

SEQ ID NO: 18278 - DNA, 20 bp, synthetic construct
  source 1..20: mol_type = other DNA
agccagagagaagaagataa

SEQ ID NO: 18279 - DNA, 20 bp, synthetic construct
  source 1..20: mol_type = other DNA
cctcattgcccagcggaccc

SEQ ID NO: 18280 - DNA, 20 bp, synthetic construct
  source 1..20: mol_type = other DNA
accccgaggtggctgaggct

SEQ ID NO: 18281 - DNA, 20 bp, synthetic construct
  source 1..20: mol_type = other DNA
gtgatggcggggccggtgaa

SEQ ID NO: 18282 - DNA, 20 bp, synthetic construct
  source 1..20: mol_type = other DNA
gcacagatgtcatctgctgc

SEQ ID NO: 18283 - DNA, 20 bp, synthetic construct
  source 1..20: mol_type = other DNA
cgctccggacgggcgacggt

SEQ ID NO: 18284 - DNA, 20 bp, synthetic construct
  source 1..20: mol_type = other DNA
tgcttcgggcttccacctca

SEQ ID NO: 18285 - DNA, 20 bp, synthetic construct
  source 1..20: mol_type = other DNA
gctccagtgccaaaacttcc

SEQ ID NO: 18286 - DNA, 20 bp, synthetic construct
  source 1..20: mol_type = other DNA
aacgagagactgcttgctgc

SEQ ID NO: 18287 - DNA, 20 bp, synthetic construct
  source 1..20: mol_type = other DNA
gaagtggtcgtttattggct

SEQ ID NO: 18288 - DNA, 20 bp, synthetic construct
  source 1..20: mol_type = other DNA
caggcgtcggtactcagcgg

SEQ ID NO: 18289 - DNA, 20 bp, synthetic construct
  source 1..20: mol_type = other DNA
ggcgggcggaaaccggtctc

SEQ ID NO: 18290 - DNA, 20 bp, synthetic construct
  source 1..20: mol_type = other DNA
gttcctccccagctcgaatg

SEQ ID NO: 18291 - DNA, 20 bp, synthetic construct
  source 1..20: mol_type = other DNA
taggagtcggcgattaagga

SEQ ID NO: 18292 - DNA, 20 bp, synthetic construct
  source 1..20: mol_type = other DNA
gcgcaccgctccgagggcca

SEQ ID NO: 18293 - DNA, 20 bp, synthetic construct
  source 1..20: mol_type = other DNA
tcattcctcccagggacccc

SEQ ID NO: 18294 - DNA, 20 bp, synthetic construct
  source 1..20: mol_type = other DNA
gcgaaagagcagcagaagtg

SEQ ID NO: 18295 - DNA, 20 bp, synthetic construct
  source 1..20: mol_type = other DNA
ctgcgttcggacccagaccc

SEQ ID NO: 18296 - DNA, 20 bp, synthetic construct
  source 1..20: mol_type = other DNA
gagcggaggaggaggaggag

SEQ ID NO: 18297 - DNA, 20 bp, synthetic construct
  source 1..20: mol_type = other DNA
aacgtcaggccacccgccgc

SEQ ID NO: 18298 - DNA, 20 bp, synthetic construct
  source 1..20: mol_type = other DNA
gaggaagtcggacgtgggcg

SEQ ID NO: 18299 - DNA, 20 bp, synthetic construct
  source 1..20: mol_type = other DNA
cacctagtacaacatcttac

SEQ ID NO: 18300 - DNA, 20 bp, synthetic construct
  source 1..20: mol_type = other DNA
ggatgaggcagaagattcag

SEQ ID NO: 18301 - DNA, 20 bp, synthetic construct
  source 1..20: mol_type = other DNA
gctggctcacaacaagatgc

SEQ ID NO: 18302 - DNA, 20 bp, synthetic construct
  source 1..20: mol_type = other DNA
acggacgtggctcgagtttc

SEQ ID NO: 18303 - DNA, 20 bp, synthetic construct
  source 1..20: mol_type = other DNA
ccggtcccttgcagcgctgc

SEQ ID NO: 18304 - DNA, 20 bp, synthetic construct
  source 1..20: mol_type = other DNA
cgcagcgcctacgggagtcc

SEQ ID NO: 18305 - DNA, 20 bp, synthetic construct
  source 1..20: mol_type = other DNA
taaccttcctgaagaggaca

SEQ ID NO: 18306 - DNA, 20 bp, synthetic construct
  source 1..20: mol_type = other DNA
tccggctcccacccgacgct

SEQ ID NO: 18307 - DNA, 20 bp, synthetic construct
  source 1..20: mol_type = other DNA
gaatgccactagagggtctg

SEQ ID NO: 18308 - DNA, 20 bp, synthetic construct
  source 1..20: mol_type = other DNA
attagggttgggagcaggaa

SEQ ID NO: 18309 - DNA, 20 bp, synthetic construct
  source 1..20: mol_type = other DNA
cggctgcgtggggctcggcc

SEQ ID NO: 18310 - DNA, 20 bp, synthetic construct
  source 1..20: mol_type = other DNA
agaaggccttggctccttga

SEQ ID NO: 18311 - DNA, 20 bp, synthetic construct
  source 1..20: mol_type = other DNA
ctgctctgcttccttcccat

SEQ ID NO: 18312 - DNA, 20 bp, synthetic construct
  source 1..20: mol_type = other DNA
aaggtcctctctgatgacat

SEQ ID NO: 18313 - DNA, 20 bp, synthetic construct
  source 1..20: mol_type = other DNA
aggacccgccccggccttga

SEQ ID NO: 18314 - DNA, 20 bp, synthetic construct
  source 1..20: mol_type = other DNA
cgaggcagcagttgcggccg

SEQ ID NO: 18315 - DNA, 20 bp, synthetic construct
  source 1..20: mol_type = other DNA
aagacggctcggatgccggc

SEQ ID NO: 18316 - DNA, 20 bp, synthetic construct
  source 1..20: mol_type = other DNA
gctgggctgggctgggctgg

SEQ ID NO: 18317 - DNA, 20 bp, synthetic construct
  source 1..20: mol_type = other DNA
tccacctgggaccggccggg

SEQ ID NO: 18318 - DNA, 20 bp, synthetic construct
  source 1..20: mol_type = other DNA
cttgaagcagaggagcagca

SEQ ID NO: 18319 - DNA, 20 bp, synthetic construct
  source 1..20: mol_type = other DNA
cggtctcgcatcggcggcga

SEQ ID NO: 18320 - DNA, 20 bp, synthetic construct
  source 1..20: mol_type = other DNA
gagggccagagactaagtta

SEQ ID NO: 18321 - DNA, 20 bp, synthetic construct
  source 1..20: mol_type = other DNA
gctccggcagcgttcctggg

SEQ ID NO: 18322 - DNA, 20 bp, synthetic construct
  source 1..20: mol_type = other DNA
gtgttgctccggcagcgttc

SEQ ID NO: 18323 - DNA, 20 bp, synthetic construct
  source 1..20: mol_type = other DNA
cggagggatctccgtggggc

SEQ ID NO: 18324 - DNA, 20 bp, synthetic construct
  source 1..20: mol_type = other DNA
ctgtgttttcttggttcagc

SEQ ID NO: 18325 - DNA, 20 bp, synthetic construct
  source 1..20: mol_type = other DNA
ttgtccttgggctgcctgtt

SEQ ID NO: 18326 - DNA, 20 bp, synthetic construct
  source 1..20: mol_type = other DNA
ctaccgtcgcggccgccgta

SEQ ID NO: 18327 - DNA, 20 bp, synthetic construct
  source 1..20: mol_type = other DNA
cggcagacaacaggggaccc

SEQ ID NO: 18328 - DNA, 20 bp, synthetic construct
  source 1..20: mol_type = other DNA
tggagacctgatttctaact

SEQ ID NO: 18329 - DNA, 20 bp, synthetic construct
  source 1..20: mol_type = other DNA
tcacgtcgcactcctcgcag

SEQ ID NO: 18330 - DNA, 20 bp, synthetic construct
  source 1..20: mol_type = other DNA
tcggactcgcgcccgtgggc

SEQ ID NO: 18331 - DNA, 20 bp, synthetic construct
  source 1..20: mol_type = other DNA
aagaagctggcggccgacgc

SEQ ID NO: 18332 - DNA, 20 bp, synthetic construct
  source 1..20: mol_type = other DNA
gctggaggcagtttctggtg

SEQ ID NO: 18333 - DNA, 20 bp, synthetic construct
  source 1..20: mol_type = other DNA
ccccatctccacttcctccc

SEQ ID NO: 18334 - DNA, 20 bp, synthetic construct
  source 1..20: mol_type = other DNA
gggcggcggcggtagctgcg

SEQ ID NO: 18335 - DNA, 20 bp, synthetic construct
  source 1..20: mol_type = other DNA
ccagggtcgtcaggggtgta

SEQ ID NO: 18336 - DNA, 20 bp, synthetic construct
  source 1..20: mol_type = other DNA
gctgggaaaaagaccaacag

SEQ ID NO: 18337 - DNA, 20 bp, synthetic construct
  source 1..20: mol_type = other DNA
tctcccgtcagaccttcctg

SEQ ID NO: 18338 - DNA, 20 bp, synthetic construct
  source 1..20: mol_type = other DNA
gcggtcgcccccttgggaaa

SEQ ID NO: 18339 - DNA, 20 bp, synthetic construct
  source 1..20: mol_type = other DNA
actcactccatggctgcagc

SEQ ID NO: 18340 - DNA, 20 bp, synthetic construct
  source 1..20: mol_type = other DNA
gcgccccaggccggcaggcg

SEQ ID NO: 18341 - DNA, 20 bp, synthetic construct
  source 1..20: mol_type = other DNA
agccgcgcgagtcgtagtgt

SEQ ID NO: 18342 - DNA, 20 bp, synthetic construct
  source 1..20: mol_type = other DNA
cgagggcagtaggctctcgg

SEQ ID NO: 18343 - DNA, 20 bp, synthetic construct
  source 1..20: mol_type = other DNA
agggctacgatgagctgcag

SEQ ID NO: 18344 - DNA, 20 bp, synthetic construct
  source 1..20: mol_type = other DNA
tgatccgattctttccagcg

SEQ ID NO: 18345 - DNA, 20 bp, synthetic construct
  source 1..20: mol_type = other DNA
tttttaagctcccctgagcc

SEQ ID NO: 18346 - DNA, 20 bp, synthetic construct
  source 1..20: mol_type = other DNA
ggcgtccgccacccgtctca

SEQ ID NO: 18347 - DNA, 20 bp, synthetic construct
  source 1..20: mol_type = other DNA
aggaaggctgtagtgtcggg

SEQ ID NO: 18348 - DNA, 20 bp, synthetic construct
  source 1..20: mol_type = other DNA
cggatcctcgctgctgctgc

SEQ ID NO: 18349 - DNA, 20 bp, synthetic construct
  source 1..20: mol_type = other DNA
ggctcagcctccagcccagg

SEQ ID NO: 18350 - DNA, 20 bp, synthetic construct
  source 1..20: mol_type = other DNA
aggcagaggaggctcagcgc

SEQ ID NO: 18351 - DNA, 20 bp, synthetic construct
  source 1..20: mol_type = other DNA
aaggtttccctgggcgttcc

SEQ ID NO: 18352 - DNA, 20 bp, synthetic construct
  source 1..20: mol_type = other DNA
aacgctacgatgcctgaacc

SEQ ID NO: 18353 - DNA, 20 bp, synthetic construct
  source 1..20: mol_type = other DNA
aaaaggaagcaaatgagctg

SEQ ID NO: 18354 - DNA, 20 bp, synthetic construct
  source 1..20: mol_type = other DNA
gcagccggaagggggaagtg

SEQ ID NO: 18355 - DNA, 20 bp, synthetic construct
  source 1..20: mol_type = other DNA
ccgctggccgcctcctgaca

SEQ ID NO: 18356 - DNA, 20 bp, synthetic construct
  source 1..20: mol_type = other DNA
actgcacggacccagggaac

SEQ ID NO: 18357 - DNA, 20 bp, synthetic construct
  source 1..20: mol_type = other DNA
cagcagggagaggctgagcc

SEQ ID NO: 18358 - DNA, 20 bp, synthetic construct
  source 1..20: mol_type = other DNA
caaaccctcctgcctccacc

SEQ ID NO: 18359 - DNA, 20 bp, synthetic construct
  source 1..20: mol_type = other DNA
gccagcctgaggctgggctg

SEQ ID NO: 18360 - DNA, 20 bp, synthetic construct
  source 1..20: mol_type = other DNA
ggcccactgctcagtggagc

SEQ ID NO: 18361 - DNA, 20 bp, synthetic construct
  source 1..20: mol_type = other DNA
cgcggcagccgaacaaagga

SEQ ID NO: 18362 - DNA, 20 bp, synthetic construct
  source 1..20: mol_type = other DNA
cgcccatctagctaacccga

SEQ ID NO: 18363 - DNA, 20 bp, synthetic construct
  source 1..20: mol_type = other DNA
gacctatagaggtatttcct

SEQ ID NO: 18364 - DNA, 20 bp, synthetic construct
  source 1..20: mol_type = other DNA
cggaggtgggggggggacgg

SEQ ID NO: 18365 - DNA, 20 bp, synthetic construct
  source 1..20: mol_type = other DNA
ccgcggcggagccaggccgg

SEQ ID NO: 18366 - DNA, 20 bp, synthetic construct
  source 1..20: mol_type = other DNA
gagcaggcagctgggggtgg

SEQ ID NO: 18367 - DNA, 20 bp, synthetic construct
  source 1..20: mol_type = other DNA
cgaaacttccctctacccgc

SEQ ID NO: 18368 - DNA, 20 bp, synthetic construct
  source 1..20: mol_type = other DNA
ttttcctgcgcaggagccgc

SEQ ID NO: 18369 - DNA, 20 bp, synthetic construct
  source 1..20: mol_type = other DNA
caagacggggcccgggcttt

SEQ ID NO: 18370 - DNA, 20 bp, synthetic construct
  source 1..20: mol_type = other DNA
tgctgctcagctcctcagct

SEQ ID NO: 18371 - DNA, 20 bp, synthetic construct
  source 1..20: mol_type = other DNA
cggcgcgagaagcggcggcc

SEQ ID NO: 18372 - DNA, 20 bp, synthetic construct
  source 1..20: mol_type = other DNA
ggagctgcggcgctggctac

SEQ ID NO: 18373 - DNA, 20 bp, synthetic construct
  source 1..20: mol_type = other DNA
caggccgggccaggctctct

SEQ ID NO: 18374 - DNA, 20 bp, synthetic construct
  source 1..20: mol_type = other DNA
gggctgtgtggccaaatctg

SEQ ID NO: 18375 - DNA, 20 bp, synthetic construct
  source 1..20: mol_type = other DNA
atatcttcctgcttctagtc

SEQ ID NO: 18376 - DNA, 20 bp, synthetic construct
  source 1..20: mol_type = other DNA
tggagccggccggcgctcac

SEQ ID NO: 18377 - DNA, 20 bp, synthetic construct
  source 1..20: mol_type = other DNA
ttggcgtggtgggcgactct

SEQ ID NO: 18378 - DNA, 20 bp, synthetic construct
  source 1..20: mol_type = other DNA
ctttggtttccgggtcggtt

SEQ ID NO: 18379 - DNA, 20 bp, synthetic construct
  source 1..20: mol_type = other DNA
ggcgcgggcggcgcggacag

SEQ ID NO: 18380 - DNA, 20 bp, synthetic construct
  source 1..20: mol_type = other DNA
gagccgggcggcgcaggcgc

SEQ ID NO: 18381 - DNA, 20 bp, synthetic construct
  source 1..20: mol_type = other DNA
cggcggcagcggaggaggag

SEQ ID NO: 18382 - DNA, 20 bp, synthetic construct
  source 1..20: mol_type = other DNA
tcctccggctttttcctccc

SEQ ID NO: 18383 - DNA, 20 bp, synthetic construct
  source 1..20: mol_type = other DNA
cgtgtcagtggcgctagcgg

SEQ ID NO: 18384 - DNA, 20 bp, synthetic construct
  source 1..20: mol_type = other DNA
ggatgcagaaagcctcagtg

SEQ ID NO: 18385 - DNA, 20 bp, synthetic construct
  source 1..20: mol_type = other DNA
ggcgcgaggcctgtgggccc

SEQ ID NO: 18386 - DNA, 20 bp, synthetic construct
  source 1..20: mol_type = other DNA
agctccaagtcctcacacag

SEQ ID NO: 18387 - DNA, 20 bp, synthetic construct
  source 1..20: mol_type = other DNA
agcagaggactttttagctg

SEQ ID NO: 18388 - DNA, 20 bp, synthetic construct
  source 1..20: mol_type = other DNA
ggcagctgcgggctccgcgc

SEQ ID NO: 18389 - DNA, 20 bp, synthetic construct
  source 1..20: mol_type = other DNA
ggcctatgtcttgactccgt

SEQ ID NO: 18390 - DNA, 20 bp, synthetic construct
  source 1..20: mol_type = other DNA
ttcggggtcaagccccagag

SEQ ID NO: 18391 - DNA, 20 bp, synthetic construct
  source 1..20: mol_type = other DNA
ggcctgctgtaggaaaatgc

SEQ ID NO: 18392 - DNA, 20 bp, synthetic construct
  source 1..20: mol_type = other DNA
ggaggggcaaaagctgaggg

SEQ ID NO: 18393 - DNA, 20 bp, synthetic construct
  source 1..20: mol_type = other DNA
cctcaccgggctgactagcc

SEQ ID NO: 18394 - DNA, 20 bp, synthetic construct
  source 1..20: mol_type = other DNA
ggcgtctcttcttctaactg

SEQ ID NO: 18395 - DNA, 20 bp, synthetic construct
  source 1..20: mol_type = other DNA
tgggagctgtttctcctggg

SEQ ID NO: 18396 - DNA, 20 bp, synthetic construct
  source 1..20: mol_type = other DNA
tagccacaatgcttaactgc

SEQ ID NO: 18397 - DNA, 20 bp, synthetic construct
  source 1..20: mol_type = other DNA
gtcaggctttcttcggtgga

SEQ ID NO: 18398 - DNA, 20 bp, synthetic construct
  source 1..20: mol_type = other DNA
cctgaactgaagagctgtgt

SEQ ID NO: 18399 - DNA, 20 bp, synthetic construct
  source 1..20: mol_type = other DNA
ggttgcccccgcgggcgtca

SEQ ID NO: 18400 - DNA, 20 bp, synthetic construct
  source 1..20: mol_type = other DNA
gcagaagctgtgacacgtgc

SEQ ID NO: 18401 - DNA, 20 bp, synthetic construct
  source 1..20: mol_type = other DNA
aggtccggattgcacgtgga

SEQ ID NO: 18402 - DNA, 20 bp, synthetic construct
  source 1..20: mol_type = other DNA
ccgcctccccgcgagtattt

SEQ ID NO: 18403 - DNA, 20 bp, synthetic construct
  source 1..20: mol_type = other DNA
gcggttgccgtggggaccgg

SEQ ID NO: 18404 - DNA, 20 bp, synthetic construct
  source 1..20: mol_type = other DNA
agggcgcctttcgattgcat

SEQ ID NO: 18405 - DNA, 20 bp, synthetic construct
  source 1..20: mol_type = other DNA
ggcgtggtgcatggctgtaa

SEQ ID NO: 18406 - DNA, 20 bp, synthetic construct
  source 1..20: mol_type = other DNA
aggtctgacaagatgtacca

SEQ ID NO: 18407 - DNA, 20 bp, synthetic construct
  source 1..20: mol_type = other DNA
gagctgggagaaggcagtga

SEQ ID NO: 18408 - DNA, 20 bp, synthetic construct
  source 1..20: mol_type = other DNA
cgcgcattggggacttgact

SEQ ID NO: 18409 - DNA, 20 bp, synthetic construct
  source 1..20: mol_type = other DNA
caggggacccagccaggggg

SEQ ID NO: 18410 - DNA, 20 bp, synthetic construct
  source 1..20: mol_type = other DNA
ccgcgctgcgaggcggaggt

SEQ ID NO: 18411 - DNA, 20 bp, synthetic construct
  source 1..20: mol_type = other DNA
tctgggatgtgcctcaccgg

SEQ ID NO: 18412 - DNA, 20 bp, synthetic construct
  source 1..20: mol_type = other DNA
taccccatgtctcaccacga

SEQ ID NO: 18413 - DNA, 20 bp, synthetic construct
  source 1..20: mol_type = other DNA
aagtgggtacgcaggggcgc

SEQ ID NO: 18414 - DNA, 20 bp, synthetic construct
  source 1..20: mol_type = other DNA
gaagctgctgttagctcgcc

SEQ ID NO: 18415 - DNA, 20 bp, synthetic construct
  source 1..20: mol_type = other DNA
cgggcactccagcgaccgtg

SEQ ID NO: 18416 - DNA, 20 bp, synthetic construct
  source 1..20: mol_type = other DNA
tcagcactgaaaccccgtcc

SEQ ID NO: 18417 - DNA, 20 bp, synthetic construct
  source 1..20: mol_type = other DNA
gggcctccgggacaagttgg

SEQ ID NO: 18418 - DNA, 20 bp, synthetic construct
  source 1..20: mol_type = other DNA
ctcgtgatccgcccgccttg

SEQ ID NO: 18419 - DNA, 20 bp, synthetic construct
  source 1..20: mol_type = other DNA
ggcgggcttcgggagcgccc

SEQ ID NO: 18420 - DNA, 20 bp, synthetic construct
  source 1..20: mol_type = other DNA
ttttcctgttccccctctgc

SEQ ID NO: 18421 - DNA, 20 bp, synthetic construct
  source 1..20: mol_type = other DNA
tgaggcgtagggggtggcgc

SEQ ID NO: 18422 - DNA, 20 bp, synthetic construct
  source 1..20: mol_type = other DNA
gacaaaacctcctccttttc

SEQ ID NO: 18423 - DNA, 20 bp, synthetic construct
  source 1..20: mol_type = other DNA
ttcgttcgagaacaactgtg

SEQ ID NO: 18424 - DNA, 20 bp, synthetic construct
  source 1..20: mol_type = other DNA
tcctccttttccaagcggct

SEQ ID NO: 18425 - DNA, 20 bp, synthetic construct
  source 1..20: mol_type = other DNA
accacacccaagtagctgcc

SEQ ID NO: 18426 - DNA, 20 bp, synthetic construct
  source 1..20: mol_type = other DNA
catagtgaccgtccgctcgc

SEQ ID NO: 18427 - DNA, 20 bp, synthetic construct
  source 1..20: mol_type = other DNA
gctactctgagaagaagaca

SEQ ID NO: 18428 - DNA, 20 bp, synthetic construct
  source 1..20: mol_type = other DNA
tcttgtgggctgaggggcag

SEQ ID NO: 18429 - DNA, 20 bp, synthetic construct
  source 1..20: mol_type = other DNA
cgcagtccctcaagcctgtg

SEQ ID NO: 18430 - DNA, 20 bp, synthetic construct
  source 1..20: mol_type = other DNA
gctgtgctctcactcaatgc

SEQ ID NO: 18431 - DNA, 20 bp, synthetic construct
  source 1..20: mol_type = other DNA
gagaaaggagctcccgggat

SEQ ID NO: 18432 - DNA, 20 bp, synthetic construct
  source 1..20: mol_type = other DNA
ctgacactggccctgaatca

SEQ ID NO: 18433 - DNA, 20 bp, synthetic construct
  source 1..20: mol_type = other DNA
aatcagggctggagggggca

SEQ ID NO: 18434 - DNA, 20 bp, synthetic construct
  source 1..20: mol_type = other DNA
acaactatttttgaggtatc

SEQ ID NO: 18435 - DNA, 20 bp, synthetic construct
  source 1..20: mol_type = other DNA
ttgggaagatggcggctgtg

SEQ ID NO: 18436 - DNA, 20 bp, synthetic construct
  source 1..20: mol_type = other DNA
cgccgcggcgcctgcgcggt

SEQ ID NO: 18437 - DNA, 20 bp, synthetic construct
  source 1..20: mol_type = other DNA
cgggcctggcctcccgataa

SEQ ID NO: 18438 - DNA, 20 bp, synthetic construct
  source 1..20: mol_type = other DNA
gtcccttgcggcggcgggag

SEQ ID NO: 18439 - DNA, 20 bp, synthetic construct
  source 1..20: mol_type = other DNA
gggaagaggctgagcccggc

SEQ ID NO: 18440 - DNA, 20 bp, synthetic construct
  source 1..20: mol_type = other DNA
ccaggcagctggcgctggag

SEQ ID NO: 18441 - DNA, 20 bp, synthetic construct
  source 1..20: mol_type = other DNA
cgcccttccaggagatgggt

SEQ ID NO: 18442 - DNA, 20 bp, synthetic construct
  source 1..20: mol_type = other DNA
cccggcctcagctctccgcc

SEQ ID NO: 18443 - DNA, 20 bp, synthetic construct
  source 1..20: mol_type = other DNA
ggcttttcatggggccgagc

SEQ ID NO: 18444 - DNA, 20 bp, synthetic construct
  source 1..20: mol_type = other DNA
cgggagcgcccttccaggag

SEQ ID NO: 18445 - DNA, 20 bp, synthetic construct
  source 1..20: mol_type = other DNA
aagggaagccctcgagggcc

SEQ ID NO: 18446 - DNA, 20 bp, synthetic construct
  source 1..20: mol_type = other DNA
tcccggctaccccccggacg

SEQ ID NO: 18447 - DNA, 20 bp, synthetic construct
  source 1..20: mol_type = other DNA
tgctctctctcgctgggtcg

SEQ ID NO: 18448 - DNA, 20 bp, synthetic construct
  source 1..20: mol_type = other DNA
acagccctgctctgggacac

SEQ ID NO: 18449 - DNA, 20 bp, synthetic construct
  source 1..20: mol_type = other DNA
tcctgagtcagaccataatc

SEQ ID NO: 18450 - DNA, 20 bp, synthetic construct
  source 1..20: mol_type = other DNA
ctaccctcacgtgtctggtt

SEQ ID NO: 18451 - DNA, 20 bp, synthetic construct
  source 1..20: mol_type = other DNA
ccgtcccactctgccctgtt

SEQ ID NO: 18452 - DNA, 20 bp, synthetic construct
  source 1..20: mol_type = other DNA
cgcttgccgcgtcctcccat

SEQ ID NO: 18453 - DNA, 20 bp, synthetic construct
  source 1..20: mol_type = other DNA
agtgtctgggcgggaagccg

SEQ ID NO: 18454 - DNA, 20 bp, synthetic construct
  source 1..20: mol_type = other DNA
ggcctcccgcagggcccact

SEQ ID NO: 18455 - DNA, 20 bp, synthetic construct
  source 1..20: mol_type = other DNA
agagcggtgcccgcgtcaga

SEQ ID NO: 18456 - DNA, 20 bp, synthetic construct
  source 1..20: mol_type = other DNA
caaagctcacggaagacaaa

SEQ ID NO: 18457 - DNA, 20 bp, synthetic construct
  source 1..20: mol_type = other DNA
cgatagctgcttcgggattg

SEQ ID NO: 18458 - DNA, 20 bp, synthetic construct
  source 1..20: mol_type = other DNA
ccaggaactgaccctgctct

SEQ ID NO: 18459 - DNA, 20 bp, synthetic construct
  source 1..20: mol_type = other DNA
cctttcgtttttttaaagaa

SEQ ID NO: 18460 - DNA, 20 bp, synthetic construct
  source 1..20: mol_type = other DNA
catcggcatgccgcagggaa

SEQ ID NO: 18461 - DNA, 20 bp, synthetic construct
  source 1..20: mol_type = other DNA
ggcgactacggctggtgtgg

SEQ ID NO: 18462 - DNA, 20 bp, synthetic construct
  source 1..20: mol_type = other DNA
gacgctgccggcggagacgg

SEQ ID NO: 18463 - DNA, 20 bp, synthetic construct
  source 1..20: mol_type = other DNA
cagcttcagatcactgtatc

SEQ ID NO: 18464 - DNA, 20 bp, synthetic construct
  source 1..20: mol_type = other DNA
ttcctgccggggcggcccca

SEQ ID NO: 18465 - DNA, 20 bp, synthetic construct
  source 1..20: mol_type = other DNA
actgggatacccttagactg

SEQ ID NO: 18466 - DNA, 20 bp, synthetic construct
  source 1..20: mol_type = other DNA
caggacgcggggtgggggac

SEQ ID NO: 18467 - DNA, 20 bp, synthetic construct
  source 1..20: mol_type = other DNA
cgcggttttcttaactttag

SEQ ID NO: 18468 - DNA, 20 bp, synthetic construct
  source 1..20: mol_type = other DNA
atggagaagccgcggcggag

SEQ ID NO: 18469 - DNA, 20 bp, synthetic construct
  source 1..20: mol_type = other DNA
tctctgcagcccagcaccag

SEQ ID NO: 18470 - DNA, 20 bp, synthetic construct
  source 1..20: mol_type = other DNA
ctggtatccctaagactggg

SEQ ID NO: 18471 - DNA, 20 bp, synthetic construct
  source 1..20: mol_type = other DNA
gagacaccccgtttcgtagt

SEQ ID NO: 18472 - DNA, 20 bp, synthetic construct
  source 1..20: mol_type = other DNA
cgcactgagcctaagcagcc

SEQ ID NO: 18473 - DNA, 20 bp, synthetic construct
  source 1..20: mol_type = other DNA
gcgcggctgaggcgcggcgg

SEQ ID NO: 18474 - DNA, 20 bp, synthetic construct
  source 1..20: mol_type = other DNA
cccaagacatctctgcacag

SEQ ID NO: 18475 - DNA, 20 bp, synthetic construct
  source 1..20: mol_type = other DNA
gccgcccggtgcactgtgga

SEQ ID NO: 18476 - DNA, 20 bp, synthetic construct
  source 1..20: mol_type = other DNA
ctgtatgatccaaggtaccc

SEQ ID NO: 18477 - DNA, 20 bp, synthetic construct
  source 1..20: mol_type = other DNA
cggcggcgggaacccggata

SEQ ID NO: 18478 - DNA, 20 bp, synthetic construct
  source 1..20: mol_type = other DNA
ggaccgcgtcctgcgccgga

SEQ ID NO: 18479 - DNA, 20 bp, synthetic construct
  source 1..20: mol_type = other DNA
gcctcattccttagctgggg

SEQ ID NO: 18480 - DNA, 20 bp, synthetic construct
  source 1..20: mol_type = other DNA
tgctgctgaggcgtgagaat

SEQ ID NO: 18481 - DNA, 20 bp, synthetic construct
  source 1..20: mol_type = other DNA
gggggctggggcatggtcta

SEQ ID NO: 18482 - DNA, 20 bp, synthetic construct
  source 1..20: mol_type = other DNA
gtgtacgcccgcagagccgc

SEQ ID NO: 18483 - DNA, 20 bp, synthetic construct
  source 1..20: mol_type = other DNA
gatcaccttgggatgatggt

SEQ ID NO: 18484 - DNA, 20 bp, synthetic construct
  source 1..20: mol_type = other DNA
gggtgcagtgagacaccagg

SEQ ID NO: 18485 - DNA, 20 bp, synthetic construct
  source 1..20: mol_type = other DNA
cggactgggcccagcttgtc

SEQ ID NO: 18486 - DNA, 20 bp, synthetic construct
  source 1..20: mol_type = other DNA
accctgtgatctgcaagtcc

SEQ ID NO: 18487 - DNA, 20 bp, synthetic construct
  source 1..20: mol_type = other DNA
ttggagctctgcgtctcgtc

SEQ ID NO: 18488 - DNA, 20 bp, synthetic construct
  source 1..20: mol_type = other DNA
cttttccgcgttctccaact

SEQ ID NO: 18489 - DNA, 20 bp, synthetic construct
  source 1..20: mol_type = other DNA
ggcggctcctccctccgcag

SEQ ID NO: 18490 - DNA, 20 bp, synthetic construct
  source 1..20: mol_type = other DNA
gctctgtgacctgcgggtat

SEQ ID NO: 18491 - DNA, 20 bp, synthetic construct
  source 1..20: mol_type = other DNA
aatgcctctctaaaacatga

SEQ ID NO: 18492 - DNA, 20 bp, synthetic construct
  source 1..20: mol_type = other DNA
gaccgcgggcgagtgcagcc

SEQ ID NO: 18493 - DNA, 20 bp, synthetic construct
  source 1..20: mol_type = other DNA
catctgcctctaggtcccat

SEQ ID NO: 18494 - DNA, 20 bp, synthetic construct
  source 1..20: mol_type = other DNA
cgcgcgcctacactcccgtg

SEQ ID NO: 18495 - DNA, 20 bp, synthetic construct
  source 1..20: mol_type = other DNA
gtcgtcgcagagcacagcct

SEQ ID NO: 18496 - DNA, 20 bp, synthetic construct
  source 1..20: mol_type = other DNA
cttgcttggcccgtccggcg

SEQ ID NO: 18497 - DNA, 20 bp, synthetic construct
  source 1..20: mol_type = other DNA
gccaagagcactgcatgagc

SEQ ID NO: 18498 - DNA, 20 bp, synthetic construct
  source 1..20: mol_type = other DNA
gcgagacttcctgctcatct

SEQ ID NO: 18499 - DNA, 20 bp, synthetic construct
  source 1..20: mol_type = other DNA
cgagacggagggccagagag

SEQ ID NO: 18500 - DNA, 20 bp, synthetic construct
  source 1..20: mol_type = other DNA
agccctccctagcatcacca

SEQ ID NO: 18501 - DNA, 20 bp, synthetic construct
  source 1..20: mol_type = other DNA
gcctcgggaggtggtggagt

SEQ ID NO: 18502 - DNA, 20 bp, synthetic construct
  source 1..20: mol_type = other DNA
cggcctccgtcacagccacc

SEQ ID NO: 18503 - DNA, 20 bp, synthetic construct
  source 1..20: mol_type = other DNA
tccttagccaaatctactga

SEQ ID NO: 18504 - DNA, 20 bp, synthetic construct
  source 1..20: mol_type = other DNA
tgtcgtccgctctctctgcc

SEQ ID NO: 18505 - DNA, 20 bp, synthetic construct
  source 1..20: mol_type = other DNA
accgtgttgcattcatcttt

SEQ ID NO: 18506 - DNA, 20 bp, synthetic construct
  source 1..20: mol_type = other DNA
agctgccgggacggtcccca

SEQ ID NO: 18507 - DNA, 20 bp, synthetic construct
  source 1..20: mol_type = other DNA
gtggcagcggccgtggcagg

SEQ ID NO: 18508 - DNA, 20 bp, synthetic construct
  source 1..20: mol_type = other DNA
ccggggcagaagtgctggtc

SEQ ID NO: 18509 - DNA, 20 bp, synthetic construct
  source 1..20: mol_type = other DNA
tcaccgcctgccgccgcgcc

SEQ ID NO: 18510 - DNA, 20 bp, synthetic construct
  source 1..20: mol_type = other DNA
aacctgttccaccttctcca

SEQ ID NO: 18511 - DNA, 20 bp, synthetic construct
  source 1..20: mol_type = other DNA
cgagcggcgctccaaaaccc

SEQ ID NO: 18512 - DNA, 20 bp, synthetic construct
  source 1..20: mol_type = other DNA
cttccccaaatcccgtaatc

SEQ ID NO: 18513 - DNA, 20 bp, synthetic construct
  source 1..20: mol_type = other DNA
gggatgccgcgcgccgcgcg

SEQ ID NO: 18514 - DNA, 20 bp, synthetic construct
  source 1..20: mol_type = other DNA
ggcggagaagactcgaacgg

SEQ ID NO: 18515 - DNA, 20 bp, synthetic construct
  source 1..20: mol_type = other DNA
gcctcccctcggaactcggg

SEQ ID NO: 18516 - DNA, 20 bp, synthetic construct
  source 1..20: mol_type = other DNA
gctgactggcgggtggggtt

SEQ ID NO: 18517 - DNA, 20 bp, synthetic construct
  source 1..20: mol_type = other DNA
gagttgctcagtggctctgc

SEQ ID NO: 18518 - DNA, 20 bp, synthetic construct
  source 1..20: mol_type = other DNA
ccggcggtggacccacgagc

SEQ ID NO: 18519 - DNA, 20 bp, synthetic construct
  source 1..20: mol_type = other DNA
gaacatggcggcccccgagt

SEQ ID NO: 18520 - DNA, 20 bp, synthetic construct
  source 1..20: mol_type = other DNA
gagtggaaagctgctgctga

SEQ ID NO: 18521 - DNA, 20 bp, synthetic construct
  source 1..20: mol_type = other DNA
tgcaggaggtggcactcctg

SEQ ID NO: 18522 - DNA, 20 bp, synthetic construct
  source 1..20: mol_type = other DNA
cccggtaaaggcctccgtgt

SEQ ID NO: 18523 - DNA, 20 bp, synthetic construct
  source 1..20: mol_type = other DNA
ggagcgccccgccccctccc

SEQ ID NO: 18524 - DNA, 20 bp, synthetic construct
  source 1..20: mol_type = other DNA
gtctccgccttctgcatcgc

SEQ ID NO: 18525 - DNA, 20 bp, synthetic construct
  source 1..20: mol_type = other DNA
aggagaatgaaaggttgcag

SEQ ID NO: 18526 - DNA, 20 bp, synthetic construct
  source 1..20: mol_type = other DNA
tgaagctagaatctcagaag

SEQ ID NO: 18527 - DNA, 20 bp, synthetic construct
  source 1..20: mol_type = other DNA
ttcagtatttgttattgtga

SEQ ID NO: 18528 - DNA, 20 bp, synthetic construct
  source 1..20: mol_type = other DNA
cgcggggtccgctatggcgg

SEQ ID NO: 18529 - DNA, 20 bp, synthetic construct
  source 1..20: mol_type = other DNA
ggaggaggtactcgccttac

SEQ ID NO: 18530 - DNA, 20 bp, synthetic construct
  source 1..20: mol_type = other DNA
actcttcagtctttgcaggc

SEQ ID NO: 18531 - DNA, 20 bp, synthetic construct
  source 1..20: mol_type = other DNA
gtcatcaggcaggtactaga

SEQ ID NO: 18532 - DNA, 20 bp, synthetic construct
  source 1..20: mol_type = other DNA
aagggctcgagacgcagccg

SEQ ID NO: 18533 - DNA, 20 bp, synthetic construct
  source 1..20: mol_type = other DNA
acaaatttttatgtggaggc

SEQ ID NO: 18534 - DNA, 20 bp, synthetic construct
  source 1..20: mol_type = other DNA
ctgcaacgtgtctctggggc

SEQ ID NO: 18535 - DNA, 20 bp, synthetic construct
  source 1..20: mol_type = other DNA
gcgcacgcatcctgcccgcg

SEQ ID NO: 18536 - DNA, 20 bp, synthetic construct
  source 1..20: mol_type = other DNA
cgcgaagagccctctgtacc

SEQ ID NO: 18537 - DNA, 20 bp, synthetic construct
  source 1..20: mol_type = other DNA
gcgcggcggtggaaggtgtc

SEQ ID NO: 18538 - DNA, 20 bp, synthetic construct
  source 1..20: mol_type = other DNA
ggctgcacgcggtgaagaaa

SEQ ID NO: 18539 - DNA, 20 bp, synthetic construct
  source 1..20: mol_type = other DNA
agccggggagccgccgccgc

SEQ ID NO: 18540 - DNA, 20 bp, synthetic construct
  source 1..20: mol_type = other DNA
accgttcttattgctggcgg

SEQ ID NO: 18541 - DNA, 20 bp, synthetic construct
  source 1..20: mol_type = other DNA
aggtcccggcaaccgcaggc

SEQ ID NO: 18542 - DNA, 20 bp, synthetic construct
  source 1..20: mol_type = other DNA
gatggcggcttcctagtgag

SEQ ID NO: 18543 - DNA, 20 bp, synthetic construct
  source 1..20: mol_type = other DNA
ggcctcctgacctttcacac

SEQ ID NO: 18544 - DNA, 20 bp, synthetic construct
  source 1..20: mol_type = other DNA
gtggggcggtggcgtcccac

SEQ ID NO: 18545 - DNA, 20 bp, synthetic construct
  source 1..20: mol_type = other DNA
gagggagcccagtggaggcg

SEQ ID NO: 18546 - DNA, 20 bp, synthetic construct
  source 1..20: mol_type = other DNA
ttttgtcaaagaggcctcct

SEQ ID NO: 18547 - DNA, 20 bp, synthetic construct
  source 1..20: mol_type = other DNA
tcacagccagtgcaccggag

SEQ ID NO: 18548 - DNA, 20 bp, synthetic construct
  source 1..20: mol_type = other DNA
gagttgtaagacgttcatcg

SEQ ID NO: 18549 - DNA, 20 bp, synthetic construct
  source 1..20: mol_type = other DNA
ccggttgtcctcttcgctgc

SEQ ID NO: 18550 - DNA, 20 bp, synthetic construct
  source 1..20: mol_type = other DNA
ttacgcgggccagttgttgc

SEQ ID NO: 18551 - DNA, 20 bp, synthetic construct
  source 1..20: mol_type = other DNA
cagccggggactctgcgcct

SEQ ID NO: 18552 - DNA, 20 bp, synthetic construct
  source 1..20: mol_type = other DNA
gggagccgcggacaagccca

SEQ ID NO: 18553 - DNA, 20 bp, synthetic construct
  source 1..20: mol_type = other DNA
ggcccccagcgtgttgaccg

SEQ ID NO: 18554 - DNA, 20 bp, synthetic construct
  source 1..20: mol_type = other DNA
agcagcggcggacgctctgc

SEQ ID NO: 18555 - DNA, 20 bp, synthetic construct
  source 1..20: mol_type = other DNA
gttgctctgcgctctgcggc

SEQ ID NO: 18556 - DNA, 20 bp, synthetic construct
  source 1..20: mol_type = other DNA
tttccggataacgactacag

SEQ ID NO: 18557 - DNA, 20 bp, synthetic construct
  source 1..20: mol_type = other DNA
ttttccatttacctccgctg

SEQ ID NO: 18558 - DNA, 20 bp, synthetic construct
  source 1..20: mol_type = other DNA
ggagacgtgggccctcggaa

SEQ ID NO: 18559 - DNA, 20 bp, synthetic construct
  source 1..20: mol_type = other DNA
agctctgtgtgatttctgga

SEQ ID NO: 18560 - DNA, 20 bp, synthetic construct
  source 1..20: mol_type = other DNA
cagaaccagcaaaaccagaa

SEQ ID NO: 18561 - DNA, 20 bp, synthetic construct
  source 1..20: mol_type = other DNA
gggaggcctggctgtgtgga

SEQ ID NO: 18562 - DNA, 20 bp, synthetic construct
  source 1..20: mol_type = other DNA
cccagacagagtgtccccac

SEQ ID NO: 18563 - DNA, 20 bp, synthetic construct
  source 1..20: mol_type = other DNA
agcagcaggcgagcctcggc

SEQ ID NO: 18564 - DNA, 20 bp, synthetic construct
  source 1..20: mol_type = other DNA
ttccggggagaagcctttcc

SEQ ID NO: 18565 - DNA, 20 bp, synthetic construct
  source 1..20: mol_type = other DNA
aaagataggaactgacagga

SEQ ID NO: 18566 - DNA, 20 bp, synthetic construct
  source 1..20: mol_type = other DNA
tccgctgggctgcagggact

SEQ ID NO: 18567 - DNA, 20 bp, synthetic construct
  source 1..20: mol_type = other DNA
agtgcaatggcgctatctcg

SEQ ID NO: 18568 - DNA, 20 bp, synthetic construct
  source 1..20: mol_type = other DNA
gtagcggcggcggctcgggc

SEQ ID NO: 18569 - DNA, 20 bp, synthetic construct
  source 1..20: mol_type = other DNA
gaccccaccccctggctacc

SEQ ID NO: 18570 - DNA, 20 bp, synthetic construct
  source 1..20: mol_type = other DNA
gcgcagctctggtacaccgg

SEQ ID NO: 18571 - DNA, 20 bp, synthetic construct
  source 1..20: mol_type = other DNA
tgcgcagtggcgtccgctgt

SEQ ID NO: 18572 - DNA, 20 bp, synthetic construct
  source 1..20: mol_type = other DNA
tccggcggagcgcgcctccc

SEQ ID NO: 18573 - DNA, 20 bp, synthetic construct
  source 1..20: mol_type = other DNA
cttccgggcaaacgaccatc

SEQ ID NO: 18574 - DNA, 20 bp, synthetic construct
  source 1..20: mol_type = other DNA
aagagcggcgcgacgtgagc

SEQ ID NO: 18575 - DNA, 20 bp, synthetic construct
  source 1..20: mol_type = other DNA
ctagcactagaaggtgaggc

SEQ ID NO: 18576 - DNA, 20 bp, synthetic construct
  source 1..20: mol_type = other DNA
ccgcggacgtccttgtgggc

SEQ ID NO: 18577 - DNA, 20 bp, synthetic construct
  source 1..20: mol_type = other DNA
tcctcccgccggcgctgggc

SEQ ID NO: 18578 - DNA, 20 bp, synthetic construct
  source 1..20: mol_type = other DNA
gcggtggggggaaagcggcc

SEQ ID NO: 18579 - DNA, 20 bp, synthetic construct
  source 1..20: mol_type = other DNA
tctggctataaaaatgctat

SEQ ID NO: 18580 - DNA, 20 bp, synthetic construct
  source 1..20: mol_type = other DNA
ccgccccgcccgcggctgct

SEQ ID NO: 18581 - DNA, 20 bp, synthetic construct
  source 1..20: mol_type = other DNA
acgtagctgcccttcagcca

SEQ ID NO: 18582 - DNA, 20 bp, synthetic construct
  source 1..20: mol_type = other DNA
tttttgcatttttcctccca

SEQ ID NO: 18583 - DNA, 20 bp, synthetic construct
  source 1..20: mol_type = other DNA
aactgcccaggagtgagtag

SEQ ID NO: 18584 - DNA, 20 bp, synthetic construct
  source 1..20: mol_type = other DNA
cttggtggttttgctgcagc

SEQ ID NO: 18585 - DNA, 20 bp, synthetic construct
  source 1..20: mol_type = other DNA
ctggccttccatctctctca

SEQ ID NO: 18586 - DNA, 20 bp, synthetic construct
  source 1..20: mol_type = other DNA
caccctcactggctgtcgct

SEQ ID NO: 18587 - DNA, 20 bp, synthetic construct
  source 1..20: mol_type = other DNA
gccttccatctctctcagac

SEQ ID NO: 18588 - DNA, 20 bp, synthetic construct
  source 1..20: mol_type = other DNA
aatcagactccaagcagcga

SEQ ID NO: 18589 - DNA, 20 bp, synthetic construct
  source 1..20: mol_type = other DNA
tctcagacaccaagctgcag

SEQ ID NO: 18590 - DNA, 20 bp, synthetic construct
  source 1..20: mol_type = other DNA
taacactgccccaagtgaaa

SEQ ID NO: 18591 - DNA, 20 bp, synthetic construct
  source 1..20: mol_type = other DNA
taattaagcaagagaaactg

SEQ ID NO: 18592 - DNA, 20 bp, synthetic construct
  source 1..20: mol_type = other DNA
tagagacaaaatatcagtgt

SEQ ID NO: 18593 - DNA, 20 bp, synthetic construct
  source 1..20: mol_type = other DNA
tccttgaccacaacaaagat

SEQ ID NO: 18594 - DNA, 20 bp, synthetic construct
  source 1..20: mol_type = other DNA
gattcttctgcctcagcctc

SEQ ID NO: 18595 - DNA, 20 bp, synthetic construct
  source 1..20: mol_type = other DNA
ccatcattctccacccagct

SEQ ID NO: 18596 - DNA, 20 bp, synthetic construct
  source 1..20: mol_type = other DNA
ccagcttgcctcctcttgag

SEQ ID NO: 18597 - DNA, 20 bp, synthetic construct
  source 1..20: mol_type = other DNA
tgcgcgctgggcggaaagga

SEQ ID NO: 18598 - DNA, 20 bp, synthetic construct
  source 1..20: mol_type = other DNA
gttaatggcttttctgcacg

SEQ ID NO: 18599 - DNA, 20 bp, synthetic construct
  source 1..20: mol_type = other DNA
taccaaatcactggacctta

SEQ ID NO: 18600 - DNA, 20 bp, synthetic construct
  source 1..20: mol_type = other DNA
cctgtcgcagccgcgccgcc

SEQ ID NO: 18601 - DNA, 20 bp, synthetic construct
  source 1..20: mol_type = other DNA
attcccgaagggcaagaagt

SEQ ID NO: 18602 - DNA, 20 bp, synthetic construct
  source 1..20: mol_type = other DNA
ccaggacctgcaggaaggga

SEQ ID NO: 18603 - DNA, 20 bp, synthetic construct
  source 1..20: mol_type = other DNA
tcccccactggaaaggattc

SEQ ID NO: 18604 - DNA, 20 bp, synthetic construct
  source 1..20: mol_type = other DNA
ggcagcatcactgtgcctgt

SEQ ID NO: 18605 - DNA, 20 bp, synthetic construct
  source 1..20: mol_type = other DNA
gggggagaccagcgcaggtc

SEQ ID NO: 18606 - DNA, 20 bp, synthetic construct
  source 1..20: mol_type = other DNA
ccttgggttcgggtgaaagc

SEQ ID NO: 18607 - DNA, 20 bp, synthetic construct
  source 1..20: mol_type = other DNA
tcaggctccataatgggaga

SEQ ID NO: 18608 - DNA, 20 bp, synthetic construct
  source 1..20: mol_type = other DNA
agcaacaaaactgacggagg

SEQ ID NO: 18609 - DNA, 20 bp, synthetic construct
  source 1..20: mol_type = other DNA
gctacagttaattaatcctt

SEQ ID NO: 18610 - DNA, 20 bp, synthetic construct
  source 1..20: mol_type = other DNA
ccatctcacctctgtcggat

SEQ ID NO: 18611 - DNA, 20 bp, synthetic construct
  source 1..20: mol_type = other DNA
aggtcacagggcaccgctgg

SEQ ID NO: 18612 - DNA, 20 bp, synthetic construct
  source 1..20: mol_type = other DNA
ggtcgcgcggctcgcgcagg

SEQ ID NO: 18613 - DNA, 20 bp, synthetic construct
  source 1..20: mol_type = other DNA
tccccctctcctccatcccc

SEQ ID NO: 18614 - DNA, 20 bp, synthetic construct
  source 1..20: mol_type = other DNA
cttccccctctctcctggga

SEQ ID NO: 18615 - DNA, 20 bp, synthetic construct
  source 1..20: mol_type = other DNA
gcccggttggccaccccgtt

SEQ ID NO: 18616 - DNA, 20 bp, synthetic construct
  source 1..20: mol_type = other DNA
ctgagcctgaactaggagca

SEQ ID NO: 18617 - DNA, 20 bp, synthetic construct
  source 1..20: mol_type = other DNA
aggttcttcttgaggaaact

SEQ ID NO: 18618 - DNA, 20 bp, synthetic construct
  source 1..20: mol_type = other DNA
gggtttgaatgtgccccggc

SEQ ID NO: 18619 - DNA, 20 bp, synthetic construct
  source 1..20: mol_type = other DNA
gcctgaagaccaaggagtgg

SEQ ID NO: 18620 - DNA, 20 bp, synthetic construct
  source 1..20: mol_type = other DNA
gtacatcccctcctccccca

SEQ ID NO: 18621 - DNA, 20 bp, synthetic construct
  source 1..20: mol_type = other DNA
aacggagaaaagaagccgtg

SEQ ID NO: 18622 - DNA, 20 bp, synthetic construct
  source 1..20: mol_type = other DNA
gcgtcccgccagaacgatcg

SEQ ID NO: 18623 - DNA, 20 bp, synthetic construct
  source 1..20: mol_type = other DNA
cagcgtcctaggactcacct

SEQ ID NO: 18624 - DNA, 20 bp, synthetic construct
  source 1..20: mol_type = other DNA
cgcagcgatcgcgagcgtgt

SEQ ID NO: 18625 - DNA, 20 bp, synthetic construct
  source 1..20: mol_type = other DNA
cgtactcgtgcgcctcgctt

SEQ ID NO: 18626 - DNA, 20 bp, synthetic construct
  source 1..20: mol_type = other DNA
cgccccatcctgtctgtccg

SEQ ID NO: 18627 - DNA, 20 bp, synthetic construct
  source 1..20: mol_type = other DNA
ttcctttagcccgctggcgc

SEQ ID NO: 18628 - DNA, 20 bp, synthetic construct
  source 1..20: mol_type = other DNA
gtgagagggaggctccccat

SEQ ID NO: 18629 - DNA, 20 bp, synthetic construct
  source 1..20: mol_type = other DNA
tcaagctccggacagggaag

SEQ ID NO: 18630 - DNA, 20 bp, synthetic construct
  source 1..20: mol_type = other DNA
ccaaagctgaccaagaagaa

SEQ ID NO: 18631 - DNA, 20 bp, synthetic construct
  source 1..20: mol_type = other DNA
gcctgggtgcagcagtgtgc

SEQ ID NO: 18632 - DNA, 20 bp, synthetic construct
  source 1..20: mol_type = other DNA
tcgtggcgtgtgcggtttcg

SEQ ID NO: 18633 - DNA, 20 bp, synthetic construct
  source 1..20: mol_type = other DNA
cagcacctcctcgccagcag

SEQ ID NO: 18634 - DNA, 20 bp, synthetic construct
  source 1..20: mol_type = other DNA
gccagttcaaagccctgctg

SEQ ID NO: 18635 - DNA, 20 bp, synthetic construct
  source 1..20: mol_type = other DNA
tggcgcttgggtactggctg

SEQ ID NO: 18636 - DNA, 20 bp, synthetic construct
  source 1..20: mol_type = other DNA
catcttggctcactgcagtg

SEQ ID NO: 18637 - DNA, 20 bp, synthetic construct
  source 1..20: mol_type = other DNA
tgtgctgagcggcgggactg

SEQ ID NO: 18638 - DNA, 20 bp, synthetic construct
  source 1..20: mol_type = other DNA
agggggagctggaggctgga

SEQ ID NO: 18639 - DNA, 20 bp, synthetic construct
  source 1..20: mol_type = other DNA
ttctcgtgagcttaggccgc

SEQ ID NO: 18640 - DNA, 20 bp, synthetic construct
  source 1..20: mol_type = other DNA
acaccatggtcaactcctgt

SEQ ID NO: 18641 - DNA, 20 bp, synthetic construct
  source 1..20: mol_type = other DNA
acttttaagtttttccgctt

SEQ ID NO: 18642 - DNA, 20 bp, synthetic construct
  source 1..20: mol_type = other DNA
aggaccacgcaggaggtggt

SEQ ID NO: 18643 - DNA, 20 bp, synthetic construct
  source 1..20: mol_type = other DNA
ccccgcctccacgtgagagc

SEQ ID NO: 18644 - DNA, 20 bp, synthetic construct
  source 1..20: mol_type = other DNA
aggcggggctgctaggcctc

SEQ ID NO: 18645 - DNA, 20 bp, synthetic construct
  source 1..20: mol_type = other DNA
gaaaactacccctaaaagcc

SEQ ID NO: 18646 - DNA, 20 bp, synthetic construct
  source 1..20: mol_type = other DNA
gggcgtggtgtcctggtgct

SEQ ID NO: 18647 - DNA, 20 bp, synthetic construct
  source 1..20: mol_type = other DNA
cccttcggacctcgtctccc

SEQ ID NO: 18648 - DNA, 20 bp, synthetic construct
  source 1..20: mol_type = other DNA
cagtagtaatttgagcctct

SEQ ID NO: 18649 - DNA, 20 bp, synthetic construct
  source 1..20: mol_type = other DNA
ccagctgcagagagcttcag

SEQ ID NO: 18650 - DNA, 20 bp, synthetic construct
  source 1..20: mol_type = other DNA
ttgcaaggaagggcgagatt

SEQ ID NO: 18651 - DNA, 20 bp, synthetic construct
  source 1..20: mol_type = other DNA
cgtggtggtgcaggcgagac

SEQ ID NO: 18652 - DNA, 20 bp, synthetic construct
  source 1..20: mol_type = other DNA
tcaagtgttgcggagatagg

SEQ ID NO: 18653 - DNA, 20 bp, synthetic construct
  source 1..20: mol_type = other DNA
aagatggcggctgctgtagg

SEQ ID NO: 18654 - DNA, 20 bp, synthetic construct
  source 1..20: mol_type = other DNA
acctcgcacagcctctccca

SEQ ID NO: 18655 - DNA, 20 bp, synthetic construct
  source 1..20: mol_type = other DNA
tgagcttcagggaaaagaag

SEQ ID NO: 18656 - DNA, 20 bp, synthetic construct
  source 1..20: mol_type = other DNA
ggtgacgctgctgctggggc

SEQ ID NO: 18657 - DNA, 20 bp, synthetic construct
  source 1..20: mol_type = other DNA
cagctaacctctaatgggag

SEQ ID NO: 18658 - DNA, 20 bp, synthetic construct
  source 1..20: mol_type = other DNA
cagccgctacttaagaggct

SEQ ID NO: 18659 - DNA, 20 bp, synthetic construct
  source 1..20: mol_type = other DNA
tgcaccctcgcacccacacc

SEQ ID NO: 18660 - DNA, 20 bp, synthetic construct
  source 1..20: mol_type = other DNA
cccgcggtcctccgtcggtt

SEQ ID NO: 18661 - DNA, 20 bp, synthetic construct
  source 1..20: mol_type = other DNA
accgacaaccaagaccccgc

SEQ ID NO: 18662 - DNA, 20 bp, synthetic construct
  source 1..20: mol_type = other DNA
ccagaatggctactctgatc

SEQ ID NO: 18663 - DNA, 20 bp, synthetic construct
  source 1..20: mol_type = other DNA
agaggtctgtacctcgaggg

SEQ ID NO: 18664 - DNA, 20 bp, synthetic construct
  source 1..20: mol_type = other DNA
cagtcgccccgacgctagtg

SEQ ID NO: 18665 - DNA, 20 bp, synthetic construct
  source 1..20: mol_type = other DNA
gtcctttgcatctgcacgtg

SEQ ID NO: 18666 - DNA, 20 bp, synthetic construct
  source 1..20: mol_type = other DNA
caccctctcccctcgtccac

SEQ ID NO: 18667 - DNA, 20 bp, synthetic construct
  source 1..20: mol_type = other DNA
tggacaaaatggcgaagatc

SEQ ID NO: 18668 - DNA, 20 bp, synthetic construct
  source 1..20: mol_type = other DNA
ctttatctcctgactcacgg

SEQ ID NO: 18669 - DNA, 20 bp, synthetic construct
  source 1..20: mol_type = other DNA
ggggctgcttagatgcgcca

SEQ ID NO: 18670 - DNA, 20 bp, synthetic construct
  source 1..20: mol_type = other DNA
gagcgccggagcggagggag

SEQ ID NO: 18671 - DNA, 20 bp, synthetic construct
  source 1..20: mol_type = other DNA
ccatggccgcctctcccgga

SEQ ID NO: 18672 - DNA, 20 bp, synthetic construct
  source 1..20: mol_type = other DNA
gataatcggcgcccggggcc

SEQ ID NO: 18673 - DNA, 20 bp, synthetic construct
  source 1..20: mol_type = other DNA
actgtgcacgagcgaagggt

SEQ ID NO: 18674 - DNA, 20 bp, synthetic construct
  source 1..20: mol_type = other DNA
cggtagtcgattggtcaagt

SEQ ID NO: 18675 - DNA, 20 bp, synthetic construct
  source 1..20: mol_type = other DNA
tcctgctcggcggagtggtg

SEQ ID NO: 18676 - DNA, 20 bp, synthetic construct
  source 1..20: mol_type = other DNA
actgtcacatggtgcgcgct

SEQ ID NO: 18677 - DNA, 20 bp, synthetic construct
  source 1..20: mol_type = other DNA
tccgtccgctcgccgcaccg

SEQ ID NO: 18678 - DNA, 20 bp, synthetic construct
  source 1..20: mol_type = other DNA
cgggtttgatatttgacaaa

SEQ ID NO: 18679 - DNA, 20 bp, synthetic construct
  source 1..20: mol_type = other DNA
cctctacccacccgccgcac

SEQ ID NO: 18680 - DNA, 20 bp, synthetic construct
  source 1..20: mol_type = other DNA
ggcggcgaggagagcggtgc

SEQ ID NO: 18681 - DNA, 20 bp, synthetic construct
  source 1..20: mol_type = other DNA
ggactcgagtctcaaccggg

SEQ ID NO: 18682 - DNA, 20 bp, synthetic construct
  source 1..20: mol_type = other DNA
gttggtcctggagcggcgca

SEQ ID NO: 18683 - DNA, 20 bp, synthetic construct
  source 1..20: mol_type = other DNA
cgagcagcagagtccgcacg

SEQ ID NO: 18684 - DNA, 20 bp, synthetic construct
  source 1..20: mol_type = other DNA
cgtgcacattgctttgcttg

SEQ ID NO: 18685 - DNA, 20 bp, synthetic construct
  source 1..20: mol_type = other DNA
cggtagcgggagcggagagc

SEQ ID NO: 18686 - DNA, 20 bp, synthetic construct
  source 1..20: mol_type = other DNA
ccctcggagtcaccgtggcc

SEQ ID NO: 18687 - DNA, 20 bp, synthetic construct
  source 1..20: mol_type = other DNA
gcgcggcatagcccggctcg

SEQ ID NO: 18688 - DNA, 20 bp, synthetic construct
  source 1..20: mol_type = other DNA
ttctttcggttctacctggg

SEQ ID NO: 18689 - DNA, 20 bp, synthetic construct
  source 1..20: mol_type = other DNA
cggacgcagtctggccgcca

SEQ ID NO: 18690 - DNA, 20 bp, synthetic construct
  source 1..20: mol_type = other DNA
ggctctcggctgcagcgctg

SEQ ID NO: 18691 - DNA, 20 bp, synthetic construct
  source 1..20: mol_type = other DNA
cggcgcaggggcggagcgaa

SEQ ID NO: 18692 - DNA, 20 bp, synthetic construct
  source 1..20: mol_type = other DNA
aacaaaaagcaacacccccc

SEQ ID NO: 18693 - DNA, 20 bp, synthetic construct
  source 1..20: mol_type = other DNA
cccatcacttaataaatagc

SEQ ID NO: 18694 - DNA, 20 bp, synthetic construct
  source 1..20: mol_type = other DNA
ttcactgccataaatgtggg

SEQ ID NO: 18695 - DNA, 20 bp, synthetic construct
  source 1..20: mol_type = other DNA
cagccattccgaaggtcaag

SEQ ID NO: 18696 - DNA, 20 bp, synthetic construct
  source 1..20: mol_type = other DNA
ggatgatccatcggtccacg

SEQ ID NO: 18697 - DNA, 20 bp, synthetic construct
  source 1..20: mol_type = other DNA
caccaaagattgagacggac

SEQ ID NO: 18698 - DNA, 20 bp, synthetic construct
  source 1..20: mol_type = other DNA
tgaaagaagagatggagaaa

SEQ ID NO: 18699 - DNA, 20 bp, synthetic construct
  source 1..20: mol_type = other DNA
ggcggtgccccataggatgt

SEQ ID NO: 18700 - DNA, 20 bp, synthetic construct
  source 1..20: mol_type = other DNA
cgaaacacagagtagtgtcc

SEQ ID NO: 18701 - DNA, 20 bp, synthetic construct
  source 1..20: mol_type = other DNA
caaaaacaagtcccatgtcc

SEQ ID NO: 18702 - DNA, 20 bp, synthetic construct
  source 1..20: mol_type = other DNA
agtagactccttcgaacgta

SEQ ID NO: 18703 - DNA, 20 bp, synthetic construct
  source 1..20: mol_type = other DNA
ctaaagacattgtcaccgag

SEQ ID NO: 18704 - DNA, 20 bp, synthetic construct
  source 1..20: mol_type = other DNA
gcttaagaatttaagctctg

SEQ ID NO: 18705 - DNA, 20 bp, synthetic construct
  source 1..20: mol_type = other DNA
tgtgtgtgtgtgtgtgtgtg

SEQ ID NO: 18706 - DNA, 20 bp, synthetic construct
  source 1..20: mol_type = other DNA
cccatcctctctctgtgccc

SEQ ID NO: 18707 - DNA, 20 bp, synthetic construct
  source 1..20: mol_type = other DNA
caagatggctattggtctgc

SEQ ID NO: 18708 - DNA, 20 bp, synthetic construct
  source 1..20: mol_type = other DNA
actcttaagtgcataatgat

SEQ ID NO: 18709 - DNA, 20 bp, synthetic construct
  source 1..20: mol_type = other DNA
ggtgctcacagaaccctttt

SEQ ID NO: 18710 - DNA, 20 bp, synthetic construct
  source 1..20: mol_type = other DNA
aactacccaactatgttgtg

SEQ ID NO: 18711 - DNA, 20 bp, synthetic construct
  source 1..20: mol_type = other DNA
tgaaaagctgtgtcgtgttc

SEQ ID NO: 18712 - DNA, 20 bp, synthetic construct
  source 1..20: mol_type = other DNA
tgtgatccctacctgctccc

SEQ ID NO: 18713 - DNA, 20 bp, synthetic construct
  source 1..20: mol_type = other DNA
cctggactaccagcggatgt

SEQ ID NO: 18714 - DNA, 20 bp, synthetic construct
  source 1..20: mol_type = other DNA
gatcctggattacaaggatt

SEQ ID NO: 18715 - DNA, 20 bp, synthetic construct
  source 1..20: mol_type = other DNA
agggtaccaggatgttcggg

SEQ ID NO: 18716 - DNA, 20 bp, synthetic construct
  source 1..20: mol_type = other DNA
ccaggcaccagaccccagcg

SEQ ID NO: 18717 - DNA, 20 bp, synthetic construct
  source 1..20: mol_type = other DNA
atggcgtagaaatttctatg

SEQ ID NO: 18718 - DNA, 20 bp, synthetic construct
  source 1..20: mol_type = other DNA
tttgtcctgctgtgttgcag

SEQ ID NO: 18719 - DNA, 20 bp, synthetic construct
  source 1..20: mol_type = other DNA
caagtagaatagtttctgag

SEQ ID NO: 18720 - DNA, 20 bp, synthetic construct
  source 1..20: mol_type = other DNA
gtgtgtgtgtgtgtgtgtgt

SEQ ID NO: 18721 - DNA, 20 bp, synthetic construct
  source 1..20: mol_type = other DNA
cctcttccttggtctacata

SEQ ID NO: 18722 - DNA, 20 bp, synthetic construct
  source 1..20: mol_type = other DNA
atgtccatcctggtcacagc

SEQ ID NO: 18723 - DNA, 20 bp, synthetic construct
  source 1..20: mol_type = other DNA
tgggaacatttgacttcctt

SEQ ID NO: 18724 - DNA, 20 bp, synthetic construct
  source 1..20: mol_type = other DNA
gcacagctagctatgcatct

SEQ ID NO: 18725 - DNA, 20 bp, synthetic construct
  source 1..20: mol_type = other DNA
agacaggtgaccgctccagg

SEQ ID NO: 18726 - DNA, 20 bp, synthetic construct
  source 1..20: mol_type = other DNA
ctgtacttcctatgccagcc

SEQ ID NO: 18727 - DNA, 20 bp, synthetic construct
  source 1..20: mol_type = other DNA
tctggtgggcgggcgggagc

SEQ ID NO: 18728 - DNA, 20 bp, synthetic construct
  source 1..20: mol_type = other DNA
gtggattgacaccacggctt

SEQ ID NO: 18729 - DNA, 20 bp, synthetic construct
  source 1..20: mol_type = other DNA
tgcagacaccatcaaggacc

SEQ ID NO: 18730 - DNA, 20 bp, synthetic construct
  source 1..20: mol_type = other DNA
gcgcgagggggaccagctga

SEQ ID NO: 18731 - DNA, 20 bp, synthetic construct
  source 1..20: mol_type = other DNA
gtgtccgggatgtgtggcca

SEQ ID NO: 18732 - DNA, 20 bp, synthetic construct
  source 1..20: mol_type = other DNA
ttacccatgactcagcctgg

SEQ ID NO: 18733 - DNA, 20 bp, synthetic construct
  source 1..20: mol_type = other DNA
gtagctgaggactggtctga

SEQ ID NO: 18734 - DNA, 20 bp, synthetic construct
  source 1..20: mol_type = other DNA
tacacagctatggaataccg

SEQ ID NO: 18735 - DNA, 20 bp, synthetic construct
  source 1..20: mol_type = other DNA
tttctggatgtattgattca

SEQ ID NO: 18736 - DNA, 20 bp, synthetic construct
  source 1..20: mol_type = other DNA
tatattcccccaaaagccaa

SEQ ID NO: 18737 - DNA, 20 bp, synthetic construct
  source 1..20: mol_type = other DNA
agcgcttagatatggtgccg

SEQ ID NO: 18738 - DNA, 20 bp, synthetic construct
  source 1..20: mol_type = other DNA
ctggtgcctctcggctgccc

SEQ ID NO: 18739 - DNA, 20 bp, synthetic construct
  source 1..20: mol_type = other DNA
agaccatggatcacaaccgg

SEQ ID NO: 18740 - DNA, 20 bp, synthetic construct
  source 1..20: mol_type = other DNA
ggcgaagggtatgtggcgag

SEQ ID NO: 18741 - DNA, 20 bp, synthetic construct
  source 1..20: mol_type = other DNA
gatcattcccttttagaagg

SEQ ID NO: 18742 - DNA, 20 bp, synthetic construct
  source 1..20: mol_type = other DNA
gtgcagtattgcattcatta

SEQ ID NO: 18743 - DNA, 20 bp, synthetic construct
  source 1..20: mol_type = other DNA
tcctcctgcctcagcctccc

SEQ ID NO: 18744 - DNA, 20 bp, synthetic construct
  source 1..20: mol_type = other DNA
atatgagccactggcctggc

SEQ ID NO: 18745 - DNA, 20 bp, synthetic construct
  source 1..20: mol_type = other DNA
agccttgaatggcccttgtc

SEQ ID NO: 18746 - DNA, 20 bp, synthetic construct
  source 1..20: mol_type = other DNA
ctcgagccactcccaggacg

SEQ ID NO: 18747 - DNA, 20 bp, synthetic construct
  source 1..20: mol_type = other DNA
agtggcgcggaccttcattt

SEQ ID NO: 18748 - DNA, 20 bp, synthetic construct
  source 1..20: mol_type = other DNA
cctgaccagccatgggggct

SEQ ID NO: 18749 - DNA, 20 bp, synthetic construct
  source 1..20: mol_type = other DNA
tcttggtccatgtgaccgac

SEQ ID NO: 18750 - DNA, 20 bp, synthetic construct
  source 1..20: mol_type = other DNA
ataccttttggggagttgtg

SEQ ID NO: 18751 - DNA, 20 bp, synthetic construct
  source 1..20: mol_type = other DNA
taccctaaactgcctttttt

SEQ ID NO: 18752 - DNA, 20 bp, synthetic construct
  source 1..20: mol_type = other DNA
gtttgggaactggcattact

SEQ ID NO: 18753 - DNA, 20 bp, synthetic construct
  source 1..20: mol_type = other DNA
ggactcagcattgcaaccat

SEQ ID NO: 18754 - DNA, 20 bp, synthetic construct
  source 1..20: mol_type = other DNA
ttctgtccagatgttgaatt

SEQ ID NO: 18755 - DNA, 20 bp, synthetic construct
  source 1..20: mol_type = other DNA
aagaaggggaaagaccaatc

SEQ ID NO: 18756 - DNA, 20 bp, synthetic construct
  source 1..20: mol_type = other DNA
cctacatatgagacaacata

SEQ ID NO: 18757 - DNA, 20 bp, synthetic construct
  source 1..20: mol_type = other DNA
tttggaaaacatatgtgatg

SEQ ID NO: 18758 - DNA, 20 bp, synthetic construct
  source 1..20: mol_type = other DNA
aaaagctattagaagtaaag

SEQ ID NO: 18759 - DNA, 20 bp, synthetic construct
  source 1..20: mol_type = other DNA
ctcttcggtgctaggaaaga

SEQ ID NO: 18760 - DNA, 20 bp, synthetic construct
  source 1..20: mol_type = other DNA
tatacccagccatgaaacaa

SEQ ID NO: 18761 - DNA, 20 bp, synthetic construct
  source 1..20: mol_type = other DNA
tttcaatgtatgtttccatt

SEQ ID NO: 18762 - DNA, 20 bp, synthetic construct
  source 1..20: mol_type = other DNA
agccttttcctaatgcagct

SEQ ID NO: 18763 - DNA, 20 bp, synthetic construct
  source 1..20: mol_type = other DNA
acgggaggccttcacatatt

SEQ ID NO: 18764 - DNA, 20 bp, synthetic construct
  source 1..20: mol_type = other DNA
cctgtctacctttcatgacc

SEQ ID NO: 18765 - DNA, 20 bp, synthetic construct
  source 1..20: mol_type = other DNA
accccaaatttggacttttg

SEQ ID NO: 18766 - DNA, 20 bp, synthetic construct
  source 1..20: mol_type = other DNA
ggaccaccaagaaggcccgg

SEQ ID NO: 18767 - DNA, 20 bp, synthetic construct
  source 1..20: mol_type = other DNA
gaaatcaatggctatacatt

SEQ ID NO: 18768 - DNA, 20 bp, synthetic construct
  source 1..20: mol_type = other DNA
gccaatcagccacccccttt

SEQ ID NO: 18769 - DNA, 20 bp, synthetic construct
  source 1..20: mol_type = other DNA
gaacatggatgttgatatat

SEQ ID NO: 18770 - DNA, 20 bp, synthetic construct
  source 1..20: mol_type = other DNA
ggtgaggtagagctgcaatg

SEQ ID NO: 18771 - DNA, 20 bp, synthetic construct
  source 1..20: mol_type = other DNA
atgagtaaagaaagagatgt

SEQ ID NO: 18772 - DNA, 20 bp, synthetic construct
  source 1..20: mol_type = other DNA
tccattaactttggaccatg

SEQ ID NO: 18773 - DNA, 20 bp, synthetic construct
  source 1..20: mol_type = other DNA
atttccttctgtgggcattg

SEQ ID NO: 18774 - DNA, 20 bp, synthetic construct
  source 1..20: mol_type = other DNA
ctttccctgcccggtcccga

SEQ ID NO: 18775 - DNA, 20 bp, synthetic construct
  source 1..20: mol_type = other DNA
acagttcagaaaagaaaatc

SEQ ID NO: 18776 - DNA, 20 bp, synthetic construct
  source 1..20: mol_type = other DNA
tgtgatgttcaatgtaaagc

SEQ ID NO: 18777 - DNA, 20 bp, synthetic construct
  source 1..20: mol_type = other DNA
gtagaagcagaaaattctaa

SEQ ID NO: 18778 - DNA, 20 bp, synthetic construct
  source 1..20: mol_type = other DNA
tttgaagaaatcaagttcag

SEQ ID NO: 18779 - DNA, 20 bp, synthetic construct
  source 1..20: mol_type = other DNA
actgacttggactttcctga

SEQ ID NO: 18780 - DNA, 20 bp, synthetic construct
  source 1..20: mol_type = other DNA
caaggaaaaagtaaaagaag

SEQ ID NO: 18781 - DNA, 20 bp, synthetic construct
  source 1..20: mol_type = other DNA
gccgtgagtcctcggtgctc

SEQ ID NO: 18782 - DNA, 20 bp, synthetic construct
  source 1..20: mol_type = other DNA
gtattagcagagccacaggc

SEQ ID NO: 18783 - DNA, 20 bp, synthetic construct
  source 1..20: mol_type = other DNA
ccccctcctcactggccctt

SEQ ID NO: 18784 - DNA, 20 bp, synthetic construct
  source 1..20: mol_type = other DNA
acctctagaatcccagcagc

SEQ ID NO: 18785 - DNA, 20 bp, synthetic construct
  source 1..20: mol_type = other DNA
tcaccacgtgcagtatctca

SEQ ID NO: 18786 - DNA, 20 bp, synthetic construct
  source 1..20: mol_type = other DNA
ggttaggactctccactcaa

SEQ ID NO: 18787 - DNA, 20 bp, synthetic construct
  source 1..20: mol_type = other DNA
gctgcaaagtgccgaaacaa

SEQ ID NO: 18788 - DNA, 20 bp, synthetic construct
  source 1..20: mol_type = other DNA
tttctctgaagaagagggtc

SEQ ID NO: 18789 - DNA, 20 bp, synthetic construct
  source 1..20: mol_type = other DNA
ttgcttgtcccccaggagtc

SEQ ID NO: 18790 - DNA, 20 bp, synthetic construct
  source 1..20: mol_type = other DNA
gcctgcagtgattcagcagg

SEQ ID NO: 18791 - DNA, 20 bp, synthetic construct
  source 1..20: mol_type = other DNA
gcttgtcagcaagaggagga

SEQ ID NO: 18792 - DNA, 20 bp, synthetic construct
  source 1..20: mol_type = other DNA
ctaggctggaagagccaaag

SEQ ID NO: 18793 - DNA, 20 bp, synthetic construct
  source 1..20: mol_type = other DNA
tccctaatcacgtggtgaat

SEQ ID NO: 18794 - DNA, 20 bp, synthetic construct
  source 1..20: mol_type = other DNA
tttttgaagccatccgcaga

SEQ ID NO: 18795 - DNA, 20 bp, synthetic construct
  source 1..20: mol_type = other DNA
atccacctctcctttttgcc

SEQ ID NO: 18796 - DNA, 20 bp, synthetic construct
  source 1..20: mol_type = other DNA
cattcttctgctgggtgcca

SEQ ID NO: 18797 - DNA, 20 bp, synthetic construct
  source 1..20: mol_type = other DNA
gagctaggggtgcctgtaag

SEQ ID NO: 18798 - DNA, 20 bp, synthetic construct
  source 1..20: mol_type = other DNA
tttaaagagacatcatcctg

SEQ ID NO: 18799 - DNA, 20 bp, synthetic construct
  source 1..20: mol_type = other DNA
ttcccacccctaataacatt

SEQ ID NO: 18800 - DNA, 20 bp, synthetic construct
  source 1..20: mol_type = other DNA
aacactattgtgctgtttgc

SEQ ID NO: 18801 - DNA, 20 bp, synthetic construct
  source 1..20: mol_type = other DNA
ttttgctcaggttgtaccca

SEQ ID NO: 18802 - DNA, 20 bp, synthetic construct
  source 1..20: mol_type = other DNA
gaccctgaaggatgaatatg

SEQ ID NO: 18803 - DNA, 20 bp, synthetic construct
  source 1..20: mol_type = other DNA
ggacaatgtggatactcatc

SEQ ID NO: 18804 - DNA, 20 bp, synthetic construct
  source 1..20: mol_type = other DNA
gctgtctgctaagttcctgc

SEQ ID NO: 18805 - DNA, 20 bp, synthetic construct
  source 1..20: mol_type = other DNA
gtcgccctctggctcgcacg

SEQ ID NO: 18806 - DNA, 20 bp, synthetic construct
  source 1..20: mol_type = other DNA
catacctcacttgggggagc

SEQ ID NO: 18807 - DNA, 20 bp, synthetic construct
  source 1..20: mol_type = other DNA
ttaagcattggattaacgga

SEQ ID NO: 18808 - DNA, 20 bp, synthetic construct
  source 1..20: mol_type = other DNA
ctgcagaaagagcttgcaga

SEQ ID NO: 18809 - DNA, 20 bp, synthetic construct
  source 1..20: mol_type = other DNA
tctatcactaatatctttgg

SEQ ID NO: 18810 - DNA, 20 bp, synthetic construct
  source 1..20: mol_type = other DNA
ttactggccactggaggcat

SEQ ID NO: 18811 - DNA, 20 bp, synthetic construct
  source 1..20: mol_type = other DNA
tgggctcctgcagccctgtc

SEQ ID NO: 18812 - DNA, 20 bp, synthetic construct
  source 1..20: mol_type = other DNA
cttagcagaggctcaggttc

SEQ ID NO: 18813 - DNA, 20 bp, synthetic construct
  source 1..20: mol_type = other DNA
gctctctttcccccacaaaa

SEQ ID NO: 18814 - DNA, 20 bp, synthetic construct
  source 1..20: mol_type = other DNA
gtgaagaggcgacccagagt

SEQ ID NO: 18815 - DNA, 20 bp, synthetic construct
  source 1..20: mol_type = other DNA
ttacctcccagcagggcagc

SEQ ID NO: 18816 - DNA, 20 bp, synthetic construct
  source 1..20: mol_type = other DNA
agctctaatttgccttgggc

SEQ ID NO: 18817 - DNA, 20 bp, synthetic construct
  source 1..20: mol_type = other DNA
ataagtagaccacttatccc

SEQ ID NO: 18818 - DNA, 20 bp, synthetic construct
  source 1..20: mol_type = other DNA
tacgcccctgcactccagcc

SEQ ID NO: 18819 - DNA, 20 bp, synthetic construct
  source 1..20: mol_type = other DNA
tgcgctataactctacctaa

SEQ ID NO: 18820 - DNA, 20 bp, synthetic construct
  source 1..20: mol_type = other DNA
ctctagctcccacttcctct

SEQ ID NO: 18821 - DNA, 20 bp, synthetic construct
  source 1..20: mol_type = other DNA
atttgttggctgtctgctgt

SEQ ID NO: 18822 - DNA, 20 bp, synthetic construct
  source 1..20: mol_type = other DNA
tcctaatttttactccctct

SEQ ID NO: 18823 - DNA, 20 bp, synthetic construct
  source 1..20: mol_type = other DNA
gcggggcctgcgctcagccc

SEQ ID NO: 18824 - DNA, 20 bp, synthetic construct
  source 1..20: mol_type = other DNA
gctgggtaggtgcacttggt

SEQ ID NO: 18825 - DNA, 20 bp, synthetic construct
  source 1..20: mol_type = other DNA
tcagagtgagcccggatggg

SEQ ID NO: 18826 - DNA, 20 bp, synthetic construct
  source 1..20: mol_type = other DNA
gtagctttattcagaatctg

SEQ ID NO: 18827 - DNA, 20 bp, synthetic construct
  source 1..20: mol_type = other DNA
tcgaggactaacccctacag

SEQ ID NO: 18828 - DNA, 20 bp, synthetic construct
  source 1..20: mol_type = other DNA
tgggaaccaaaggatgatgc

SEQ ID NO: 18829 - DNA, 20 bp, synthetic construct
  source 1..20: mol_type = other DNA
tgttgaacacttgaagccat

SEQ ID NO: 18830 - DNA, 20 bp, synthetic construct
  source 1..20: mol_type = other DNA
gcctgcaccccggagcggat

SEQ ID NO: 18831 - DNA, 20 bp, synthetic construct
  source 1..20: mol_type = other DNA
cagtgaatgtgtctggacct

SEQ ID NO: 18832 - DNA, 20 bp, synthetic construct
  source 1..20: mol_type = other DNA
agctgcagggtggattgtta

SEQ ID NO: 18833 - DNA, 20 bp, synthetic construct
  source 1..20: mol_type = other DNA
cagaatgcttcaagtgtttg

SEQ ID NO: 18834 - DNA, 20 bp, synthetic construct
  source 1..20: mol_type = other DNA
atccagtaataaaatggaag

SEQ ID NO: 18835 - DNA, 20 bp, synthetic construct
  source 1..20: mol_type = other DNA
cctgcactctcagaaatcag

SEQ ID NO: 18836 - DNA, 20 bp, synthetic construct
  source 1..20: mol_type = other DNA
gactatgaaaatccagatga

SEQ ID NO: 18837 - DNA, 20 bp, synthetic construct
  source 1..20: mol_type = other DNA
tccccacccttcagcaagac

SEQ ID NO: 18838 - DNA, 20 bp, synthetic construct
  source 1..20: mol_type = other DNA
gaaaactatattcatcccac

SEQ ID NO: 18839 - DNA, 20 bp, synthetic construct
  source 1..20: mol_type = other DNA
ttgccacgggccgggaaaaa

SEQ ID NO: 18840 - DNA, 20 bp, synthetic construct
  source 1..20: mol_type = other DNA
tggttggtgttggccgagcc

SEQ ID NO: 18841 - DNA, 20 bp, synthetic construct
  source 1..20: mol_type = other DNA
tgatggaggaattcgctttc

SEQ ID NO: 18842 - DNA, 20 bp, synthetic construct
  source 1..20: mol_type = other DNA
gagaagggagctcgggagca

SEQ ID NO: 18843 - DNA, 20 bp, synthetic construct
  source 1..20: mol_type = other DNA
gtcattggcggccgctcagg

SEQ ID NO: 18844 - DNA, 20 bp, synthetic construct
  source 1..20: mol_type = other DNA
aaaaggacctggtctaaaac

SEQ ID NO: 18845 - DNA, 20 bp, synthetic construct
  source 1..20: mol_type = other DNA
agcgaattgcatcgtcctcg

SEQ ID NO: 18846 - DNA, 20 bp, synthetic construct
  source 1..20: mol_type = other DNA
tggctggaatgtcatggact

SEQ ID NO: 18847 - DNA, 20 bp, synthetic construct
  source 1..20: mol_type = other DNA
tgggaccaaatgtcagccct

SEQ ID NO: 18848 - DNA, 20 bp, synthetic construct
  source 1..20: mol_type = other DNA
ccccctcatcatcatcggct

SEQ ID NO: 18849 - DNA, 20 bp, synthetic construct
  source 1..20: mol_type = other DNA
ggaggtggcagaagtgagtc

SEQ ID NO: 18850 - DNA, 20 bp, synthetic construct
  source 1..20: mol_type = other DNA
gggcgaggccgagcgaggca

SEQ ID NO: 18851 - DNA, 20 bp, synthetic construct
  source 1..20: mol_type = other DNA
ccagagcccagccaagatgg

SEQ ID NO: 18852 - DNA, 20 bp, synthetic construct
  source 1..20: mol_type = other DNA
cgaccgtggggaagacggcc

SEQ ID NO: 18853 - DNA, 20 bp, synthetic construct
  source 1..20: mol_type = other DNA
tgtgcagcccaacgcacctc

SEQ ID NO: 18854 - DNA, 20 bp, synthetic construct
  source 1..20: mol_type = other DNA
ccccttcttctttgtcaata

SEQ ID NO: 18855 - DNA, 20 bp, synthetic construct
  source 1..20: mol_type = other DNA
gtaccgcatgtggcagttcg

SEQ ID NO: 18856 - DNA, 20 bp, synthetic construct
  source 1..20: mol_type = other DNA
gctgaaagtcatggcttttg

SEQ ID NO: 18857 - DNA, 20 bp, synthetic construct
  source 1..20: mol_type = other DNA
agatgagttccaaatcactg

SEQ ID NO: 18858 - DNA, 20 bp, synthetic construct
  source 1..20: mol_type = other DNA
gatgatcatggagtactacc

SEQ ID NO: 18859 - DNA, 20 bp, synthetic construct
  source 1..20: mol_type = other DNA
ctccgacagcgagcactacc

SEQ ID NO: 18860 - DNA, 20 bp, synthetic construct
  source 1..20: mol_type = other DNA
cagcgagggccgagagcaca

SEQ ID NO: 18861 - DNA, 20 bp, synthetic construct
  source 1..20: mol_type = other DNA
caggatggagaggcgggtcc

SEQ ID NO: 18862 - DNA, 20 bp, synthetic construct
  source 1..20: mol_type = other DNA
acaccagctcctgtgctgcg

SEQ ID NO: 18863 - DNA, 20 bp, synthetic construct
  source 1..20: mol_type = other DNA
cgccacctggatgctggagg

SEQ ID NO: 18864 - DNA, 20 bp, synthetic construct
  source 1..20: mol_type = other DNA
cgtggacatctgagggcgcc

SEQ ID NO: 18865 - DNA, 20 bp, synthetic construct
  source 1..20: mol_type = other DNA
ccgaggggaaggggcggtgc

SEQ ID NO: 18866 - DNA, 20 bp, synthetic construct
  source 1..20: mol_type = other DNA
tggggcaagggcacaagtcc

SEQ ID NO: 18867 - DNA, 20 bp, synthetic construct
  source 1..20: mol_type = other DNA
aaagggaccgcttggagcag

SEQ ID NO: 18868 - DNA, 20 bp, synthetic construct
  source 1..20: mol_type = other DNA
acagcgacaaagtgaaagcc

SEQ ID NO: 18869 - DNA, 20 bp, synthetic construct
  source 1..20: mol_type = other DNA
tggcgcgggagtacggatcc

SEQ ID NO: 18870 - DNA, 20 bp, synthetic construct
  source 1..20: mol_type = other DNA
attcggaaatcgatcagatc

SEQ ID NO: 18871 - DNA, 20 bp, synthetic construct
  source 1..20: mol_type = other DNA
tcatgaacaagttcctgacc

SEQ ID NO: 18872 - DNA, 20 bp, synthetic construct
  source 1..20: mol_type = other DNA
tggtcccctctcctctccgc

SEQ ID NO: 18873 - DNA, 20 bp, synthetic construct
  source 1..20: mol_type = other DNA
cgggctgcgtaggggcgctt

SEQ ID NO: 18874 - DNA, 20 bp, synthetic construct
  source 1..20: mol_type = other DNA
caatgcgcaggaataaggaa

SEQ ID NO: 18875 - DNA, 20 bp, synthetic construct
  source 1..20: mol_type = other DNA
cgctaagctccagtcggcgc

SEQ ID NO: 18876 - DNA, 20 bp, synthetic construct
  source 1..20: mol_type = other DNA
actctggagctcccattctt

SEQ ID NO: 18877 - DNA, 20 bp, synthetic construct
  source 1..20: mol_type = other DNA
cttccctgtctgatccttag

SEQ ID NO: 18878 - DNA, 20 bp, synthetic construct
  source 1..20: mol_type = other DNA
tggcatggcaatggttagag

SEQ ID NO: 18879 - DNA, 20 bp, synthetic construct
  source 1..20: mol_type = other DNA
aaggagccaggagttaatac

SEQ ID NO: 18880 - DNA, 20 bp, synthetic construct
  source 1..20: mol_type = other DNA
tcacctggaaggggagttac

SEQ ID NO: 18881 - DNA, 20 bp, synthetic construct
  source 1..20: mol_type = other DNA
gcagaaagctgaggaggctg

SEQ ID NO: 18882 - DNA, 20 bp, synthetic construct
  source 1..20: mol_type = other DNA
ggtcaccaaggggcagctgg

SEQ ID NO: 18883 - DNA, 20 bp, synthetic construct
  source 1..20: mol_type = other DNA
tcatcaagacctgtggaaga

SEQ ID NO: 18884 - DNA, 20 bp, synthetic construct
  source 1..20: mol_type = other DNA
tttggccctcctgacccaga

SEQ ID NO: 18885 - DNA, 20 bp, synthetic construct
  source 1..20: mol_type = other DNA
ggagctagagaagtgtaggt

SEQ ID NO: 18886 - DNA, 20 bp, synthetic construct
  source 1..20: mol_type = other DNA
gaggagagaccaggagctga

SEQ ID NO: 18887 - DNA, 20 bp, synthetic construct
  source 1..20: mol_type = other DNA
cctcctcctgtcccagcgag

SEQ ID NO: 18888 - DNA, 20 bp, synthetic construct
  source 1..20: mol_type = other DNA
ggcccagggacaggaggaga

SEQ ID NO: 18889 - DNA, 20 bp, synthetic construct
  source 1..20: mol_type = other DNA
ggaggtgctgggagacctaa

SEQ ID NO: 18890 - DNA, 20 bp, synthetic construct
  source 1..20: mol_type = other DNA
ggcactctccctagcgcaga

SEQ ID NO: 18891 - DNA, 20 bp, synthetic construct
  source 1..20: mol_type = other DNA
cacagcagaactggggtcca

SEQ ID NO: 18892 - DNA, 20 bp, synthetic construct
  source 1..20: mol_type = other DNA
ggcagagacccgcaggctgg

SEQ ID NO: 18893 - DNA, 20 bp, synthetic construct
  source 1..20: mol_type = other DNA
gtttgccaaaggaaaagcct

SEQ ID NO: 18894 - DNA, 20 bp, synthetic construct
  source 1..20: mol_type = other DNA
tagagagagcgcgctctgct

SEQ ID NO: 18895 - DNA, 20 bp, synthetic construct
  source 1..20: mol_type = other DNA
tttatttatttttcgttttt

SEQ ID NO: 18896 - DNA, 20 bp, synthetic construct
  source 1..20: mol_type = other DNA
cagcagctctgaatcttctg

SEQ ID NO: 18897 - DNA, 20 bp, synthetic construct
  source 1..20: mol_type = other DNA
tcggaagccggcaccctcaa

SEQ ID NO: 18898 - DNA, 20 bp, synthetic construct
  source 1..20: mol_type = other DNA
tgatttcaagtccaaccata

SEQ ID NO: 18899 - DNA, 20 bp, synthetic construct
  source 1..20: mol_type = other DNA
gctagagcctttccttctcc

SEQ ID NO: 18900 - DNA, 20 bp, synthetic construct
  source 1..20: mol_type = other DNA
ctctgcttctgagagtgaaa

SEQ ID NO: 18901 - DNA, 20 bp, synthetic construct
  source 1..20: mol_type = other DNA
agcacgtgatgctgagctgg

SEQ ID NO: 18902 - DNA, 20 bp, synthetic construct
  source 1..20: mol_type = other DNA
gatttatgaacatggctatg

SEQ ID NO: 18903 - DNA, 20 bp, synthetic construct
  source 1..20: mol_type = other DNA
tattacagcaggaagtgaac

SEQ ID NO: 18904 - DNA, 20 bp, synthetic construct
  source 1..20: mol_type = other DNA
agaagaggagcaaaagaaga

SEQ ID NO: 18905 - DNA, 20 bp, synthetic construct
  source 1..20: mol_type = other DNA
gcgacatatggatgcccacc

SEQ ID NO: 18906 - DNA, 20 bp, synthetic construct
  source 1..20: mol_type = other DNA
ccaccagcaggatttccgac

SEQ ID NO: 18907 - DNA, 20 bp, synthetic construct
  source 1..20: mol_type = other DNA
tttgacgggcacttggagga

SEQ ID NO: 18908 - DNA, 20 bp, synthetic construct
  source 1..20: mol_type = other DNA
ggacctggtgaacagtgtgt

SEQ ID NO: 18909 - DNA, 20 bp, synthetic construct
  source 1..20: mol_type = other DNA
atgtgaaacctgtgggtggg

SEQ ID NO: 18910 - DNA, 20 bp, synthetic construct
  source 1..20: mol_type = other DNA
tggctgactgagtactgtga

SEQ ID NO: 18911 - DNA, 20 bp, synthetic construct
  source 1..20: mol_type = other DNA
ggagaaggggatgcagaggc

SEQ ID NO: 18912 - DNA, 20 bp, synthetic construct
  source 1..20: mol_type = other DNA
ctatggccttagaaaagggc

SEQ ID NO: 18913 - DNA, 20 bp, synthetic construct
  source 1..20: mol_type = other DNA
tgcaggcgcagccgcggcga

SEQ ID NO: 18914 - DNA, 20 bp, synthetic construct
  source 1..20: mol_type = other DNA
ggcagccatgtccatgggcc

SEQ ID NO: 18915 - DNA, 20 bp, synthetic construct
  source 1..20: mol_type = other DNA
gagcaccggccagatgcagt

SEQ ID NO: 18916 - DNA, 20 bp, synthetic construct
  source 1..20: mol_type = other DNA
caagatcaccatcgtggcag

SEQ ID NO: 18917 - DNA, 20 bp, synthetic construct
  source 1..20: mol_type = other DNA
gcagctgctggggggcgcgc

SEQ ID NO: 18918 - DNA, 20 bp, synthetic construct
  source 1..20: mol_type = other DNA
ggggcccagggaccaacctg

SEQ ID NO: 18919 - DNA, 20 bp, synthetic construct
  source 1..20: mol_type = other DNA
aaaaatggaaattttcaaga

SEQ ID NO: 18920 - DNA, 20 bp, synthetic construct
  source 1..20: mol_type = other DNA
ggctggctaccaagagttta

SEQ ID NO: 18921 - DNA, 20 bp, synthetic construct
  source 1..20: mol_type = other DNA
ttttgatcgcgggaggaccg

SEQ ID NO: 18922 - DNA, 20 bp, synthetic construct
  source 1..20: mol_type = other DNA
ggcagaatcagcctgttttg

SEQ ID NO: 18923 - DNA, 20 bp, synthetic construct
  source 1..20: mol_type = other DNA
agttccacccagaggtcacc

SEQ ID NO: 18924 - DNA, 20 bp, synthetic construct
  source 1..20: mol_type = other DNA
tgttttcagataaactaaat

SEQ ID NO: 18925 - DNA, 20 bp, synthetic construct
  source 1..20: mol_type = other DNA
ttgtggctcctgcccagaca

SEQ ID NO: 18926 - DNA, 20 bp, synthetic construct
  source 1..20: mol_type = other DNA
caaactatctctatgttacc

SEQ ID NO: 18927 - DNA, 20 bp, synthetic construct
  source 1..20: mol_type = other DNA
ggccttcctatgttttgagt

SEQ ID NO: 18928 - DNA, 20 bp, synthetic construct
  source 1..20: mol_type = other DNA
tgcagaaatctcgcaaggtg

SEQ ID NO: 18929 - DNA, 20 bp, synthetic construct
  source 1..20: mol_type = other DNA
ttctttttgagatggagtca

SEQ ID NO: 18930 - DNA, 20 bp, synthetic construct
  source 1..20: mol_type = other DNA
atttgattggtgtgctgtct

SEQ ID NO: 18931 - DNA, 20 bp, synthetic construct
  source 1..20: mol_type = other DNA
gctgacaaaatttgttgaag

SEQ ID NO: 18932 - DNA, 20 bp, synthetic construct
  source 1..20: mol_type = other DNA
gaaggatgctacccggaaga

SEQ ID NO: 18933 - DNA, 20 bp, synthetic construct
  source 1..20: mol_type = other DNA
gctcaacgccaacaatgtcc

SEQ ID NO: 18934 - DNA, 20 bp, synthetic construct
  source 1..20: mol_type = other DNA
agctgttgatagtggaatcc

SEQ ID NO: 18935 - DNA, 20 bp, synthetic construct
  source 1..20: mol_type = other DNA
aagttgagaaatgtgacaga

SEQ ID NO: 18936 - DNA, 20 bp, synthetic construct
  source 1..20: mol_type = other DNA
aagtaaggttcattccctta

SEQ ID NO: 18937 - DNA, 20 bp, synthetic construct
  source 1..20: mol_type = other DNA
actagcgcaggagaaggcta

SEQ ID NO: 18938 - DNA, 20 bp, synthetic construct
  source 1..20: mol_type = other DNA
accacagagattaacttcaa

SEQ ID NO: 18939 - DNA, 20 bp, synthetic construct
  source 1..20: mol_type = other DNA
gaactgatcctgaccatgac

SEQ ID NO: 18940 - DNA, 20 bp, synthetic construct
  source 1..20: mol_type = other DNA
cagtcacttctgggggtcac

SEQ ID NO: 18941 - DNA, 20 bp, synthetic construct
  source 1..20: mol_type = other DNA
gttccgtacagggtataaaa

SEQ ID NO: 18942 - DNA, 20 bp, synthetic construct
  source 1..20: mol_type = other DNA
gaccaacgatggggaactga

SEQ ID NO: 18943 - DNA, 20 bp, synthetic construct
  source 1..20: mol_type = other DNA
gctccccttaccccagtcac

SEQ ID NO: 18944 - DNA, 20 bp, synthetic construct
  source 1..20: mol_type = other DNA
ggcggctcgagctcctggaa

SEQ ID NO: 18945 - DNA, 20 bp, synthetic construct
  source 1..20: mol_type = other DNA
tctccggtcccctcctcgga

SEQ ID NO: 18946 - DNA, 20 bp, synthetic construct
  source 1..20: mol_type = other DNA
tttctatacagcagcaacaa

SEQ ID NO: 18947 - DNA, 20 bp, synthetic construct
  source 1..20: mol_type = other DNA
tcatcatctagccaggcatg

SEQ ID NO: 18948 - DNA, 20 bp, synthetic construct
  source 1..20: mol_type = other DNA
tggaagttgctctcaaggga

SEQ ID NO: 18949 - DNA, 20 bp, synthetic construct
  source 1..20: mol_type = other DNA
cctcctcacaaggtttcctg

SEQ ID NO: 18950 - DNA, 20 bp, synthetic construct
  source 1..20: mol_type = other DNA
ggcaagtggcatctgaattt

SEQ ID NO: 18951 - DNA, 20 bp, synthetic construct
  source 1..20: mol_type = other DNA
gcgcgccacaatgagctccc

SEQ ID NO: 18952 - DNA, 20 bp, synthetic construct
  source 1..20: mol_type = other DNA
catggaggaccaggacggcc

SEQ ID NO: 18953 - DNA, 20 bp, synthetic construct
  source 1..20: mol_type = other DNA
tattgttcaaacaacttcat

SEQ ID NO: 18954 - DNA, 20 bp, synthetic construct
  source 1..20: mol_type = other DNA
gaacgtcatgatgatccagt

SEQ ID NO: 18955 - DNA, 20 bp, synthetic construct
  source 1..20: mol_type = other DNA
cgcggagctggccgctggat

SEQ ID NO: 18956 - DNA, 20 bp, synthetic construct
  source 1..20: mol_type = other DNA
tccttacttagcaagactat

SEQ ID NO: 18957 - DNA, 20 bp, synthetic construct
  source 1..20: mol_type = other DNA
ggtgtagaggcccctgccag

SEQ ID NO: 18958 - DNA, 20 bp, synthetic construct
  source 1..20: mol_type = other DNA
gaagctggcaccacagttcc

SEQ ID NO: 18959 - DNA, 20 bp, synthetic construct
  source 1..20: mol_type = other DNA
gcctgggttggcacctactt

SEQ ID NO: 18960 - DNA, 20 bp, synthetic construct
  source 1..20: mol_type = other DNA
gaggatcccaatgcgcctcc

SEQ ID NO: 18961 - DNA, 20 bp, synthetic construct
  source 1..20: mol_type = other DNA
tggtgttgtctgtggagacc

SEQ ID NO: 18962 - DNA, 20 bp, synthetic construct
  source 1..20: mol_type = other DNA
ccagggtgtttcaaacttag

SEQ ID NO: 18963 - DNA, 20 bp, synthetic construct
  source 1..20: mol_type = other DNA
aggggctggaagctggaggg

SEQ ID NO: 18964 - DNA, 20 bp, synthetic construct
  source 1..20: mol_type = other DNA
actgctctccagagggcatt

SEQ ID NO: 18965 - DNA, 20 bp, synthetic construct
  source 1..20: mol_type = other DNA
ttcgcgccgaatccccgggg

SEQ ID NO: 18966 - DNA, 20 bp, synthetic construct
  source 1..20: mol_type = other DNA
ctgctgctgcccctctgggg

SEQ ID NO: 18967 - DNA, 20 bp, synthetic construct
  source 1..20: mol_type = other DNA
attcctgatggcacggctgt

SEQ ID NO: 18968 - DNA, 20 bp, synthetic construct
  source 1..20: mol_type = other DNA
gctgcggatgaacctgtgac

SEQ ID NO: 18969 - DNA, 20 bp, synthetic construct
  source 1..20: mol_type = other DNA
atcgccaataagaagccccc

SEQ ID NO: 18970 - DNA, 20 bp, synthetic construct
  source 1..20: mol_type = other DNA
ccagtcagggatcctgttcc

SEQ ID NO: 18971 - DNA, 20 bp, synthetic construct
  source 1..20: mol_type = other DNA
gcagttgctacccctcccac

SEQ ID NO: 18972 - DNA, 20 bp, synthetic construct
  source 1..20: mol_type = other DNA
actgacaagctgaagctgac

SEQ ID NO: 18973 - DNA, 20 bp, synthetic construct
  source 1..20: mol_type = other DNA
atcactgtgacgggctctgg

SEQ ID NO: 18974 - DNA, 20 bp, synthetic construct
  source 1..20: mol_type = other DNA
gaggagaaggctcccctacc

SEQ ID NO: 18975 - DNA, 20 bp, synthetic construct
  source 1..20: mol_type = other DNA
cgtcccaagaacatgacccc

SEQ ID NO: 18976 - DNA, 20 bp, synthetic construct
  source 1..20: mol_type = other DNA
agtggaggtggagggagcga

SEQ ID NO: 18977 - DNA, 20 bp, synthetic construct
  source 1..20: mol_type = other DNA
cccacgaccaaggggtcttc

SEQ ID NO: 18978 - DNA, 20 bp, synthetic construct
  source 1..20: mol_type = other DNA
tacagcagtttgtacgagct

SEQ ID NO: 18979 - DNA, 20 bp, synthetic construct
  source 1..20: mol_type = other DNA
tccccagggggtactctgga

SEQ ID NO: 18980 - DNA, 20 bp, synthetic construct
  source 1..20: mol_type = other DNA
tcccttggggtgccgagtgg

SEQ ID NO: 18981 - DNA, 20 bp, synthetic construct
  source 1..20: mol_type = other DNA
gaggaagatcatggactgtc

SEQ ID NO: 18982 - DNA, 20 bp, synthetic construct
  source 1..20: mol_type = other DNA
ggactgtggttggatttatg

SEQ ID NO: 18983 - DNA, 20 bp, synthetic construct
  source 1..20: mol_type = other DNA
aagatatttgaatgaaatag

SEQ ID NO: 18984 - DNA, 20 bp, synthetic construct
  source 1..20: mol_type = other DNA
acctgcgtcaggtggcagtt

SEQ ID NO: 18985 - DNA, 20 bp, synthetic construct
  source 1..20: mol_type = other DNA
ttctggtcttaagtataatg

SEQ ID NO: 18986 - DNA, 20 bp, synthetic construct
  source 1..20: mol_type = other DNA
ccagaaagtccatatgctgt

SEQ ID NO: 18987 - DNA, 20 bp, synthetic construct
  source 1..20: mol_type = other DNA
cctagccattgctgatgttt

SEQ ID NO: 18988 - DNA, 20 bp, synthetic construct
  source 1..20: mol_type = other DNA
tgtccagtggctgaagcccc

SEQ ID NO: 18989 - DNA, 20 bp, synthetic construct
  source 1..20: mol_type = other DNA
agaccctaaagggattgttc

SEQ ID NO: 18990 - DNA, 20 bp, synthetic construct
  source 1..20: mol_type = other DNA
agaagacatttgggaataca

SEQ ID NO: 18991 - DNA, 20 bp, synthetic construct
  source 1..20: mol_type = other DNA
ggctggtgatcatcctttta

SEQ ID NO: 18992 - DNA, 20 bp, synthetic construct
  source 1..20: mol_type = other DNA
caagcttcatgtgcaagaac

SEQ ID NO: 18993 - DNA, 20 bp, synthetic construct
  source 1..20: mol_type = other DNA
tccctgggacccttaatttc

SEQ ID NO: 18994 - DNA, 20 bp, synthetic construct
  source 1..20: mol_type = other DNA
tccagactataaaagcggct

SEQ ID NO: 18995 - DNA, 20 bp, synthetic construct
  source 1..20: mol_type = other DNA
cttgatgagctgcctaaatt

SEQ ID NO: 18996 - DNA, 20 bp, synthetic construct
  source 1..20: mol_type = other DNA
agaggcgatgggcctatttg

SEQ ID NO: 18997 - DNA, 20 bp, synthetic construct
  source 1..20: mol_type = other DNA
attgcaacacctggaagact

SEQ ID NO: 18998 - DNA, 20 bp, synthetic construct
  source 1..20: mol_type = other DNA
gcgacttggccaaaagaagt

SEQ ID NO: 18999 - DNA, 20 bp, synthetic construct
  source 1..20: mol_type = other DNA
agtgagaaggagaataaaac

SEQ ID NO: 19000 - DNA, 20 bp, synthetic construct
  source 1..20: mol_type = other DNA
attgctacagatgtggcctc

SEQ ID NO: 19001 - DNA, 20 bp, synthetic construct
  source 1..20: mol_type = other DNA
taaattctgattattaaact

SEQ ID NO: 19002 - DNA, 20 bp, synthetic construct
  source 1..20: mol_type = other DNA
gagccagcacgatggtccta

SEQ ID NO: 19003 - DNA, 20 bp, synthetic construct
  source 1..20: mol_type = other DNA
agcactctgccgctcaagag

SEQ ID NO: 19004 - DNA, 20 bp, synthetic construct
  source 1..20: mol_type = other DNA
ctgcagtaccccactctacg

SEQ ID NO: 19005 - DNA, 20 bp, synthetic construct
  source 1..20: mol_type = other DNA
cgtgttcaacttccccgtct

SEQ ID NO: 19006 - DNA, 20 bp, synthetic construct
  source 1..20: mol_type = other DNA
tggtacattgcttggctggc

SEQ ID NO: 19007 - DNA, 20 bp, synthetic construct
  source 1..20: mol_type = other DNA
tacagcctacccatgcaggg

SEQ ID NO: 19008 - DNA, 20 bp, synthetic construct
  source 1..20: mol_type = other DNA
tttcctcatgattttttctc

SEQ ID NO: 19009 - DNA, 20 bp, synthetic construct
  source 1..20: mol_type = other DNA
gtgcagcctcccgagtgcag

SEQ ID NO: 19010 - DNA, 20 bp, synthetic construct
  source 1..20: mol_type = other DNA
agtaccctgtgcagccagga

SEQ ID NO: 19011 - DNA, 20 bp, synthetic construct
  source 1..20: mol_type = other DNA
ggtcacagggagcaatcatt

SEQ ID NO: 19012 - DNA, 20 bp, synthetic construct
  source 1..20: mol_type = other DNA
tggcatctcacacagtggaa

SEQ ID NO: 19013 - DNA, 20 bp, synthetic construct
  source 1..20: mol_type = other DNA
tggacaaggccaataaaaca

SEQ ID NO: 19014 - DNA, 20 bp, synthetic construct
  source 1..20: mol_type = other DNA
cccaggacctattccgcagg

SEQ ID NO: 19015 - DNA, 20 bp, synthetic construct
  source 1..20: mol_type = other DNA
cggcagaggaacgaggacgc

SEQ ID NO: 19016 - DNA, 20 bp, synthetic construct
  source 1..20: mol_type = other DNA
tggatgatggtggctggaac

SEQ ID NO: 19017 - DNA, 20 bp, synthetic construct
  source 1..20: mol_type = other DNA
tgaagcgagaagctgcccta

SEQ ID NO: 19018 - DNA, 20 bp, synthetic construct
  source 1..20: mol_type = other DNA
tacggcatggtgtcgagtct

SEQ ID NO: 19019 - DNA, 20 bp, synthetic construct
  source 1..20: mol_type = other DNA
tgtggcgagaagccgggctt

SEQ ID NO: 19020 - DNA, 20 bp, synthetic construct
  source 1..20: mol_type = other DNA
agggcagcagtaaccagcgg

SEQ ID NO: 19021 - DNA, 20 bp, synthetic construct
  source 1..20: mol_type = other DNA
tgcagaaatacctgtgtgac

SEQ ID NO: 19022 - DNA, 20 bp, synthetic construct
  source 1..20: mol_type = other DNA
agcagcggcggtggcagtgg

SEQ ID NO: 19023 - DNA, 20 bp, synthetic construct
  source 1..20: mol_type = other DNA
ctggccttttagggcctgac

SEQ ID NO: 19024 - DNA, 20 bp, synthetic construct
  source 1..20: mol_type = other DNA
acaggggcgttccacatacg

SEQ ID NO: 19025 - DNA, 20 bp, synthetic construct
  source 1..20: mol_type = other DNA
gaaccagccaccccagattg

SEQ ID NO: 19026 - DNA, 20 bp, synthetic construct
  source 1..20: mol_type = other DNA
gccccaggttgctgtcattg

SEQ ID NO: 19027 - DNA, 20 bp, synthetic construct
  source 1..20: mol_type = other DNA
agtcctctctattcctgggg

SEQ ID NO: 19028 - DNA, 20 bp, synthetic construct
  source 1..20: mol_type = other DNA
gttttcttccagtcctctcc

SEQ ID NO: 19029 - DNA, 20 bp, synthetic construct
  source 1..20: mol_type = other DNA
tgcccaacctgaggaactgc

SEQ ID NO: 19030 - DNA, 20 bp, synthetic construct
  source 1..20: mol_type = other DNA
gaggagacggaaaattaagg

SEQ ID NO: 19031 - DNA, 20 bp, synthetic construct
  source 1..20: mol_type = other DNA
gccagagggattgccacata

SEQ ID NO: 19032 - DNA, 20 bp, synthetic construct
  source 1..20: mol_type = other DNA
tgagaaggccatttcagagc

SEQ ID NO: 19033 - DNA, 20 bp, synthetic construct
  source 1..20: mol_type = other DNA
tcctccaggccctcccatca

SEQ ID NO: 19034 - DNA, 20 bp, synthetic construct
  source 1..20: mol_type = other DNA
tagcctcacggaggatcggg

SEQ ID NO: 19035 - DNA, 20 bp, synthetic construct
  source 1..20: mol_type = other DNA
attggctgaggacatggaaa

SEQ ID NO: 19036 - DNA, 20 bp, synthetic construct
  source 1..20: mol_type = other DNA
cctgtgcaaaagcatgggtc

SEQ ID NO: 19037 - DNA, 20 bp, synthetic construct
  source 1..20: mol_type = other DNA
acagagatatattatatata

SEQ ID NO: 19038 - DNA, 20 bp, synthetic construct
  source 1..20: mol_type = other DNA
cattcggggagactctggtg

SEQ ID NO: 19039 - DNA, 20 bp, synthetic construct
  source 1..20: mol_type = other DNA
tgtgctccttgatgttaagt

SEQ ID NO: 19040 - DNA, 20 bp, synthetic construct
  source 1..20: mol_type = other DNA
ctgctcctatggctcaaggg

SEQ ID NO: 19041 - DNA, 20 bp, synthetic construct
  source 1..20: mol_type = other DNA
ttgtgactgaatatctaaat

SEQ ID NO: 19042 - DNA, 20 bp, synthetic construct
  source 1..20: mol_type = other DNA
cttttgttcccaggaaggga

SEQ ID NO: 19043 - DNA, 20 bp, synthetic construct
  source 1..20: mol_type = other DNA
tttcggagagacctcatcta

SEQ ID NO: 19044 - DNA, 20 bp, synthetic construct
  source 1..20: mol_type = other DNA
caaacgaaaaagaacgacat

SEQ ID NO: 19045 - DNA, 20 bp, synthetic construct
  source 1..20: mol_type = other DNA
tctatgataagcgtgaaaat

SEQ ID NO: 19046 - DNA, 20 bp, synthetic construct
  source 1..20: mol_type = other DNA
ctcccacacaatcgcagttt

SEQ ID NO: 19047 - DNA, 20 bp, synthetic construct
  source 1..20: mol_type = other DNA
ctcgtgccatcatttcagag

SEQ ID NO: 19048 - DNA, 20 bp, synthetic construct
  source 1..20: mol_type = other DNA
atcacgttgatctacaagtc

SEQ ID NO: 19049 - DNA, 20 bp, synthetic construct
  source 1..20: mol_type = other DNA
gcaggtccaaccacgctggt

SEQ ID NO: 19050 - DNA, 20 bp, synthetic construct
  source 1..20: mol_type = other DNA
aatcagcacatcatgatggt

SEQ ID NO: 19051 - DNA, 20 bp, synthetic construct
  source 1..20: mol_type = other DNA
ggaggtggcagcagaaatcc

SEQ ID NO: 19052 - DNA, 20 bp, synthetic construct
  source 1..20: mol_type = other DNA
gacagggagtttctgctgga

SEQ ID NO: 19053 - DNA, 20 bp, synthetic construct
  source 1..20: mol_type = other DNA
gattttggaaggcagacacc

SEQ ID NO: 19054 - DNA, 20 bp, synthetic construct
  source 1..20: mol_type = other DNA
gctattgatgaacccagttt

SEQ ID NO: 19055 - DNA, 20 bp, synthetic construct
  source 1..20: mol_type = other DNA
gtgaagctgctaaagaacca

SEQ ID NO: 19056 - DNA, 20 bp, synthetic construct
  source 1..20: mol_type = other DNA
gatgccttacggtcaagtgc

SEQ ID NO: 19057 - DNA, 20 bp, synthetic construct
  source 1..20: mol_type = other DNA
cggccaaatactttcatgag

SEQ ID NO: 19058 - DNA, 20 bp, synthetic construct
  source 1..20: mol_type = other DNA
gtggagtccaccctggaaag

SEQ ID NO: 19059 - DNA, 20 bp, synthetic construct
  source 1..20: mol_type = other DNA
gctgaactggtgacccccat

SEQ ID NO: 19060 - DNA, 20 bp, synthetic construct
  source 1..20: mol_type = other DNA
atcacagtgcagcaaggcca

SEQ ID NO: 19061 - DNA, 20 bp, synthetic construct
  source 1..20: mol_type = other DNA
cgaatcttcactcccgctgt

SEQ ID NO: 19062 - DNA, 20 bp, synthetic construct
  source 1..20: mol_type = other DNA
actgcagtgtaccaggctaa

SEQ ID NO: 19063 - DNA, 20 bp, synthetic construct
  source 1..20: mol_type = other DNA
cctggaccaggacctgggga

SEQ ID NO: 19064 - DNA, 20 bp, synthetic construct
  source 1..20: mol_type = other DNA
agcgaccagaagcaagagga

SEQ ID NO: 19065 - DNA, 20 bp, synthetic construct
  source 1..20: mol_type = other DNA
tcttctgttgctcgaagtac

SEQ ID NO: 19066 - DNA, 20 bp, synthetic construct
  source 1..20: mol_type = other DNA
acaccagcctttgctgattt

SEQ ID NO: 19067 - DNA, 20 bp, synthetic construct
  source 1..20: mol_type = other DNA
gttgggtcacgaagatctca

SEQ ID NO: 19068 - DNA, 20 bp, synthetic construct
  source 1..20: mol_type = other DNA
aggcttcatgatgaactgga

SEQ ID NO: 19069 - DNA, 20 bp, synthetic construct
  source 1..20: mol_type = other DNA
gcagatcaagggcctaaaac

SEQ ID NO: 19070 - DNA, 20 bp, synthetic construct
  source 1..20: mol_type = other DNA
caacctccagcaccctcagg

SEQ ID NO: 19071 - DNA, 20 bp, synthetic construct
  source 1..20: mol_type = other DNA
aatcagtctcaagaagagca

SEQ ID NO: 19072 - DNA, 20 bp, synthetic construct
  source 1..20: mol_type = other DNA
ctttatgcactacaagcatc

SEQ ID NO: 19073 - DNA, 20 bp, synthetic construct
  source 1..20: mol_type = other DNA
gagtgggagaggggaaagag

SEQ ID NO: 19074 - DNA, 20 bp, synthetic construct
  source 1..20: mol_type = other DNA
aagtggagaagaacaagtac

SEQ ID NO: 19075 - DNA, 20 bp, synthetic construct
  source 1..20: mol_type = other DNA
tcggagactatggcctcgcc

SEQ ID NO: 19076 - DNA, 20 bp, synthetic construct
  source 1..20: mol_type = other DNA
atctattttttctaaaacat

SEQ ID NO: 19077 - DNA, 20 bp, synthetic construct
  source 1..20: mol_type = other DNA
ttgtcttagctacctgtgta

SEQ ID NO: 19078 - DNA, 20 bp, synthetic construct
  source 1..20: mol_type = other DNA
gatgcgaatgatcctgtcac

SEQ ID NO: 19079 - DNA, 20 bp, synthetic construct
  source 1..20: mol_type = other DNA
tactgaccctgagcaacccc

SEQ ID NO: 19080 - DNA, 20 bp, synthetic construct
  source 1..20: mol_type = other DNA
ggccctttgaccagggcagc

SEQ ID NO: 19081 - DNA, 20 bp, synthetic construct
  source 1..20: mol_type = other DNA
gtgacgtggacctggatccc

SEQ ID NO: 19082 - DNA, 20 bp, synthetic construct
  source 1..20: mol_type = other DNA
cccacctgtgggagttcatc

SEQ ID NO: 19083 - DNA, 20 bp, synthetic construct
  source 1..20: mol_type = other DNA
aaaccttcctgggaggacag

SEQ ID NO: 19084 - DNA, 20 bp, synthetic construct
  source 1..20: mol_type = other DNA
caggccctccagtgggctga

SEQ ID NO: 19085 - DNA, 20 bp, synthetic construct
  source 1..20: mol_type = other DNA
caatcgattccagaactatt

SEQ ID NO: 19086 - DNA, 20 bp, synthetic construct
  source 1..20: mol_type = other DNA
gatacccctcgacgaggatg

SEQ ID NO: 19087 - DNA, 20 bp, synthetic construct
  source 1..20: mol_type = other DNA
gttcctcagcctccgctacc

SEQ ID NO: 19088 - DNA, 20 bp, synthetic construct
  source 1..20: mol_type = other DNA
cctcgcctggagccccgagg

SEQ ID NO: 19089 - DNA, 20 bp, synthetic construct
  source 1..20: mol_type = other DNA
tcagaaagcccggaggctgt

SEQ ID NO: 19090 - DNA, 20 bp, synthetic construct
  source 1..20: mol_type = other DNA
catccggctttcctgactct

SEQ ID NO: 19091 - DNA, 20 bp, synthetic construct
  source 1..20: mol_type = other DNA
aggcttcatctccggctcca

SEQ ID NO: 19092 - DNA, 20 bp, synthetic construct
  source 1..20: mol_type = other DNA
cccttccgtccccttttgcc

SEQ ID NO: 19093 - DNA, 20 bp, synthetic construct
  source 1..20: mol_type = other DNA
ctccagtgtctccactgtgg

SEQ ID NO: 19094 - DNA, 20 bp, synthetic construct
  source 1..20: mol_type = other DNA
tgtcacctgcatctcctttt

SEQ ID NO: 19095 - DNA, 20 bp, synthetic construct
  source 1..20: mol_type = other DNA
ggattgctggggaccctcaa

SEQ ID NO: 19096 - DNA, 20 bp, synthetic construct
  source 1..20: mol_type = other DNA
aatgtccacctcctgggttc

SEQ ID NO: 19097 - DNA, 20 bp, synthetic construct
  source 1..20: mol_type = other DNA
cctctagcgctgggtgttgg

SEQ ID NO: 19098 - DNA, 20 bp, synthetic construct
  source 1..20: mol_type = other DNA
gcctctggaaggggctgggg

SEQ ID NO: 19099 - DNA, 20 bp, synthetic construct
  source 1..20: mol_type = other DNA
cgtgaagtcagtcaacaaaa

SEQ ID NO: 19100 - DNA, 20 bp, synthetic construct
  source 1..20: mol_type = other DNA
aaggagcagggtcctggtcc

SEQ ID NO: 19101 - DNA, 20 bp, synthetic construct
  source 1..20: mol_type = other DNA
tctctaacatatgatactga

SEQ ID NO: 19102 - DNA, 20 bp, synthetic construct
  source 1..20: mol_type = other DNA
acatgctctagtttattaac

SEQ ID NO: 19103 - DNA, 20 bp, synthetic construct
  source 1..20: mol_type = other DNA
ggctaagtgggacattagta

SEQ ID NO: 19104 - DNA, 20 bp, synthetic construct
  source 1..20: mol_type = other DNA
acaaagaaatccccccttca

SEQ ID NO: 19105 - DNA, 20 bp, synthetic construct
  source 1..20: mol_type = other DNA
tctgcagttccatcaggtcc

SEQ ID NO: 19106 - DNA, 20 bp, synthetic construct
  source 1..20: mol_type = other DNA
ctacctgagcattcaggcag

SEQ ID NO: 19107 - DNA, 20 bp, synthetic construct
  source 1..20: mol_type = other DNA
gttaataatagtattttaga

SEQ ID NO: 19108 - DNA, 20 bp, synthetic construct
  source 1..20: mol_type = other DNA
taaacacagactttgtaggt

SEQ ID NO: 19109 - DNA, 20 bp, synthetic construct
  source 1..20: mol_type = other DNA
gcggagcaagtacaatgatg

SEQ ID NO: 19110 - DNA, 20 bp, synthetic construct
  source 1..20: mol_type = other DNA
acggagaacgctccaggagg

SEQ ID NO: 19111 - DNA, 20 bp, synthetic construct
  source 1..20: mol_type = other DNA
ggttataataaagatataaa

SEQ ID NO: 19112 - DNA, 20 bp, synthetic construct
  source 1..20: mol_type = other DNA
agggttggacctaatgcccc

SEQ ID NO: 19113 - DNA, 20 bp, synthetic construct
  source 1..20: mol_type = other DNA
actgcataattctgaagtta

SEQ ID NO: 19114 - DNA, 20 bp, synthetic construct
  source 1..20: mol_type = other DNA
cagatttgcacaaaaagata

SEQ ID NO: 19115 - DNA, 20 bp, synthetic construct
  source 1..20: mol_type = other DNA
taatatatagcatttatggt

SEQ ID NO: 19116 - DNA, 20 bp, synthetic construct
  source 1..20: mol_type = other DNA
ttggttttgttttttgagtc

SEQ ID NO: 19117 - DNA, 20 bp, synthetic construct
  source 1..20: mol_type = other DNA
aaacagaaattggtaccttg

SEQ ID NO: 19118 - DNA, 20 bp, synthetic construct
  source 1..20: mol_type = other DNA
cccggtggctgtcagtcaaa

SEQ ID NO: 19119 - DNA, 20 bp, synthetic construct
  source 1..20: mol_type = other DNA
caagtacactgggaacactt

SEQ ID NO: 19120 - DNA, 20 bp, synthetic construct
  source 1..20: mol_type = other DNA
gctttgcacgtgcctgggca

SEQ ID NO: 19121 - DNA, 20 bp, synthetic construct
  source 1..20: mol_type = other DNA
gaccacacagaactatgatg

SEQ ID NO: 19122 - DNA, 20 bp, synthetic construct
  source 1..20: mol_type = other DNA
atggacatgcattgcctact

SEQ ID NO: 19123 - DNA, 20 bp, synthetic construct
  source 1..20: mol_type = other DNA
ttcagagactgggacgtttt

SEQ ID NO: 19124 - DNA, 20 bp, synthetic construct
  source 1..20: mol_type = other DNA
tcagcccaactcccacccca

SEQ ID NO: 19125 - DNA, 20 bp, synthetic construct
  source 1..20: mol_type = other DNA
ccagctcatcagcatccagc

SEQ ID NO: 19126 - DNA, 20 bp, synthetic construct
  source 1..20: mol_type = other DNA
ggtctcctgggtctcagctt

SEQ ID NO: 19127 - DNA, 20 bp, synthetic construct
  source 1..20: mol_type = other DNA
ggatggggagcagagtttga

SEQ ID NO: 19128 - DNA, 20 bp, synthetic construct
  source 1..20: mol_type = other DNA
cacagaactcaaccttcctg

SEQ ID NO: 19129 - DNA, 20 bp, synthetic construct
  source 1..20: mol_type = other DNA
gcagcctgggagctctattc

SEQ ID NO: 19130 - DNA, 20 bp, synthetic construct
  source 1..20: mol_type = other DNA
ctctgataccatcatcccag

SEQ ID NO: 19131 - DNA, 20 bp, synthetic construct
  source 1..20: mol_type = other DNA
cgaacaacatgagagcacac

SEQ ID NO: 19132 - DNA, 20 bp, synthetic construct
  source 1..20: mol_type = other DNA
acctcgagaagatcgggtgc

SEQ ID NO: 19133 - DNA, 20 bp, synthetic construct
  source 1..20: mol_type = other DNA
cactgtgtatgctgtcactg

SEQ ID NO: 19134 - DNA, 20 bp, synthetic construct
  source 1..20: mol_type = other DNA
agttgtcaccactctggaga

SEQ ID NO: 19135 - DNA, 20 bp, synthetic construct
  source 1..20: mol_type = other DNA
tgtcagaagctacaccatca

SEQ ID NO: 19136 - DNA, 20 bp, synthetic construct
  source 1..20: mol_type = other DNA
atggcagccgccacgtgcca

SEQ ID NO: 19137 - DNA, 20 bp, synthetic construct
  source 1..20: mol_type = other DNA
cacttctggtcagcaaccca

SEQ ID NO: 19138 - DNA, 20 bp, synthetic construct
  source 1..20: mol_type = other DNA
tcacctgtacccacagggtc

SEQ ID NO: 19139 - DNA, 20 bp, synthetic construct
  source 1..20: mol_type = other DNA
taccagtgccactctgacag

SEQ ID NO: 19140 - DNA, 20 bp, synthetic construct
  source 1..20: mol_type = other DNA
ggagtttcctgagggttttc

SEQ ID NO: 19141 - DNA, 20 bp, synthetic construct
  source 1..20: mol_type = other DNA
atctcttcactaatggagat

SEQ ID NO: 19142 - DNA, 20 bp, synthetic construct
  source 1..20: mol_type = other DNA
gccgagagtcgtcggggttt

SEQ ID NO: 19143 - DNA, 20 bp, synthetic construct
  source 1..20: mol_type = other DNA
cgcctctccttagtcgccgc

SEQ ID NO: 19144 - DNA, 20 bp, synthetic construct
  source 1..20: mol_type = other DNA
aatgtgaatcagtcactact

SEQ ID NO: 19145 - DNA, 20 bp, synthetic construct
  source 1..20: mol_type = other DNA
gaatatctctttgacaagca

SEQ ID NO: 19146 - DNA, 20 bp, synthetic construct
  source 1..20: mol_type = other DNA
ttgggcagtatactaaggtg

SEQ ID NO: 19147 - DNA, 20 bp, synthetic construct
  source 1..20: mol_type = other DNA
gttacagtggttatagccag

SEQ ID NO: 19148 - DNA, 20 bp, synthetic construct
  source 1..20: mol_type = other DNA
gccgagggcgaggaggaccc

SEQ ID NO: 19149 - DNA, 20 bp, synthetic construct
  source 1..20: mol_type = other DNA
tgcatccttgaatcttgggt

SEQ ID NO: 19150 - DNA, 20 bp, synthetic construct
  source 1..20: mol_type = other DNA
ttcctgggtttcagtacttg

SEQ ID NO: 19151 - DNA, 20 bp, synthetic construct
  source 1..20: mol_type = other DNA
gtctcactctcacccaggct

SEQ ID NO: 19152 - DNA, 20 bp, synthetic construct
  source 1..20: mol_type = other DNA
gcggcgcctgtgagtgagtg

SEQ ID NO: 19153 - DNA, 20 bp, synthetic construct
  source 1..20: mol_type = other DNA
taagtcaacttatttgtttt

SEQ ID NO: 19154 - DNA, 20 bp, synthetic construct
  source 1..20: mol_type = other DNA
atcccatcaccatcttccag

SEQ ID NO: 19155 - DNA, 20 bp, synthetic construct
  source 1..20: mol_type = other DNA
tggatggcccctccgggaaa

SEQ ID NO: 19156 - DNA, 20 bp, synthetic construct
  source 1..20: mol_type = other DNA
acgaccactttgtcaagctc

SEQ ID NO: 19157 - DNA, 20 bp, synthetic construct
  source 1..20: mol_type = other DNA
ctcagtcccccaccacactg

SEQ ID NO: 19158 - DNA, 20 bp, synthetic construct
  source 1..20: mol_type = other DNA
ggtagagcggccgccatgtt

SEQ ID NO: 19159 - DNA, 20 bp, synthetic construct
  source 1..20: mol_type = other DNA
agattattctctgatttggt

SEQ ID NO: 19160 - DNA, 20 bp, synthetic construct
  source 1..20: mol_type = other DNA
acgggaagcttgtcatcaat

SEQ ID NO: 19161 - DNA, 20 bp, synthetic construct
  source 1..20: mol_type = other DNA
ccatcactgccacccagaag

SEQ ID NO: 19162 - DNA, 20 bp, synthetic construct
  source 1..20: mol_type = other DNA
cactgctggggagtccctgc

SEQ ID NO: 19163 - DNA, 20 bp, synthetic construct
  source 1..20: mol_type = other DNA
aaaggctaagctaaggtcaa

SEQ ID NO: 19164 - DNA, 20 bp, synthetic construct
  source 1..20: mol_type = other DNA
tttattttcataacagcatg

SEQ ID NO: 19165 - DNA, 20 bp, synthetic construct
  source 1..20: mol_type = other DNA
ggatgttatcgctattgaat

SEQ ID NO: 19166 - DNA, 20 bp, synthetic construct
  source 1..20: mol_type = other DNA
cacgggctggaagagacatg

SEQ ID NO: 19167 - DNA, 20 bp, synthetic construct
  source 1..20: mol_type = other DNA
ctattccacacattttcagc

SEQ ID NO: 19168 - DNA, 20 bp, synthetic construct
  source 1..20: mol_type = other DNA
cccaaagtgctgggatgaca

SEQ ID NO: 19169 - DNA, 20 bp, synthetic construct
  source 1..20: mol_type = other DNA
ctcagcagctccccagcacc

SEQ ID NO: 19170 - DNA, 20 bp, synthetic construct
  source 1..20: mol_type = other DNA
cttcaaattcctggggctga

SEQ ID NO: 19171 - DNA, 20 bp, synthetic construct
  source 1..20: mol_type = other DNA
tgaaagaatcttccaattct

SEQ ID NO: 19172 - DNA, 20 bp, synthetic construct
  source 1..20: mol_type = other DNA
ttctggaacaagatagagtg

SEQ ID NO: 19173 - DNA, 20 bp, synthetic construct
  source 1..20: mol_type = other DNA
aagtgcctggagtatcttct

SEQ ID NO: 19174 - DNA, 20 bp, synthetic construct
  source 1..20: mol_type = other DNA
tgaaaaagtctggcaagctg

SEQ ID NO: 19175 - DNA, 20 bp, synthetic construct
  source 1..20: mol_type = other DNA
ctaatgaaacttgtaccgtg

SEQ ID NO: 19176 - DNA, 20 bp, synthetic construct
  source 1..20: mol_type = other DNA
ggctgcagtgagccatgatc

SEQ ID NO: 19177 - DNA, 20 bp, synthetic construct
  source 1..20: mol_type = other DNA
gcatatcttctccagaagtc

SEQ ID NO: 19178 - DNA, 20 bp, synthetic construct
  source 1..20: mol_type = other DNA
ttttatttgcattttattga

SEQ ID NO: 19179 - DNA, 20 bp, synthetic construct
  source 1..20: mol_type = other DNA
gatggaaaggaaacaagaaa

SEQ ID NO: 19180 - DNA, 20 bp, synthetic construct
  source 1..20: mol_type = other DNA
tgtccagatgggagtcccat

SEQ ID NO: 19181 - DNA, 20 bp, synthetic construct
  source 1..20: mol_type = other DNA
gggtggatcacctgaggtca

SEQ ID NO: 19182 - DNA, 20 bp, synthetic construct
  source 1..20: mol_type = other DNA
agtatggctctgacatctct

SEQ ID NO: 19183 - DNA, 20 bp, synthetic construct
  source 1..20: mol_type = other DNA
agaagccaactagccaacac

SEQ ID NO: 19184 - DNA, 20 bp, synthetic construct
  source 1..20: mol_type = other DNA
ctcattttacattttaaagt

SEQ ID NO: 19185 - DNA, 20 bp, synthetic construct
  source 1..20: mol_type = other DNA
ctgcagtgcgaagaaactga

SEQ ID NO: 19186 - DNA, 20 bp, synthetic construct
  source 1..20: mol_type = other DNA
tcttggtctgatccacgctg

SEQ ID NO: 19187 - DNA, 20 bp, synthetic construct
  source 1..20: mol_type = other DNA
ctctgtccagcccacagcaa

SEQ ID NO: 19188 - DNA, 20 bp, synthetic construct
  source 1..20: mol_type = other DNA
tcagcatcagcccatcatca

SEQ ID NO: 19189 - DNA, 20 bp, synthetic construct
  source 1..20: mol_type = other DNA
ctcttctttgagcagccctt

SEQ ID NO: 19190 - DNA, 20 bp, synthetic construct
  source 1..20: mol_type = other DNA
aggtctcctgagcaataaga

SEQ ID NO: 19191 - DNA, 20 bp, synthetic construct
  source 1..20: mol_type = other DNA
catctgctgcaccagttcct

SEQ ID NO: 19192 - DNA, 20 bp, synthetic construct
  source 1..20: mol_type = other DNA
ataatgctgtaccgattgta

SEQ ID NO: 19193 - DNA, 20 bp, synthetic construct
  source 1..20: mol_type = other DNA
ggccggcgctggttgaacag

SEQ ID NO: 19194 - DNA, 20 bp, synthetic construct
  source 1..20: mol_type = other DNA
ccctaagttgttcaccggga

SEQ ID NO: 19195 - DNA, 20 bp, synthetic construct
  source 1..20: mol_type = other DNA
gtaagaaatgagatgcagga

SEQ ID NO: 19196 - DNA, 20 bp, synthetic construct
  source 1..20: mol_type = other DNA
gggtcacagtgacctgacct

SEQ ID NO: 19197 - DNA, 20 bp, synthetic construct
  source 1..20: mol_type = other DNA
ggtgatattattttcagtgc

SEQ ID NO: 19198 - DNA, 20 bp, synthetic construct
  source 1..20: mol_type = other DNA
acataatatggtaaaatgta

SEQ ID NO: 19199 - DNA, 20 bp, synthetic construct
  source 1..20: mol_type = other DNA
ggctcatcggggatgcggcc

SEQ ID NO: 19200 - DNA, 20 bp, synthetic construct
  source 1..20: mol_type = other DNA
acaagggggagaccaaggca

SEQ ID NO: 19201 - DNA, 20 bp, synthetic construct
  source 1..20: mol_type = other DNA
tgttggggcgcttcgagctg

SEQ ID NO: 19202 - DNA, 20 bp, synthetic construct
  source 1..20: mol_type = other DNA
gagggtctgggtcaggcccc

SEQ ID NO: 19203 - DNA, 20 bp, synthetic construct
  source 1..20: mol_type = other DNA
tttccggtttctacatgcag

SEQ ID NO: 19204 - DNA, 20 bp, synthetic construct
  source 1..20: mol_type = other DNA
tctacatgcagagatgaatt

SEQ ID NO: 19205 - DNA, 20 bp, synthetic construct
  source 1..20: mol_type = other DNA
tacggcctgtggctggactg

SEQ ID NO: 19206 - DNA, 20 bp, synthetic construct
  source 1..20: mol_type = other DNA
gtattcttcgagtgacagct

SEQ ID NO: 19207 - DNA, 20 bp, synthetic construct
  source 1..20: mol_type = other DNA
tggaaagctatgcctattct

SEQ ID NO: 19208 - DNA, 20 bp, synthetic construct
  source 1..20: mol_type = other DNA
taatctaagaaaaggggaga

SEQ ID NO: 19209 - DNA, 20 bp, synthetic construct
  source 1..20: mol_type = other DNA
agctgcttggattctctgag

SEQ ID NO: 19210 - DNA, 20 bp, synthetic construct
  source 1..20: mol_type = other DNA
ggtgacattgaaactacact

SEQ ID NO: 19211 - DNA, 20 bp, synthetic construct
  source 1..20: mol_type = other DNA
ggttaaatggtagttagcaa

SEQ ID NO: 19212 - DNA, 20 bp, synthetic construct
  source 1..20: mol_type = other DNA
ttagacgcaccccggtgagc

SEQ ID NO: 19213 - DNA, 20 bp, synthetic construct
  source 1..20: mol_type = other DNA
gggaccgcggcttctacttc

SEQ ID NO: 19214 - DNA, 20 bp, synthetic construct
  source 1..20: mol_type = other DNA
ccacccaagaccccgcccac

SEQ ID NO: 19215 - DNA, 20 bp, synthetic construct
  source 1..20: mol_type = other DNA
cttctcctgacccagtcccc

SEQ ID NO: 19216 - DNA, 20 bp, synthetic construct
  source 1..20: mol_type = other DNA
gaattttcagggtaaactgg

SEQ ID NO: 19217 - DNA, 20 bp, synthetic construct
  source 1..20: mol_type = other DNA
cacacaaacgcacagcacac

SEQ ID NO: 19218 - DNA, 20 bp, synthetic construct
  source 1..20: mol_type = other DNA
ggctggcctccttggcgcct

SEQ ID NO: 19219 - DNA, 20 bp, synthetic construct
  source 1..20: mol_type = other DNA
agcctgactccctggtgtgc

SEQ ID NO: 19220 - DNA, 20 bp, synthetic construct
  source 1..20: mol_type = other DNA
ccctcggtgacatcttgccc

SEQ ID NO: 19221 - DNA, 20 bp, synthetic construct
  source 1..20: mol_type = other DNA
cgtgcctagtcgtggctctc

SEQ ID NO: 19222 - DNA, 20 bp, synthetic construct
  source 1..20: mol_type = other DNA
ccagctgccccagcggcctc

SEQ ID NO: 19223 - DNA, 20 bp, synthetic construct
  source 1..20: mol_type = other DNA
gccccctgcccagcctgccc

SEQ ID NO: 19224 - DNA, 20 bp, synthetic construct
  source 1..20: mol_type = other DNA
caatggggaagtcgatgctg

SEQ ID NO: 19225 - DNA, 20 bp, synthetic construct
  source 1..20: mol_type = other DNA
gcagccgtggcatcgttgag

SEQ ID NO: 19226 - DNA, 20 bp, synthetic construct
  source 1..20: mol_type = other DNA
agcagtccacccagcgcctg

SEQ ID NO: 19227 - DNA, 20 bp, synthetic construct
  source 1..20: mol_type = other DNA
atcggaagtgagcaaaactg

SEQ ID NO: 19228 - DNA, 20 bp, synthetic construct
  source 1..20: mol_type = other DNA
ctcctcggccccctccatcg

SEQ ID NO: 19229 - DNA, 20 bp, synthetic construct
  source 1..20: mol_type = other DNA
ggctcctcactcccttttcc

SEQ ID NO: 19230 - DNA, 20 bp, synthetic construct
  source 1..20: mol_type = other DNA
acacacaaagacacagcaca

SEQ ID NO: 19231 - DNA, 20 bp, synthetic construct
  source 1..20: mol_type = other DNA
cgatgctccccataccccac

SEQ ID NO: 19232 - DNA, 20 bp, synthetic construct
  source 1..20: mol_type = other DNA
ggagggggctcctggctggc

SEQ ID NO: 19233 - DNA, 20 bp, synthetic construct
  source 1..20: mol_type = other DNA
ggcgcctagggctgcggcag

SEQ ID NO: 19234 - DNA, 20 bp, synthetic construct
  source 1..20: mol_type = other DNA
cagtcgcagagggtccctcg

SEQ ID NO: 19235 - DNA, 20 bp, synthetic construct
  source 1..20: mol_type = other DNA
gttatattctgcctcgccgg

SEQ ID NO: 19236 - DNA, 20 bp, synthetic construct
  source 1..20: mol_type = other DNA
gtcttcagtggggggccccc

SEQ ID NO: 19237 - DNA, 20 bp, synthetic construct
  source 1..20: mol_type = other DNA
ctgctcctgctgcagctgct

SEQ ID NO: 19238 - DNA, 20 bp, synthetic construct
  source 1..20: mol_type = other DNA
ggaactcctgaatttgtaac

SEQ ID NO: 19239 - DNA, 20 bp, synthetic construct
  source 1..20: mol_type = other DNA
ttggtggatgactccgatcc

SEQ ID NO: 19240 - DNA, 20 bp, synthetic construct
  source 1..20: mol_type = other DNA
tccgcgctggtccgccatgc

SEQ ID NO: 19241 - DNA, 20 bp, synthetic construct
  source 1..20: mol_type = other DNA
agacacacaccgagagctac

SEQ ID NO: 19242 - DNA, 20 bp, synthetic construct
  source 1..20: mol_type = other DNA
aaaagcctccagctgtccac

SEQ ID NO: 19243 - DNA, 20 bp, synthetic construct
  source 1..20: mol_type = other DNA
acttactttgagtttgaaac

SEQ ID NO: 19244 - DNA, 20 bp, synthetic construct
  source 1..20: mol_type = other DNA
tgcaatcctctcccttacat

SEQ ID NO: 19245 - DNA, 20 bp, synthetic construct
  source 1..20: mol_type = other DNA
tccaccaggatcacgtttga

SEQ ID NO: 19246 - DNA, 20 bp, synthetic construct
  source 1..20: mol_type = other DNA
acgcagtatgcctgcccacc

SEQ ID NO: 19247 - DNA, 20 bp, synthetic construct
  source 1..20: mol_type = other DNA
gctggcactgagccgtgccc

SEQ ID NO: 19248 - DNA, 20 bp, synthetic construct
  source 1..20: mol_type = other DNA
cgattcacctgcagcgagag

SEQ ID NO: 19249 - DNA, 20 bp, synthetic construct
  source 1..20: mol_type = other DNA
tccttaagtggcagggcggg

SEQ ID NO: 19250 - DNA, 20 bp, synthetic construct
  source 1..20: mol_type = other DNA
cagctggtgtacaaggatgg

SEQ ID NO: 19251 - DNA, 20 bp, synthetic construct
  source 1..20: mol_type = other DNA
tccacgagcacctttaaggt

SEQ ID NO: 19252 - DNA, 20 bp, synthetic construct
  source 1..20: mol_type = other DNA
caggatgaagcggtcgtttt

SEQ ID NO: 19253 - DNA, 20 bp, synthetic construct
  source 1..20: mol_type = other DNA
gacagctgcacttactactt

SEQ ID NO: 19254 - DNA, 20 bp, synthetic construct
  source 1..20: mol_type = other DNA
gacaactacctgtatgagat

SEQ ID NO: 19255 - DNA, 20 bp, synthetic construct
  source 1..20: mol_type = other DNA
gcctcttcctctaagtgcgg

SEQ ID NO: 19256 - DNA, 20 bp, synthetic construct
  source 1..20: mol_type = other DNA
gacagcgagaatcccgggga

SEQ ID NO: 19257 - DNA, 20 bp, synthetic construct
  source 1..20: mol_type = other DNA
tccctgcatggggatgacca

SEQ ID NO: 19258 - DNA, 20 bp, synthetic construct
  source 1..20: mol_type = other DNA
gcgaggaaagggaagtccag

SEQ ID NO: 19259 - DNA, 20 bp, synthetic construct
  source 1..20: mol_type = other DNA
actgtgcttatttttttaag

SEQ ID NO: 19260 - DNA, 20 bp, synthetic construct
  source 1..20: mol_type = other DNA
aggaggagggaggccaggcg

SEQ ID NO: 19261 - DNA, 20 bp, synthetic construct
  source 1..20: mol_type = other DNA
ccggtttggctggcttgttt

SEQ ID NO: 19262 - DNA, 20 bp, synthetic construct
  source 1..20: mol_type = other DNA
gcagtgtaactgcatagttt

SEQ ID NO: 19263 - DNA, 20 bp, synthetic construct
  source 1..20: mol_type = other DNA
gctaggaagtctggtgcagt

SEQ ID NO: 19264 - DNA, 20 bp, synthetic construct
  source 1..20: mol_type = other DNA
tacccaagtaaaagtaacct

SEQ ID NO: 19265 - DNA, 20 bp, synthetic construct
  source 1..20: mol_type = other DNA
cggctttcaaacaaaagagg

SEQ ID NO: 19266 - DNA, 20 bp, synthetic construct
  source 1..20: mol_type = other DNA
ggctcccggagcagggcgag

SEQ ID NO: 19267 - DNA, 20 bp, synthetic construct
  source 1..20: mol_type = other DNA
cttcatatgcaattcccaag

SEQ ID NO: 19268 - DNA, 20 bp, synthetic construct
  source 1..20: mol_type = other DNA
caacgaagtggaacctggtt

SEQ ID NO: 19269 - DNA, 20 bp, synthetic construct
  source 1..20: mol_type = other DNA
gtttttcattgacaacatac

SEQ ID NO: 19270 - DNA, 20 bp, synthetic construct
  source 1..20: mol_type = other DNA
tgccttctgcaatcccgtca

SEQ ID NO: 19271 - DNA, 20 bp, synthetic construct
  source 1..20: mol_type = other DNA
ctacaccatgggtcataact

SEQ ID NO: 19272 - DNA, 20 bp, synthetic construct
  source 1..20: mol_type = other DNA
ggaaggggaacactgtcagt

SEQ ID NO: 19273 - DNA, 20 bp, synthetic construct
  source 1..20: mol_type = other DNA
cttctggggagaccccgacg

SEQ ID NO: 19274 - DNA, 20 bp, synthetic construct
  source 1..20: mol_type = other DNA
ctgccaccagtgctttgctc

SEQ ID NO: 19275 - DNA, 20 bp, synthetic construct
  source 1..20: mol_type = other DNA
gagccccgcagcagagccac

SEQ ID NO: 19276 - DNA, 20 bp, synthetic construct
  source 1..20: mol_type = other DNA
cctagacaacactgtgaaag

SEQ ID NO: 19277 - DNA, 20 bp, synthetic construct
  source 1..20: mol_type = other DNA
atgtggcgggccaaactgca

SEQ ID NO: 19278 - DNA, 20 bp, synthetic construct
  source 1..20: mol_type = other DNA
tgaagtattgaaaatggaga

SEQ ID NO: 19279 - DNA, 20 bp, synthetic construct
  source 1..20: mol_type = other DNA
tgcaacagatgttaaagtca

SEQ ID NO: 19280 - DNA, 20 bp, synthetic construct
  source 1..20: mol_type = other DNA
caacgcgtcccagcgcatca

SEQ ID NO: 19281 - DNA, 20 bp, synthetic construct
  source 1..20: mol_type = other DNA
cccttccaactctcctttcc

SEQ ID NO: 19282 - DNA, 20 bp, synthetic construct
  source 1..20: mol_type = other DNA
cccttgtctccgggtggtgt

SEQ ID NO: 19283 - DNA, 20 bp, synthetic construct
  source 1..20: mol_type = other DNA
cctcagcatgaacagagaaa

SEQ ID NO: 19284 - DNA, 20 bp, synthetic construct
  source 1..20: mol_type = other DNA
gagcatcttgcatccaaacc

SEQ ID NO: 19285 - DNA, 20 bp, synthetic construct
  source 1..20: mol_type = other DNA
ctaaagcttttatttaacag

SEQ ID NO: 19286 - DNA, 20 bp, synthetic construct
  source 1..20: mol_type = other DNA
tcttcttttctttttttaaa

SEQ ID NO: 19287 - DNA, 20 bp, synthetic construct
  source 1..20: mol_type = other DNA
cgcagaagaaaggcggagaa

SEQ ID NO: 19288 - DNA, 20 bp, synthetic construct
  source 1..20: mol_type = other DNA
gtgcccgtggtgcagccatc

SEQ ID NO: 19289 - DNA, 20 bp, synthetic construct
  source 1..20: mol_type = other DNA
tctccgggtggtgttggaca

SEQ ID NO: 19290 - DNA, 20 bp, synthetic construct
  source 1..20: mol_type = other DNA
atggtggaaaacgaagctca

SEQ ID NO: 19291 - DNA, 20 bp, synthetic construct
  source 1..20: mol_type = other DNA
tatgggggttctggagagcg

SEQ ID NO: 19292 - DNA, 20 bp, synthetic construct
  source 1..20: mol_type = other DNA
gcagggtgcaaccgagctgg

SEQ ID NO: 19293 - DNA, 20 bp, synthetic construct
  source 1..20: mol_type = other DNA
gctatactcctggcctgtgc

SEQ ID NO: 19294 - DNA, 20 bp, synthetic construct
  source 1..20: mol_type = other DNA
ccgccgggatgctgctgagc

SEQ ID NO: 19295 - DNA, 20 bp, synthetic construct
  source 1..20: mol_type = other DNA
ctcccatgaggctcctggca

SEQ ID NO: 19296 - DNA, 20 bp, synthetic construct
  source 1..20: mol_type = other DNA
caccttggagctattcacag

SEQ ID NO: 19297 - DNA, 20 bp, synthetic construct
  source 1..20: mol_type = other DNA
cctccgtgccctgcatctca

SEQ ID NO: 19298 - DNA, 20 bp, synthetic construct
  source 1..20: mol_type = other DNA
tgctgctatgaagggcaact

SEQ ID NO: 19299 - DNA, 20 bp, synthetic construct
  source 1..20: mol_type = other DNA
cagcaaacaggcattctcac

SEQ ID NO: 19300 - DNA, 20 bp, synthetic construct
  source 1..20: mol_type = other DNA
cccatccctcctccagatgc

SEQ ID NO: 19301 - DNA, 20 bp, synthetic construct
  source 1..20: mol_type = other DNA
gagcctcctccaaaactgcc

SEQ ID NO: 19302 - DNA, 20 bp, synthetic construct
  source 1..20: mol_type = other DNA
acagcatgtgccaagattct

SEQ ID NO: 19303 - DNA, 20 bp, synthetic construct
  source 1..20: mol_type = other DNA
ggctgctcccacctggctct

SEQ ID NO: 19304 - DNA, 20 bp, synthetic construct
  source 1..20: mol_type = other DNA
aagaggggatgagttgtgtg

SEQ ID NO: 19305 - DNA, 20 bp, synthetic construct
  source 1..20: mol_type = other DNA
ctgggccgtggagcctatgg

SEQ ID NO: 19306 - DNA, 20 bp, synthetic construct
  source 1..20: mol_type = other DNA
gtgatccacagagatgtgaa

SEQ ID NO: 19307 - DNA, 20 bp, synthetic construct
  source 1..20: mol_type = other DNA
ggctacaatgtcaagtccga

SEQ ID NO: 19308 - DNA, 20 bp, synthetic construct
  source 1..20: mol_type = other DNA
actgctcagtgcctgaggaa

SEQ ID NO: 19309 - DNA, 20 bp, synthetic construct
  source 1..20: mol_type = other DNA
gagccccacagccccatctg

SEQ ID NO: 19310 - DNA, 20 bp, synthetic construct
  source 1..20: mol_type = other DNA
tcggccccaccagtgcctct

SEQ ID NO: 19311 - DNA, 20 bp, synthetic construct
  source 1..20: mol_type = other DNA
aaacagggcctctgcggagc

SEQ ID NO: 19312 - DNA, 20 bp, synthetic construct
  source 1..20: mol_type = other DNA
ctagggtaccagcaggcaga

SEQ ID NO: 19313 - DNA, 20 bp, synthetic construct
  source 1..20: mol_type = other DNA
cagaggtgctcatcagcact

SEQ ID NO: 19314 - DNA, 20 bp, synthetic construct
  source 1..20: mol_type = other DNA
ctctagccgacattgttttg

SEQ ID NO: 19315 - DNA, 20 bp, synthetic construct
  source 1..20: mol_type = other DNA
tgcctgtggctggagaaagg

SEQ ID NO: 19316 - DNA, 20 bp, synthetic construct
  source 1..20: mol_type = other DNA
cagcaacagagaccaaggct

SEQ ID NO: 19317 - DNA, 20 bp, synthetic construct
  source 1..20: mol_type = other DNA
tgaaacgaggttttgtgctg

SEQ ID NO: 19318 - DNA, 20 bp, synthetic construct
  source 1..20: mol_type = other DNA
agcctcagtgtaaagtctgc

SEQ ID NO: 19319 - DNA, 20 bp, synthetic construct
  source 1..20: mol_type = other DNA
tctttgggggctatgtgcct

SEQ ID NO: 19320 - DNA, 20 bp, synthetic construct
  source 1..20: mol_type = other DNA
agccacagcagatacaagcg

SEQ ID NO: 19321 - DNA, 20 bp, synthetic construct
  source 1..20: mol_type = other DNA
ctccgcccacactggcctca

SEQ ID NO: 19322 - DNA, 20 bp, synthetic construct
  source 1..20: mol_type = other DNA
tctgttccccttcgggtcca

SEQ ID NO: 19323 - DNA, 20 bp, synthetic construct
  source 1..20: mol_type = other DNA
tggggagcagccgctgtggg

SEQ ID NO: 19324 - DNA, 20 bp, synthetic construct
  source 1..20: mol_type = other DNA
ccctgctgcgccgcgcctgg

SEQ ID NO: 19325 - DNA, 20 bp, synthetic construct
  source 1..20: mol_type = other DNA
tgagcttcctgaccatcccg

SEQ ID NO: 19326 - DNA, 20 bp, synthetic construct
  source 1..20: mol_type = other DNA
cccttcggtactgggcctcc

SEQ ID NO: 19327 - DNA, 20 bp, synthetic construct
  source 1..20: mol_type = other DNA
tgccagctggtcccgggaat

SEQ ID NO: 19328 - DNA, 20 bp, synthetic construct
  source 1..20: mol_type = other DNA
ctgggagtgggaagcctctt

SEQ ID NO: 19329 - DNA, 20 bp, synthetic construct
  source 1..20: mol_type = other DNA
acaggcccgttcttccgcta

SEQ ID NO: 19330 - DNA, 20 bp, synthetic construct
  source 1..20: mol_type = other DNA
ttctacgcccgcccgctgcc

SEQ ID NO: 19331 - DNA, 20 bp, synthetic construct
  source 1..20: mol_type = other DNA
gactgggtgcactggttcct

SEQ ID NO: 19332 - DNA, 20 bp, synthetic construct
  source 1..20: mol_type = other DNA
tccccagctaaataccctgc

SEQ ID NO: 19333 - DNA, 20 bp, synthetic construct
  source 1..20: mol_type = other DNA
ggggcccctgggcagtgggt

SEQ ID NO: 19334 - DNA, 20 bp, synthetic construct
  source 1..20: mol_type = other DNA
ctggaggaagctgccaagga

SEQ ID NO: 19335 - DNA, 20 bp, synthetic construct
  source 1..20: mol_type = other DNA
gcggcctctggggtccgtgc

SEQ ID NO: 19336 - DNA, 20 bp, synthetic construct
  source 1..20: mol_type = other DNA
atgcccgacaaatgcaaatg

SEQ ID NO: 19337 - DNA, 20 bp, synthetic construct
  source 1..20: mol_type = other DNA
gtctatgaggtcatctccaa

SEQ ID NO: 19338 - DNA, 20 bp, synthetic construct
  source 1..20: mol_type = other DNA
cagcttctgaagtttgtgga

SEQ ID NO: 19339 - DNA, 20 bp, synthetic construct
  source 1..20: mol_type = other DNA
gacttcatgcccaccatctt

SEQ ID NO: 19340 - DNA, 20 bp, synthetic construct
  source 1..20: mol_type = other DNA
gaagccctcagcaagatgaa

SEQ ID NO: 19341 - DNA, 20 bp, synthetic construct
  source 1..20: mol_type = other DNA
ctcaagcgccgctttgccat

SEQ ID NO: 19342 - DNA, 20 bp, synthetic construct
  source 1..20: mol_type = other DNA
tggccaggctggcacatacc

SEQ ID NO: 19343 - DNA, 20 bp, synthetic construct
  source 1..20: mol_type = other DNA
ccccacccttgcccgcggca

SEQ ID NO: 19344 - DNA, 20 bp, synthetic construct
  source 1..20: mol_type = other DNA
gccccaagcctttgcagccc

SEQ ID NO: 19345 - DNA, 20 bp, synthetic construct
  source 1..20: mol_type = other DNA
aggacaacatagacgaggat

SEQ ID NO: 19346 - DNA, 20 bp, synthetic construct
  source 1..20: mol_type = other DNA
cccacctccccgtgcagcag

SEQ ID NO: 19347 - DNA, 20 bp, synthetic construct
  source 1..20: mol_type = other DNA
tccagactgtgaaccacgtt

SEQ ID NO: 19348 - DNA, 20 bp, synthetic construct
  source 1..20: mol_type = other DNA
tggtcaccatgccctccttc

SEQ ID NO: 19349 - DNA, 20 bp, synthetic construct
  source 1..20: mol_type = other DNA
gtgcgatgtggacgtcacgc

SEQ ID NO: 19350 - DNA, 20 bp, synthetic construct
  source 1..20: mol_type = other DNA
ccactgggcccctgtcccca

SEQ ID NO: 19351 - DNA, 20 bp, synthetic construct
  source 1..20: mol_type = other DNA
cctcctgcagtttgggagac

SEQ ID NO: 19352 - DNA, 20 bp, synthetic construct
  source 1..20: mol_type = other DNA
gcttctgctccagccccttt

SEQ ID NO: 19353 - DNA, 20 bp, synthetic construct
  source 1..20: mol_type = other DNA
ttcctgttccctcctggtcc

SEQ ID NO: 19354 - DNA, 20 bp, synthetic construct
  source 1..20: mol_type = other DNA
tgctattcccattgtgacag

SEQ ID NO: 19355 - DNA, 20 bp, synthetic construct
  source 1..20: mol_type = other DNA
cccccagcatcgggggcctg

SEQ ID NO: 19356 - DNA, 20 bp, synthetic construct
  source 1..20: mol_type = other DNA
cccactgttaacaacgacta

SEQ ID NO: 19357 - DNA, 20 bp, synthetic construct
  source 1..20: mol_type = other DNA
ttcaaacatgcacttgcagc

SEQ ID NO: 19358 - DNA, 20 bp, synthetic construct
  source 1..20: mol_type = other DNA
caagaggtggaatctccaac

SEQ ID NO: 19359 - DNA, 20 bp, synthetic construct
  source 1..20: mol_type = other DNA
ctcaaagcatttacagtacc

SEQ ID NO: 19360 - DNA, 20 bp, synthetic construct
  source 1..20: mol_type = other DNA
tccagaaaagcattatggtt

SEQ ID NO: 19361 - DNA, 20 bp, synthetic construct
  source 1..20: mol_type = other DNA
tatacaagcatgcgttgcac

SEQ ID NO: 19362 - DNA, 20 bp, synthetic construct
  source 1..20: mol_type = other DNA
actggggagacagaaactgt

SEQ ID NO: 19363 - DNA, 20 bp, synthetic construct
  source 1..20: mol_type = other DNA
ctagggtggaagagccgggc

SEQ ID NO: 19364 - DNA, 20 bp, synthetic construct
  source 1..20: mol_type = other DNA
tgcactggaacttacaacac

SEQ ID NO: 19365 - DNA, 20 bp, synthetic construct
  source 1..20: mol_type = other DNA
gtttcatctgcgacccggac

SEQ ID NO: 19366 - DNA, 20 bp, synthetic construct
  source 1..20: mol_type = other DNA
ccacctccagcttgtacctg

SEQ ID NO: 19367 - DNA, 20 bp, synthetic construct
  source 1..20: mol_type = other DNA
ccccgcagggcagccccgag

SEQ ID NO: 19368 - DNA, 20 bp, synthetic construct
  source 1..20: mol_type = other DNA
gcaaacctcctcacagccca

SEQ ID NO: 19369 - DNA, 20 bp, synthetic construct
  source 1..20: mol_type = other DNA
ggtcctcggacaccgaggag

SEQ ID NO: 19370 - DNA, 20 bp, synthetic construct
  source 1..20: mol_type = other DNA
aggtactataaaccctaatt

SEQ ID NO: 19371 - DNA, 20 bp, synthetic construct
  source 1..20: mol_type = other DNA
gccgatatttggagttctta

SEQ ID NO: 19372 - DNA, 20 bp, synthetic construct
  source 1..20: mol_type = other DNA
attcctgaattttggttaac

SEQ ID NO: 19373 - DNA, 20 bp, synthetic construct
  source 1..20: mol_type = other DNA
acaaatgaagtgctgacaaa

SEQ ID NO: 19374 - DNA, 20 bp, synthetic construct
  source 1..20: mol_type = other DNA
gggacagttcgtactgtgac

SEQ ID NO: 19375 - DNA, 20 bp, synthetic construct
  source 1..20: mol_type = other DNA
ttacataaaggggatgtggt

SEQ ID NO: 19376 - DNA, 20 bp, synthetic construct
  source 1..20: mol_type = other DNA
atcacttataaagaaaactg

SEQ ID NO: 19377 - DNA, 20 bp, synthetic construct
  source 1..20: mol_type = other DNA
atatggtaaggcccctaaaa

SEQ ID NO: 19378 - DNA, 20 bp, synthetic construct
  source 1..20: mol_type = other DNA
agcctccccaaaggcagctc

SEQ ID NO: 19379 - DNA, 20 bp, synthetic construct
  source 1..20: mol_type = other DNA
agtgactttgaacagcttcc

SEQ ID NO: 19380 - DNA, 20 bp, synthetic construct
  source 1..20: mol_type = other DNA
acaacacgatgccatgagct

SEQ ID NO: 19381 - DNA, 20 bp, synthetic construct
  source 1..20: mol_type = other DNA
aggccattcagaaaaagctt

SEQ ID NO: 19382 - DNA, 20 bp, synthetic construct
  source 1..20: mol_type = other DNA
tcttacctctttgactgaac

SEQ ID NO: 19383 - DNA, 20 bp, synthetic construct
  source 1..20: mol_type = other DNA
gaggccgcagtggcagcttc

SEQ ID NO: 19384 - DNA, 20 bp, synthetic construct
  source 1..20: mol_type = other DNA
gtccaagatgctaatggcct

SEQ ID NO: 19385 - DNA, 20 bp, synthetic construct
  source 1..20: mol_type = other DNA
gtagctgaattcacctgact

SEQ ID NO: 19386 - DNA, 20 bp, synthetic construct
  source 1..20: mol_type = other DNA
ccgagcatagtatgctgagt

SEQ ID NO: 19387 - DNA, 20 bp, synthetic construct
  source 1..20: mol_type = other DNA
tcataccagggtcatgcgtt

SEQ ID NO: 19388 - DNA, 20 bp, synthetic construct
  source 1..20: mol_type = other DNA
ggtctgccagctgagatgct

SEQ ID NO: 19389 - DNA, 20 bp, synthetic construct
  source 1..20: mol_type = other DNA
aattttctctactgtctgta

SEQ ID NO: 19390 - DNA, 20 bp, synthetic construct
  source 1..20: mol_type = other DNA
aacagctgagggtgtttgct

SEQ ID NO: 19391 - DNA, 20 bp, synthetic construct
  source 1..20: mol_type = other DNA
taggcctcagcccaggtcct

SEQ ID NO: 19392 - DNA, 20 bp, synthetic construct
  source 1..20: mol_type = other DNA
cggccacctacatgttccac

SEQ ID NO: 19393 - DNA, 20 bp, synthetic construct
  source 1..20: mol_type = other DNA
gcatcagcgtgcaccgctac

SEQ ID NO: 19394 - DNA, 20 bp, synthetic construct
  source 1..20: mol_type = other DNA
atgacaccactcggcctgaa

SEQ ID NO: 19395 - DNA, 20 bp, synthetic construct
  source 1..20: mol_type = other DNA
tccgcaccatagctgtggtg

SEQ ID NO: 19396 - DNA, 20 bp, synthetic construct
  source 1..20: mol_type = other DNA
atcctgtgctctacttgctc

SEQ ID NO: 19397 - DNA, 20 bp, synthetic construct
  source 1..20: mol_type = other DNA
gtgacctcatctctcataac

SEQ ID NO: 19398 - DNA, 20 bp, synthetic construct
  source 1..20: mol_type = other DNA
ttgtttctgttccttcctgg

SEQ ID NO: 19399 - DNA, 20 bp, synthetic construct
  source 1..20: mol_type = other DNA
agcttggctcgtggaagaag

SEQ ID NO: 19400 - DNA, 20 bp, synthetic construct
  source 1..20: mol_type = other DNA
tgctgcaacaaccgcaacgt

SEQ ID NO: 19401 - DNA, 20 bp, synthetic construct
  source 1..20: mol_type = other DNA
cgctgtggactgtcctgagg

SEQ ID NO: 19402 - DNA, 20 bp, synthetic construct
  source 1..20: mol_type = other DNA
aaacaccagtcacctcgtct

SEQ ID NO: 19403 - DNA, 20 bp, synthetic construct
  source 1..20: mol_type = other DNA
tatgacaatttctggcagat

SEQ ID NO: 19404 - DNA, 20 bp, synthetic construct
  source 1..20: mol_type = other DNA
ctcgtgggctgggaatgggg

SEQ ID NO: 19405 - DNA, 20 bp, synthetic construct
  source 1..20: mol_type = other DNA
cccgcccccctacccggccc

SEQ ID NO: 19406 - DNA, 20 bp, synthetic construct
  source 1..20: mol_type = other DNA
gccggccatgatcgccgagt

SEQ ID NO: 19407 - DNA, 20 bp, synthetic construct
  source 1..20: mol_type = other DNA
gcgacctgtccaggtgagaa

SEQ ID NO: 19408 - DNA, 20 bp, synthetic construct
  source 1..20: mol_type = other DNA
tcgggtgaccattcggacgg

SEQ ID NO: 19409 - DNA, 20 bp, synthetic construct
  source 1..20: mol_type = other DNA
gggtccttggagtgataata

SEQ ID NO: 19410 - DNA, 20 bp, synthetic construct
  source 1..20: mol_type = other DNA
gaactccatcgccatcttct

SEQ ID NO: 19411 - DNA, 20 bp, synthetic construct
  source 1..20: mol_type = other DNA
gcctgatccctgaacccctg

SEQ ID NO: 19412 - DNA, 20 bp, synthetic construct
  source 1..20: mol_type = other DNA
tgattcacctcttcctctgg

SEQ ID NO: 19413 - DNA, 20 bp, synthetic construct
  source 1..20: mol_type = other DNA
gggacacctgggagaaggtc

SEQ ID NO: 19414 - DNA, 20 bp, synthetic construct
  source 1..20: mol_type = other DNA
ccctggggtgggatctgagc

SEQ ID NO: 19415 - DNA, 20 bp, synthetic construct
  source 1..20: mol_type = other DNA
tggaatcctgaagtgcctgc

SEQ ID NO: 19416 - DNA, 20 bp, synthetic construct
  source 1..20: mol_type = other DNA
tggcatggttttgctgaatt

SEQ ID NO: 19417 - DNA, 20 bp, synthetic construct
  source 1..20: mol_type = other DNA
cacaccataggatgtgagca

SEQ ID NO: 19418 - DNA, 20 bp, synthetic construct
  source 1..20: mol_type = other DNA
tgacataatatgataatgtg

SEQ ID NO: 19419 - DNA, 20 bp, synthetic construct
  source 1..20: mol_type = other DNA
cttaaaagtaaattcagact

SEQ ID NO: 19420 - DNA, 20 bp, synthetic construct
  source 1..20: mol_type = other DNA
caccatgcctggctaatttt

SEQ ID NO: 19421 - DNA, 20 bp, synthetic construct
  source 1..20: mol_type = other DNA
tgaggtgttcttagaagggt

SEQ ID NO: 19422 - DNA, 20 bp, synthetic construct
  source 1..20: mol_type = other DNA
cagattcggctaggaaaaga

SEQ ID NO: 19423 - DNA, 20 bp, synthetic construct
  source 1..20: mol_type = other DNA
gattaattttttgattttcc

SEQ ID NO: 19424 - DNA, 20 bp, synthetic construct
  source 1..20: mol_type = other DNA
tagtcatcctaagtatacca

SEQ ID NO: 19425 - DNA, 20 bp, synthetic construct
  source 1..20: mol_type = other DNA
tgattcagagctgtcattct

SEQ ID NO: 19426 - DNA, 20 bp, synthetic construct
  source 1..20: mol_type = other DNA
ttctgtaattttaaaacatt

SEQ ID NO: 19427 - DNA, 20 bp, synthetic construct
  source 1..20: mol_type = other DNA
gtgagaaagggcctcaccca

SEQ ID NO: 19428 - DNA, 20 bp, synthetic construct
  source 1..20: mol_type = other DNA
tgctgttgtcagtattactc

SEQ ID NO: 19429 - DNA, 20 bp, synthetic construct
  source 1..20: mol_type = other DNA
tgcacattcctgaaccagcc

SEQ ID NO: 19430 - DNA, 20 bp, synthetic construct
  source 1..20: mol_type = other DNA
actagttagagtctacattt

SEQ ID NO: 19431 - DNA, 20 bp, synthetic construct
  source 1..20: mol_type = other DNA
gctcgcgcgccctcccgccg

SEQ ID NO: 19432 - DNA, 20 bp, synthetic construct
  source 1..20: mol_type = other DNA
tcctctgggcaccgtccctg

SEQ ID NO: 19433 - DNA, 20 bp, synthetic construct
  source 1..20: mol_type = other DNA
ggcagcggcggcttcggctc

SEQ ID NO: 19434 - DNA, 20 bp, synthetic construct
  source 1..20: mol_type = other DNA
gtcattaggctcctggactg

SEQ ID NO: 19435 - DNA, 20 bp, synthetic construct
  source 1..20: mol_type = other DNA
gataggccaaccttcgaaga

SEQ ID NO: 19436 - DNA, 20 bp, synthetic construct
  source 1..20: mol_type = other DNA
tctccagcttcccgagtacc

SEQ ID NO: 19437 - DNA, 20 bp, synthetic construct
  source 1..20: mol_type = other DNA
tcttctcataggtgtccagc

SEQ ID NO: 19438 - DNA, 20 bp, synthetic construct
  source 1..20: mol_type = other DNA
ccaccacatctacggactgc

SEQ ID NO: 19439 - DNA, 20 bp, synthetic construct
  source 1..20: mol_type = other DNA
cgagcctgctgtcattgaga

SEQ ID NO: 19440 - DNA, 20 bp, synthetic construct
  source 1..20: mol_type = other DNA
atcacctgaggccaggaatt

SEQ ID NO: 19441 - DNA, 20 bp, synthetic construct
  source 1..20: mol_type = other DNA
ccgtggctccggatctcttc

SEQ ID NO: 19442 - DNA, 20 bp, synthetic construct
  source 1..20: mol_type = other DNA
tcgggctgaaggcagtgatg

SEQ ID NO: 19443 - DNA, 20 bp, synthetic construct
  source 1..20: mol_type = other DNA
ccagacagctcgtcaggccc

SEQ ID NO: 19444 - DNA, 20 bp, synthetic construct
  source 1..20: mol_type = other DNA
agggaagaagatcaacgcct

SEQ ID NO: 19445 - DNA, 20 bp, synthetic construct
  source 1..20: mol_type = other DNA
tgtgtgtactctgtccagtt

SEQ ID NO: 19446 - DNA, 20 bp, synthetic construct
  source 1..20: mol_type = other DNA
cagctgtcctgcagcaaaca

SEQ ID NO: 19447 - DNA, 20 bp, synthetic construct
  source 1..20: mol_type = other DNA
gggcgtctgggatgcagtgg

SEQ ID NO: 19448 - DNA, 20 bp, synthetic construct
  source 1..20: mol_type = other DNA
catggctgacacattcctgg

SEQ ID NO: 19449 - DNA, 20 bp, synthetic construct
  source 1..20: mol_type = other DNA
aactcatgagtaccatgcgg

SEQ ID NO: 19450 - DNA, 20 bp, synthetic construct
  source 1..20: mol_type = other DNA
cgtggacctccgggtgaact

SEQ ID NO: 19451 - DNA, 20 bp, synthetic construct
  source 1..20: mol_type = other DNA
aagagttaggggccttaggg

SEQ ID NO: 19452 - DNA, 20 bp, synthetic construct
  source 1..20: mol_type = other DNA
agcgctctcactcgcacaag

SEQ ID NO: 19453 - DNA, 20 bp, synthetic construct
  source 1..20: mol_type = other DNA
tcaggcagattgtgtctgga

SEQ ID NO: 19454 - DNA, 20 bp, synthetic construct
  source 1..20: mol_type = other DNA
caagggttcttcggggatgt

SEQ ID NO: 19455 - DNA, 20 bp, synthetic construct
  source 1..20: mol_type = other DNA
acatgagcctccttccagac

SEQ ID NO: 19456 - DNA, 20 bp, synthetic construct
  source 1..20: mol_type = other DNA
ggatatctacaactttcagg

SEQ ID NO: 19457 - DNA, 20 bp, synthetic construct
  source 1..20: mol_type = other DNA
aagaatgatctagagtatgt

SEQ ID NO: 19458 - DNA, 20 bp, synthetic construct
  source 1..20: mol_type = other DNA
gggggaccgcggcccaggct

SEQ ID NO: 19459 - DNA, 20 bp, synthetic construct
  source 1..20: mol_type = other DNA
ctccccactcgaggccggcg

SEQ ID NO: 19460 - DNA, 20 bp, synthetic construct
  source 1..20: mol_type = other DNA
ggacacgctttcaccagctt

SEQ ID NO: 19461 - DNA, 20 bp, synthetic construct
  source 1..20: mol_type = other DNA
tatggagacactgtgtatgg

SEQ ID NO: 19462 - DNA, 20 bp, synthetic construct
  source 1..20: mol_type = other DNA
tgattttgccatgaagttca

SEQ ID NO: 19463 - DNA, 20 bp, synthetic construct
  source 1..20: mol_type = other DNA
catgctgctttttaatcata

SEQ ID NO: 19464 - DNA, 20 bp, synthetic construct
  source 1..20: mol_type = other DNA
aaaattagccgggtgtggtg

SEQ ID NO: 19465 - DNA, 20 bp, synthetic construct
  source 1..20: mol_type = other DNA
gttatgttgcttttaaagat

SEQ ID NO: 19466 - DNA, 20 bp, synthetic construct
  source 1..20: mol_type = other DNA
tactctgcaggctgaggtgg

SEQ ID NO: 19467 - DNA, 20 bp, synthetic construct
  source 1..20: mol_type = other DNA
gtcaacaagatccaggggct

SEQ ID NO: 19468 - DNA, 20 bp, synthetic construct
  source 1..20: mol_type = other DNA
ctgaaagtcactcgacattg

SEQ ID NO: 19469 - DNA, 20 bp, synthetic construct
  source 1..20: mol_type = other DNA
cagttacagcggcaggagcg

SEQ ID NO: 19470 - DNA, 20 bp, synthetic construct
  source 1..20: mol_type = other DNA
gttgtctggaggttccaggg

SEQ ID NO: 19471 - DNA, 20 bp, synthetic construct
  source 1..20: mol_type = other DNA
ggccaccttcaacagctggt

SEQ ID NO: 19472 - DNA, 20 bp, synthetic construct
  source 1..20: mol_type = other DNA
ccaccacctgaaggctcatg

SEQ ID NO: 19473 - DNA, 20 bp, synthetic construct
  source 1..20: mol_type = other DNA
aaatacactgcgtacacgtg

SEQ ID NO: 19474 - DNA, 20 bp, synthetic construct
  source 1..20: mol_type = other DNA
tagataagagtagcttggag

SEQ ID NO: 19475 - DNA, 20 bp, synthetic construct
  source 1..20: mol_type = other DNA
atttcacaagtgcctttctg

SEQ ID NO: 19476 - DNA, 20 bp, synthetic construct
  source 1..20: mol_type = other DNA
tcactgctgccagtgcacgt

SEQ ID NO: 19477 - DNA, 20 bp, synthetic construct
  source 1..20: mol_type = other DNA
caagaagacggagtcggatg

SEQ ID NO: 19478 - DNA, 20 bp, synthetic construct
  source 1..20: mol_type = other DNA
tagagcttggacagtctgag

SEQ ID NO: 19479 - DNA, 20 bp, synthetic construct
  source 1..20: mol_type = other DNA
ggaatggtggtgttcttagg

SEQ ID NO: 19480 - DNA, 20 bp, synthetic construct
  source 1..20: mol_type = other DNA
ttcatagcctgggctgggtg

SEQ ID NO: 19481 - DNA, 20 bp, synthetic construct
  source 1..20: mol_type = other DNA
aggaccaccgcctccaggga

SEQ ID NO: 19482 - DNA, 20 bp, synthetic construct
  source 1..20: mol_type = other DNA
tgacagagttagattccacc

SEQ ID NO: 19483 - DNA, 20 bp, synthetic construct
  source 1..20: mol_type = other DNA
ccaggagtgtcggagcacat

SEQ ID NO: 19484 - DNA, 20 bp, synthetic construct
  source 1..20: mol_type = other DNA
gcagacaaggcacccttctg

SEQ ID NO: 19485 - DNA, 20 bp, synthetic construct
  source 1..20: mol_type = other DNA
agcaagcccaatgcacccag

SEQ ID NO: 19486 - DNA, 20 bp, synthetic construct
  source 1..20: mol_type = other DNA
tggatgccatggctctgggc

SEQ ID NO: 19487 - DNA, 20 bp, synthetic construct
  source 1..20: mol_type = other DNA
gccatctcaccaaaggatta

SEQ ID NO: 19488 - DNA, 20 bp, synthetic construct
  source 1..20: mol_type = other DNA
tggaaattactgccctcctg

SEQ ID NO: 19489 - DNA, 20 bp, synthetic construct
  source 1..20: mol_type = other DNA
cgtgcttcgcccggcagtgt

SEQ ID NO: 19490 - DNA, 20 bp, synthetic construct
  source 1..20: mol_type = other DNA
acaccccagcgcagacacgc

SEQ ID NO: 19491 - DNA, 20 bp, synthetic construct
  source 1..20: mol_type = other DNA
acagatgcagtgcaagctgt

SEQ ID NO: 19492 - DNA, 20 bp, synthetic construct
  source 1..20: mol_type = other DNA
ggcccagatgcagatcgaca

SEQ ID NO: 19493 - DNA, 20 bp, synthetic construct
  source 1..20: mol_type = other DNA
ctcatcatattgatgagcga

SEQ ID NO: 19494 - DNA, 20 bp, synthetic construct
  source 1..20: mol_type = other DNA
acacccttcccaccctgctg

SEQ ID NO: 19495 - DNA, 20 bp, synthetic construct
  source 1..20: mol_type = other DNA
gcacactggagtggacgcct

SEQ ID NO: 19496 - DNA, 20 bp, synthetic construct
  source 1..20: mol_type = other DNA
ctgtgccgtccacacctcta

SEQ ID NO: 19497 - DNA, 20 bp, synthetic construct
  source 1..20: mol_type = other DNA
gctttaagccttagccagct

SEQ ID NO: 19498 - DNA, 20 bp, synthetic construct
  source 1..20: mol_type = other DNA
ccggcctcacccccacgagc

SEQ ID NO: 19499 - DNA, 20 bp, synthetic construct
  source 1..20: mol_type = other DNA
ccaagttcctatagaagagc

SEQ ID NO: 19500 - DNA, 20 bp, synthetic construct
  source 1..20: mol_type = other DNA
gaaccgaaactctggcagct

SEQ ID NO: 19501 - DNA, 20 bp, synthetic construct
  source 1..20: mol_type = other DNA
tggggaaggaacgctgtcag

SEQ ID NO: 19502 - DNA, 20 bp, synthetic construct
  source 1..20: mol_type = other DNA
tgagcccatgctgatggagt

SEQ ID NO: 19503 - DNA, 20 bp, synthetic construct
  source 1..20: mol_type = other DNA
cagaagcaggctggaggtaa

SEQ ID NO: 19504 - DNA, 20 bp, synthetic construct
  source 1..20: mol_type = other DNA
ggccaacaaaaaagacctgc

SEQ ID NO: 19505 - DNA, 20 bp, synthetic construct
  source 1..20: mol_type = other DNA
cagagtgtgtggctgtgtgt

SEQ ID NO: 19506 - DNA, 20 bp, synthetic construct
  source 1..20: mol_type = other DNA
gagcaagaggtgtcggaggt

SEQ ID NO: 19507 - DNA, 20 bp, synthetic construct
  source 1..20: mol_type = other DNA
gaagatgtcctcttagtgct

SEQ ID NO: 19508 - DNA, 20 bp, synthetic construct
  source 1..20: mol_type = other DNA
aaactatgtgcagaatctaa

SEQ ID NO: 19509 - DNA, 20 bp, synthetic construct
  source 1..20: mol_type = other DNA
tgtccagtttgtattaaaaa

SEQ ID NO: 19510 - DNA, 20 bp, synthetic construct
  source 1..20: mol_type = other DNA
gtctttgggccctccagttt

SEQ ID NO: 19511 - DNA, 20 bp, synthetic construct
  source 1..20: mol_type = other DNA
gacccaggtcttcaagctgg

SEQ ID NO: 19512 - DNA, 20 bp, synthetic construct
  source 1..20: mol_type = other DNA
tgtagacagtggctgccttc

SEQ ID NO: 19513 - DNA, 20 bp, synthetic construct
  source 1..20: mol_type = other DNA
taatggatttctgttgtgtt

SEQ ID NO: 19514 - DNA, 20 bp, synthetic construct
  source 1..20: mol_type = other DNA
tgttacgggagataattgtg

SEQ ID NO: 19515 - DNA, 20 bp, synthetic construct
  source 1..20: mol_type = other DNA
atacaaggcagatccaacca

SEQ ID NO: 19516 - DNA, 20 bp, synthetic construct
  source 1..20: mol_type = other DNA
tgacagcgttcagcgacccg

SEQ ID NO: 19517 - DNA, 20 bp, synthetic construct
  source 1..20: mol_type = other DNA
accccggctcgtcgcaagcg

SEQ ID NO: 19518 - DNA, 20 bp, synthetic construct
  source 1..20: mol_type = other DNA
accccagcctcccgaaccag

SEQ ID NO: 19519 - DNA, 20 bp, synthetic construct
  source 1..20: mol_type = other DNA
gtgatcgcttggttatccag

SEQ ID NO: 19520 - DNA, 20 bp, synthetic construct
  source 1..20: mol_type = other DNA
acttcctccttaaaacagag

SEQ ID NO: 19521 - DNA, 20 bp, synthetic construct
  source 1..20: mol_type = other DNA
ctcaacaacatctttgtgtt

SEQ ID NO: 19522 - DNA, 20 bp, synthetic construct
  source 1..20: mol_type = other DNA
cccactttctccctcctcct

SEQ ID NO: 19523 - DNA, 20 bp, synthetic construct
  source 1..20: mol_type = other DNA
gccaaccatattggatctgc

SEQ ID NO: 19524 - DNA, 20 bp, synthetic construct
  source 1..20: mol_type = other DNA
tgtttaccgtagcgtataca

SEQ ID NO: 19525 - DNA, 20 bp, synthetic construct
  source 1..20: mol_type = other DNA
tataaaatattgttaatgcc

SEQ ID NO: 19526 - DNA, 20 bp, synthetic construct
  source 1..20: mol_type = other DNA
gagagaatatcccagaaccc

SEQ ID NO: 19527 - DNA, 20 bp, synthetic construct
  source 1..20: mol_type = other DNA
ccagatggcactctggtcac

SEQ ID NO: 19528 - DNA, 20 bp, synthetic construct
  source 1..20: mol_type = other DNA
taataggatttttagacact

SEQ ID NO: 19529 - DNA, 20 bp, synthetic construct
  source 1..20: mol_type = other DNA
gtcaatttgcctctgtgtgc

SEQ ID NO: 19530 - DNA, 20 bp, synthetic construct
  source 1..20: mol_type = other DNA
aacgtacctcttaaaattcg

SEQ ID NO: 19531 - DNA, 20 bp, synthetic construct
  source 1..20: mol_type = other DNA
ctggagaaaaatgaaggaaa

SEQ ID NO: 19532 - DNA, 20 bp, synthetic construct
  source 1..20: mol_type = other DNA
ggtatctttttattcattgc

SEQ ID NO: 19533 - DNA, 20 bp, synthetic construct
  source 1..20: mol_type = other DNA
ccagttcttcccccttcaca

SEQ ID NO: 19534 - DNA, 20 bp, synthetic construct
  source 1..20: mol_type = other DNA
tcgggtgggccgcctcccct

SEQ ID NO: 19535 - DNA, 20 bp, synthetic construct
  source 1..20: mol_type = other DNA
tgtcaaaagaaacacttgga

SEQ ID NO: 19536 - DNA, 20 bp, synthetic construct
  source 1..20: mol_type = other DNA
tactcaaggagctccaagaa

SEQ ID NO: 19537 - DNA, 20 bp, synthetic construct
  source 1..20: mol_type = other DNA
tgccaggcaactcagcaagc

SEQ ID NO: 19538 - DNA, 20 bp, synthetic construct
  source 1..20: mol_type = other DNA
gagaccttttgtcatcccat

SEQ ID NO: 19539 - DNA, 20 bp, synthetic construct
  source 1..20: mol_type = other DNA
cccacctccacctcagcatt

SEQ ID NO: 19540 - DNA, 20 bp, synthetic construct
  source 1..20: mol_type = other DNA
agaagagtggaaacatcttg

SEQ ID NO: 19541 - DNA, 20 bp, synthetic construct
  source 1..20: mol_type = other DNA
cagcagccactctaggcagc

SEQ ID NO: 19542 - DNA, 20 bp, synthetic construct
  source 1..20: mol_type = other DNA
aattatcctatttcagtact

SEQ ID NO: 19543 - DNA, 20 bp, synthetic construct
  source 1..20: mol_type = other DNA
cggaattttgaaaagcacca

SEQ ID NO: 19544 - DNA, 20 bp, synthetic construct
  source 1..20: mol_type = other DNA
tctgcatagaggcaatccta

SEQ ID NO: 19545 - DNA, 20 bp, synthetic construct
  source 1..20: mol_type = other DNA
gtgaaaacaaatacaaaaaa

SEQ ID NO: 19546 - DNA, 20 bp, synthetic construct
  source 1..20: mol_type = other DNA
tgtgagaatataatttgtag

SEQ ID NO: 19547 - DNA, 20 bp, synthetic construct
  source 1..20: mol_type = other DNA
ctgttgaaatgcagatttga

SEQ ID NO: 19548 - DNA, 20 bp, synthetic construct
  source 1..20: mol_type = other DNA
cgtccccggtgtgccatggt

SEQ ID NO: 19549 - DNA, 20 bp, synthetic construct
  source 1..20: mol_type = other DNA
agctcattcataaggggatg

SEQ ID NO: 19550 - DNA, 20 bp, synthetic construct
  source 1..20: mol_type = other DNA
tctagtttccttcttgtgcc

SEQ ID NO: 19551 - DNA, 20 bp, synthetic construct
  source 1..20: mol_type = other DNA
cacttttcctccctctcccg

SEQ ID NO: 19552 - DNA, 20 bp, synthetic construct
  source 1..20: mol_type = other DNA
tttggcaatgacatttcacc

SEQ ID NO: 19553 - DNA, 20 bp, synthetic construct
  source 1..20: mol_type = other DNA
cgtgagctcctccactgcgc

SEQ ID NO: 19554 - DNA, 20 bp, synthetic construct
  source 1..20: mol_type = other DNA
ggctttgacagagagccttt

SEQ ID NO: 19555 - DNA, 20 bp, synthetic construct
  source 1..20: mol_type = other DNA
gccaagatggagcgcacggt

SEQ ID NO: 19556 - DNA, 20 bp, synthetic construct
  source 1..20: mol_type = other DNA
aaagactgggagaagcacca

SEQ ID NO: 19557 - DNA, 20 bp, synthetic construct
  source 1..20: mol_type = other DNA
cttctccaaatacatataca

SEQ ID NO: 19558 - DNA, 20 bp, synthetic construct
  source 1..20: mol_type = other DNA
gaaagcacataaccaggctc

SEQ ID NO: 19559 - DNA, 20 bp, synthetic construct
  source 1..20: mol_type = other DNA
acccacacgtctttatctct

SEQ ID NO: 19560 - DNA, 20 bp, synthetic construct
  source 1..20: mol_type = other DNA
ttcctcttcctccttcccct

SEQ ID NO: 19561 - DNA, 20 bp, synthetic construct
  source 1..20: mol_type = other DNA
attggatagaattgaatggt

SEQ ID NO: 19562 - DNA, 20 bp, synthetic construct
  source 1..20: mol_type = other DNA
ccatcctccatggtgctgaa

SEQ ID NO: 19563 - DNA, 20 bp, synthetic construct
  source 1..20: mol_type = other DNA
ggaggagaattactaccttc

SEQ ID NO: 19564 - DNA, 20 bp, synthetic construct
  source 1..20: mol_type = other DNA
gtcaggttgcttggctgcct

SEQ ID NO: 19565 - DNA, 20 bp, synthetic construct
  source 1..20: mol_type = other DNA
tatctcctctgacacatatt

SEQ ID NO: 19566 - DNA, 20 bp, synthetic construct
  source 1..20: mol_type = other DNA
actctaaaagtcaaatcttc

SEQ ID NO: 19567 - DNA, 20 bp, synthetic construct
  source 1..20: mol_type = other DNA
aagcacaggaccccaggaac

SEQ ID NO: 19568 - DNA, 20 bp, synthetic construct
  source 1..20: mol_type = other DNA
ctcatttcatttgcccagcc

SEQ ID NO: 19569 - DNA, 20 bp, synthetic construct
  source 1..20: mol_type = other DNA
ttgtgattccaaagaatccc

SEQ ID NO: 19570 - DNA, 20 bp, synthetic construct
  source 1..20: mol_type = other DNA
gcttcctcaagcaaggccat

SEQ ID NO: 19571 - DNA, 20 bp, synthetic construct
  source 1..20: mol_type = other DNA
tgctttcatcctgtggcctc

SEQ ID NO: 19572 - DNA, 20 bp, synthetic construct
  source 1..20: mol_type = other DNA
tgaatgccttccacgtgatg

SEQ ID NO: 19573 - DNA, 20 bp, synthetic construct
  source 1..20: mol_type = other DNA
cagcgcctgtccattgcttc

SEQ ID NO: 19574 - DNA, 20 bp, synthetic construct
  source 1..20: mol_type = other DNA
atgacttctggcggctggtt

SEQ ID NO: 19575 - DNA, 20 bp, synthetic construct
  source 1..20: mol_type = other DNA
gggggcgtaaaccaggaaag

SEQ ID NO: 19576 - DNA, 20 bp, synthetic construct
  source 1..20: mol_type = other DNA
gtgcctctgtggtgttgcag

SEQ ID NO: 19577 - DNA, 20 bp, synthetic construct
  source 1..20: mol_type = other DNA
tccgcttcctggagaaactc

SEQ ID NO: 19578 - DNA, 20 bp, synthetic construct
  source 1..20: mol_type = other DNA
cacactcagactcaatggac

SEQ ID NO: 19579 - DNA, 20 bp, synthetic construct
  source 1..20: mol_type = other DNA
gccttgaccacatcactcca

SEQ ID NO: 19580 - DNA, 20 bp, synthetic construct
  source 1..20: mol_type = other DNA
cggaaggccaagaaggcgct

SEQ ID NO: 19581 - DNA, 20 bp, synthetic construct
  source 1..20: mol_type = other DNA
cattcttgtgagccaaacct

SEQ ID NO: 19582 - DNA, 20 bp, synthetic construct
  source 1..20: mol_type = other DNA
caagaagaagctccaaagca

SEQ ID NO: 19583 - DNA, 20 bp, synthetic construct
  source 1..20: mol_type = other DNA
cgcctgcagctggcattggt

SEQ ID NO: 19584 - DNA, 20 bp, synthetic construct
  source 1..20: mol_type = other DNA
ctcaacaactttttgcaggg

SEQ ID NO: 19585 - DNA, 20 bp, synthetic construct
  source 1..20: mol_type = other DNA
cccaaagcttccactcgctg

SEQ ID NO: 19586 - DNA, 20 bp, synthetic construct
  source 1..20: mol_type = other DNA
atcgtctttggtgtggcgct

SEQ ID NO: 19587 - DNA, 20 bp, synthetic construct
  source 1..20: mol_type = other DNA
ttactctttgcccgccttgg

SEQ ID NO: 19588 - DNA, 20 bp, synthetic construct
  source 1..20: mol_type = other DNA
aatgtagaaggtgacgctct

SEQ ID NO: 19589 - DNA, 20 bp, synthetic construct
  source 1..20: mol_type = other DNA
ctccaggacaggagatctgg

SEQ ID NO: 19590 - DNA, 20 bp, synthetic construct
  source 1..20: mol_type = other DNA
tacgtcccaccctgtcccca

SEQ ID NO: 19591 - DNA, 20 bp, synthetic construct
  source 1..20: mol_type = other DNA
tcccggacaccagaccaccg

SEQ ID NO: 19592 - DNA, 20 bp, synthetic construct
  source 1..20: mol_type = other DNA
gcgtccgggatctgcgccac

SEQ ID NO: 19593 - DNA, 20 bp, synthetic construct
  source 1..20: mol_type = other DNA
cggttcccgggaccaggtgc

SEQ ID NO: 19594 - DNA, 20 bp, synthetic construct
  source 1..20: mol_type = other DNA
gcgtctgctgcggatgatca

SEQ ID NO: 19595 - DNA, 20 bp, synthetic construct
  source 1..20: mol_type = other DNA
ggacggtgccgcgctcttcc

SEQ ID NO: 19596 - DNA, 20 bp, synthetic construct
  source 1..20: mol_type = other DNA
agtcaacctcccggtcgacc

SEQ ID NO: 19597 - DNA, 20 bp, synthetic construct
  source 1..20: mol_type = other DNA
gaggaatggataaatggatg

SEQ ID NO: 19598 - DNA, 20 bp, synthetic construct
  source 1..20: mol_type = other DNA
gatgtgtgtgtgcacgtgtg

SEQ ID NO: 19599 - DNA, 20 bp, synthetic construct
  source 1..20: mol_type = other DNA
gggcaacctggcgggtctga

SEQ ID NO: 19600 - DNA, 20 bp, synthetic construct
  source 1..20: mol_type = other DNA
ggctaaaaaaaagagcatcc

SEQ ID NO: 19601 - DNA, 20 bp, synthetic construct
  source 1..20: mol_type = other DNA
tgagattggcctggatgcag

SEQ ID NO: 19602 - DNA, 20 bp, synthetic construct
  source 1..20: mol_type = other DNA
ttcccaggccctttggcttc

SEQ ID NO: 19603 - DNA, 20 bp, synthetic construct
  source 1..20: mol_type = other DNA
cttgcggcgcgaaaaaggcg

SEQ ID NO: 19604 - DNA, 20 bp, synthetic construct
  source 1..20: mol_type = other DNA
ccccttgcccacacacccca

SEQ ID NO: 19605 - DNA, 20 bp, synthetic construct
  source 1..20: mol_type = other DNA
ttacccaggctggtcttcaa

SEQ ID NO: 19606 - DNA, 20 bp, synthetic construct
  source 1..20: mol_type = other DNA
ctaagttcacgggcctgtcc

SEQ ID NO: 19607 - DNA, 20 bp, synthetic construct
  source 1..20: mol_type = other DNA
agtggtggcacacgggcgcc

SEQ ID NO: 19608 - DNA, 20 bp, synthetic construct
  source 1..20: mol_type = other DNA
ccccgcagccaacgggccgc

SEQ ID NO: 19609 - DNA, 20 bp, synthetic construct
  source 1..20: mol_type = other DNA
accctgtggagatcctgcag

SEQ ID NO: 19610 - DNA, 20 bp, synthetic construct
  source 1..20: mol_type = other DNA
gcattctccagcatgccaag

SEQ ID NO: 19611 - DNA, 20 bp, synthetic construct
  source 1..20: mol_type = other DNA
aggggtaccgcaagctcatc

SEQ ID NO: 19612 - DNA, 20 bp, synthetic construct
  source 1..20: mol_type = other DNA
tgtacaacaacaacctgaac

SEQ ID NO: 19613 - DNA, 20 bp, synthetic construct
  source 1..20: mol_type = other DNA
agggcggccggcggcggccg

SEQ ID NO: 19614 - DNA, 20 bp, synthetic construct
  source 1..20: mol_type = other DNA
agaattccgaattggggaac

SEQ ID NO: 19615 - DNA, 20 bp, synthetic construct
  source 1..20: mol_type = other DNA
ggggaggcgccgggaagtcg

SEQ ID NO: 19616 - DNA, 20 bp, synthetic construct
  source 1..20: mol_type = other DNA
agaagctgattcccccgcag

SEQ ID NO: 19617 - DNA, 20 bp, synthetic construct
  source 1..20: mol_type = other DNA
ggctggtgtccctgtacaac

SEQ ID NO: 19618 - DNA, 20 bp, synthetic construct
  source 1..20: mol_type = other DNA
ttgacaagtgggccccctcc

SEQ ID NO: 19619 - DNA, 20 bp, synthetic construct
  source 1..20: mol_type = other DNA
acatcgaggagtccttttcc

SEQ ID NO: 19620 - DNA, 20 bp, synthetic construct
  source 1..20: mol_type = other DNA
aggagccacctctaaaggag

SEQ ID NO: 19621 - DNA, 20 bp, synthetic construct
  source 1..20: mol_type = other DNA
aacaagaggaggaccgctca

SEQ ID NO: 19622 - DNA, 20 bp, synthetic construct
  source 1..20: mol_type = other DNA
ttggagtcactgtagttaag

SEQ ID NO: 19623 - DNA, 20 bp, synthetic construct
  source 1..20: mol_type = other DNA
cggcggcccatgaacgcctt

SEQ ID NO: 19624 - DNA, 20 bp, synthetic construct
  source 1..20: mol_type = other DNA
cagcacatgcaggactaccc

SEQ ID NO: 19625 - DNA, 20 bp, synthetic construct
  source 1..20: mol_type = other DNA
ttctcctccccctgccagga

SEQ ID NO: 19626 - DNA, 20 bp, synthetic construct
  source 1..20: mol_type = other DNA
ccacgttccagcccctgcag

SEQ ID NO: 19627 - DNA, 20 bp, synthetic construct
  source 1..20: mol_type = other DNA
tctgtagattcaaaaggtgc

SEQ ID NO: 19628 - DNA, 20 bp, synthetic construct
  source 1..20: mol_type = other DNA
ttcctcaccagccaggtcct

SEQ ID NO: 19629 - DNA, 20 bp, synthetic construct
  source 1..20: mol_type = other DNA
ctctggcagatgagcgtgaa

SEQ ID NO: 19630 - DNA, 20 bp, synthetic construct
  source 1..20: mol_type = other DNA
attttgacaaactaaagaaa

SEQ ID NO: 19631 - DNA, 20 bp, synthetic construct
  source 1..20: mol_type = other DNA
cctgggaaagactggaaaaa

SEQ ID NO: 19632 - DNA, 20 bp, synthetic construct
  source 1..20: mol_type = other DNA
accttcctgcagttgaggcc

SEQ ID NO: 19633 - DNA, 20 bp, synthetic construct
  source 1..20: mol_type = other DNA
aatacctactggaactgctc

SEQ ID NO: 19634 - DNA, 20 bp, synthetic construct
  source 1..20: mol_type = other DNA
cggctgagcgcagggcccgt

SEQ ID NO: 19635 - DNA, 20 bp, synthetic construct
  source 1..20: mol_type = other DNA
acgagatgagcggccgcagt

SEQ ID NO: 19636 - DNA, 20 bp, synthetic construct
  source 1..20: mol_type = other DNA
cctccctgctgcaccagttc

SEQ ID NO: 19637 - DNA, 20 bp, synthetic construct
  source 1..20: mol_type = other DNA
acacgctgcacgaacaagcc

SEQ ID NO: 19638 - DNA, 20 bp, synthetic construct
  source 1..20: mol_type = other DNA
atgcctgtgagctctggatc

SEQ ID NO: 19639 - DNA, 20 bp, synthetic construct
  source 1..20: mol_type = other DNA
acagcggccacccaagtgag

SEQ ID NO: 19640 - DNA, 20 bp, synthetic construct
  source 1..20: mol_type = other DNA
ccaaggtcatcgagtccacc

SEQ ID NO: 19641 - DNA, 20 bp, synthetic construct
  source 1..20: mol_type = other DNA
tcctgtctcggctggccgag

SEQ ID NO: 19642 - DNA, 20 bp, synthetic construct
  source 1..20: mol_type = other DNA
caaacaccctgaccgaggct

SEQ ID NO: 19643 - DNA, 20 bp, synthetic construct
  source 1..20: mol_type = other DNA
ctggatggaacgagctccac

SEQ ID NO: 19644 - DNA, 20 bp, synthetic construct
  source 1..20: mol_type = other DNA
tccaaagccaagcccaggcc

SEQ ID NO: 19645 - DNA, 20 bp, synthetic construct
  source 1..20: mol_type = other DNA
gcagcagcctcagcgctgag

SEQ ID NO: 19646 - DNA, 20 bp, synthetic construct
  source 1..20: mol_type = other DNA
tgcggcagtccaaagtggat

SEQ ID NO: 19647 - DNA, 20 bp, synthetic construct
  source 1..20: mol_type = other DNA
actatgagcatgtcacgatg

SEQ ID NO: 19648 - DNA, 20 bp, synthetic construct
  source 1..20: mol_type = other DNA
tgcacactacatttgagcat

SEQ ID NO: 19649 - DNA, 20 bp, synthetic construct
  source 1..20: mol_type = other DNA
tccatcagttctcaagagac

SEQ ID NO: 19650 - DNA, 20 bp, synthetic construct
  source 1..20: mol_type = other DNA
aacagggatctccacggatg

SEQ ID NO: 19651 - DNA, 20 bp, synthetic construct
  source 1..20: mol_type = other DNA
ctacagaccaaaccatttgt

SEQ ID NO: 19652 - DNA, 20 bp, synthetic construct
  source 1..20: mol_type = other DNA
gagacctcaccatcctctcc

SEQ ID NO: 19653 - DNA, 20 bp, synthetic construct
  source 1..20: mol_type = other DNA
tggcaataagttcataccag

SEQ ID NO: 19654 - DNA, 20 bp, synthetic construct
  source 1..20: mol_type = other DNA
ttgttgccataatgctgtgc

SEQ ID NO: 19655 - DNA, 20 bp, synthetic construct
  source 1..20: mol_type = other DNA
gttgggatgcatcttctgat

SEQ ID NO: 19656 - DNA, 20 bp, synthetic construct
  source 1..20: mol_type = other DNA
cgtggcatgcttaggattgg

SEQ ID NO: 19657 - DNA, 20 bp, synthetic construct
  source 1..20: mol_type = other DNA
actctcttgcagccaacttc

SEQ ID NO: 19658 - DNA, 20 bp, synthetic construct
  source 1..20: mol_type = other DNA
gaattgcagaggacgtctag

SEQ ID NO: 19659 - DNA, 20 bp, synthetic construct
  source 1..20: mol_type = other DNA
tgccggatcacagacctgta

SEQ ID NO: 19660 - DNA, 20 bp, synthetic construct
  source 1..20: mol_type = other DNA
gaagtgctgctcttcaccat

SEQ ID NO: 19661 - DNA, 20 bp, synthetic construct
  source 1..20: mol_type = other DNA
gaacagctcgcccgcagatt

SEQ ID NO: 19662 - DNA, 20 bp, synthetic construct
  source 1..20: mol_type = other DNA
caggctgtggtagccgtggc

SEQ ID NO: 19663 - DNA, 20 bp, synthetic construct
  source 1..20: mol_type = other DNA
gcaacagacggggaaggtta

SEQ ID NO: 19664 - DNA, 20 bp, synthetic construct
  source 1..20: mol_type = other DNA
tggatacgggagaaggagaa

SEQ ID NO: 19665 - DNA, 20 bp, synthetic construct
  source 1..20: mol_type = other DNA
atcgaggagcggtataagga

SEQ ID NO: 19666 - DNA, 20 bp, synthetic construct
  source 1..20: mol_type = other DNA
ctggttgacaggaagaagga

SEQ ID NO: 19667 - DNA, 20 bp, synthetic construct
  source 1..20: mol_type = other DNA
cggaggctggtgagcgatgg

SEQ ID NO: 19668 - DNA, 20 bp, synthetic construct
  source 1..20: mol_type = other DNA
gctgtggtgaaggagaaact

SEQ ID NO: 19669 - DNA, 20 bp, synthetic construct
  source 1..20: mol_type = other DNA
ttaataaagaaaaatcagac

SEQ ID NO: 19670 - DNA, 20 bp, synthetic construct
  source 1..20: mol_type = other DNA
agacacaggttattccagct

SEQ ID NO: 19671 - DNA, 20 bp, synthetic construct
  source 1..20: mol_type = other DNA
ataggccagagcgtggacga

SEQ ID NO: 19672 - DNA, 20 bp, synthetic construct
  source 1..20: mol_type = other DNA
cccgagccgagcacgaaggt

SEQ ID NO: 19673 - DNA, 20 bp, synthetic construct
  source 1..20: mol_type = other DNA
cttgcacagatgttgcagcc

SEQ ID NO: 19674 - DNA, 20 bp, synthetic construct
  source 1..20: mol_type = other DNA
ttggattaatcttctgattc

SEQ ID NO: 19675 - DNA, 20 bp, synthetic construct
  source 1..20: mol_type = other DNA
aagagaagcaacgtgggggg

SEQ ID NO: 19676 - DNA, 20 bp, synthetic construct
  source 1..20: mol_type = other DNA
aacagcgggctggggcagcc

SEQ ID NO: 19677 - DNA, 20 bp, synthetic construct
  source 1..20: mol_type = other DNA
cagagctacagacctatggg

SEQ ID NO: 19678 - DNA, 20 bp, synthetic construct
  source 1..20: mol_type = other DNA
tttccccaacacctgcggca

SEQ ID NO: 19679 - DNA, 20 bp, synthetic construct
  source 1..20: mol_type = other DNA
cacatcagcacccttgagag

SEQ ID NO: 19680 - DNA, 20 bp, synthetic construct
  source 1..20: mol_type = other DNA
ctagtgctgaagaggatcca

SEQ ID NO: 19681 - DNA, 20 bp, synthetic construct
  source 1..20: mol_type = other DNA
cgggcatcgctgactggccg

SEQ ID NO: 19682 - DNA, 20 bp, synthetic construct
  source 1..20: mol_type = other DNA
cggtgtgagcggaagggcac

SEQ ID NO: 19683 - DNA, 20 bp, synthetic construct
  source 1..20: mol_type = other DNA
aaacagtacgttactagcct

SEQ ID NO: 19684 - DNA, 20 bp, synthetic construct
  source 1..20: mol_type = other DNA
ctgggggaccgaatccggga

SEQ ID NO: 19685 - DNA, 20 bp, synthetic construct
  source 1..20: mol_type = other DNA
ttccaggagcctcacctgca

SEQ ID NO: 19686 - DNA, 20 bp, synthetic construct
  source 1..20: mol_type = other DNA
ccagtgacagcgtttcctca

SEQ ID NO: 19687 - DNA, 20 bp, synthetic construct
  source 1..20: mol_type = other DNA
atctcaatgtcccacatgga

SEQ ID NO: 19688 - DNA, 20 bp, synthetic construct
  source 1..20: mol_type = other DNA
tcaggaggaaaagactaaca

SEQ ID NO: 19689 - DNA, 20 bp, synthetic construct
  source 1..20: mol_type = other DNA
acagagctctctgagggtga

SEQ ID NO: 19690 - DNA, 20 bp, synthetic construct
  source 1..20: mol_type = other DNA
gggccctgcctgctgcatct

SEQ ID NO: 19691 - DNA, 20 bp, synthetic construct
  source 1..20: mol_type = other DNA
gagcttgagcccaagacccg

SEQ ID NO: 19692 - DNA, 20 bp, synthetic construct
  source 1..20: mol_type = other DNA
gccaagcctccgctggtcag

SEQ ID NO: 19693 - DNA, 20 bp, synthetic construct
  source 1..20: mol_type = other DNA
aagatcttcaatgacaacag

SEQ ID NO: 19694 - DNA, 20 bp, synthetic construct
  source 1..20: mol_type = other DNA
caaccacttcctaccccaga

SEQ ID NO: 19695 - DNA, 20 bp, synthetic construct
  source 1..20: mol_type = other DNA
gtcaacgtgttgtcagcctt

SEQ ID NO: 19696 - DNA, 20 bp, synthetic construct
  source 1..20: mol_type = other DNA
acgcacgcacacacacatac

SEQ ID NO: 19697 - DNA, 20 bp, synthetic construct
  source 1..20: mol_type = other DNA
atgcaaaagtacaagggctg

SEQ ID NO: 19698 - DNA, 20 bp, synthetic construct
  source 1..20: mol_type = other DNA
gggctatcccgacccggcgg

SEQ ID NO: 19699 - DNA, 20 bp, synthetic construct
  source 1..20: mol_type = other DNA
cggcgctcggcttcctcctg

SEQ ID NO: 19700 - DNA, 20 bp, synthetic construct
  source 1..20: mol_type = other DNA
aggcagagtcgggggccttg

SEQ ID NO: 19701 - DNA, 20 bp, synthetic construct
  source 1..20: mol_type = other DNA
aggggggatgtcacacgcag

SEQ ID NO: 19702 - DNA, 20 bp, synthetic construct
  source 1..20: mol_type = other DNA
catttctatgtgtaatttct

SEQ ID NO: 19703 - DNA, 20 bp, synthetic construct
  source 1..20: mol_type = other DNA
ctcttctggagtagggggtc

SEQ ID NO: 19704 - DNA, 20 bp, synthetic construct
  source 1..20: mol_type = other DNA
acttgttcctggggaatgcc

SEQ ID NO: 19705 - DNA, 20 bp, synthetic construct
  source 1..20: mol_type = other DNA
gcaagatctggggctgcaga

SEQ ID NO: 19706 - DNA, 20 bp, synthetic construct
  source 1..20: mol_type = other DNA
aaagctaaagcaataacatt

SEQ ID NO: 19707 - DNA, 20 bp, synthetic construct
  source 1..20: mol_type = other DNA
tgacggttgaggacttcaac

SEQ ID NO: 19708 - DNA, 20 bp, synthetic construct
  source 1..20: mol_type = other DNA
gctgtgctgagacagctgtc

SEQ ID NO: 19709 - DNA, 20 bp, synthetic construct
  source 1..20: mol_type = other DNA
cactccaggacttgcagacg

SEQ ID NO: 19710 - DNA, 20 bp, synthetic construct
  source 1..20: mol_type = other DNA
gtctggtgggcagtgtcctc

SEQ ID NO: 19711 - DNA, 20 bp, synthetic construct
  source 1..20: mol_type = other DNA
ccggggacaagaaggagccg

SEQ ID NO: 19712 - DNA, 20 bp, synthetic construct
  source 1..20: mol_type = other DNA
cgtacgggcctagcccggcc

SEQ ID NO: 19713 - DNA, 20 bp, synthetic construct
  source 1..20: mol_type = other DNA
gccagtgcgcatgcgcgagt

SEQ ID NO: 19714 - DNA, 20 bp, synthetic construct
  source 1..20: mol_type = other DNA
cgtgacggtgggggacttcc

SEQ ID NO: 19715 - DNA, 20 bp, synthetic construct
  source 1..20: mol_type = other DNA
gctcagccactgactgcccc

SEQ ID NO: 19716 - DNA, 20 bp, synthetic construct
  source 1..20: mol_type = other DNA
tggtgaccctgggcgtctga

SEQ ID NO: 19717 - DNA, 20 bp, synthetic construct
  source 1..20: mol_type = other DNA
agtgcctgagagacaagtgt

SEQ ID NO: 19718 - DNA, 20 bp, synthetic construct
  source 1..20: mol_type = other DNA
tgccctccacctggcctgct

SEQ ID NO: 19719 - DNA, 20 bp, synthetic construct
  source 1..20: mol_type = other DNA
cgggagctgctggaggagat

SEQ ID NO: 19720 - DNA, 20 bp, synthetic construct
  source 1..20: mol_type = other DNA
acacggggcactgccgagtg

SEQ ID NO: 19721 - DNA, 20 bp, synthetic construct
  source 1..20: mol_type = other DNA
actctgaaccctgaagcatc

SEQ ID NO: 19722 - DNA, 20 bp, synthetic construct
  source 1..20: mol_type = other DNA
accaccactgcctgactgcc

SEQ ID NO: 19723 - DNA, 20 bp, synthetic construct
  source 1..20: mol_type = other DNA
gacacttcagatctgaggtt

SEQ ID NO: 19724 - DNA, 20 bp, synthetic construct
  source 1..20: mol_type = other DNA
tttccttgggccttcaaact

SEQ ID NO: 19725 - DNA, 20 bp, synthetic construct
  source 1..20: mol_type = other DNA
ctgcaggccaggggcctggc

SEQ ID NO: 19726 - DNA, 20 bp, synthetic construct
  source 1..20: mol_type = other DNA
acagtgctttccaggtggat

SEQ ID NO: 19727 - DNA, 20 bp, synthetic construct
  source 1..20: mol_type = other DNA
ggctccctcggccaaaggac

SEQ ID NO: 19728 - DNA, 20 bp, synthetic construct
  source 1..20: mol_type = other DNA
attacaccattattgagaat

SEQ ID NO: 19729 - DNA, 20 bp, synthetic construct
  source 1..20: mol_type = other DNA
gtacgaagatggagaagcac

SEQ ID NO: 19730 - DNA, 20 bp, synthetic construct
  source 1..20: mol_type = other DNA
tgaaggaaccaaatccaatt

SEQ ID NO: 19731 - DNA, 20 bp, synthetic construct
  source 1..20: mol_type = other DNA
aggcttgggggttttcaatg

SEQ ID NO: 19732 - DNA, 20 bp, synthetic construct
  source 1..20: mol_type = other DNA
ctgaaccaagatgtaaaaca

SEQ ID NO: 19733 - DNA, 20 bp, synthetic construct
  source 1..20: mol_type = other DNA
caccaagacagtgctgagat

SEQ ID NO: 19734 - DNA, 20 bp, synthetic construct
  source 1..20: mol_type = other DNA
taaaaaaaaaaaaaaaaaaa

SEQ ID NO: 19735 - DNA, 20 bp, synthetic construct
  source 1..20: mol_type = other DNA
cccactgcccttaaaataag

SEQ ID NO: 19736 - DNA, 20 bp, synthetic construct
  source 1..20: mol_type = other DNA
ttgatgctgaagctgttgtt

SEQ ID NO: 19737 - DNA, 20 bp, synthetic construct
  source 1..20: mol_type = other DNA
tgggtgagtcctatgtgatt

SEQ ID NO: 19738 - DNA, 20 bp, synthetic construct
  source 1..20: mol_type = other DNA
aaaacgagtacccttaaaat

SEQ ID NO: 19739 - DNA, 20 bp, synthetic construct
  source 1..20: mol_type = other DNA
ccgcgcgctgattgctgtgg

SEQ ID NO: 19740 - DNA, 20 bp, synthetic construct
  source 1..20: mol_type = other DNA
tttagccactgcaggtccag

SEQ ID NO: 19741 - DNA, 20 bp, synthetic construct
  source 1..20: mol_type = other DNA
ttctgtggtccagttttcat

SEQ ID NO: 19742 - DNA, 20 bp, synthetic construct
  source 1..20: mol_type = other DNA
aaatccaatttctccaccaa

SEQ ID NO: 19743 - DNA, 20 bp, synthetic construct
  source 1..20: mol_type = other DNA
aaacagcagtgctgcccaca

SEQ ID NO: 19744 - DNA, 20 bp, synthetic construct
  source 1..20: mol_type = other DNA
cacactttacagttttaata

SEQ ID NO: 19745 - DNA, 20 bp, synthetic construct
  source 1..20: mol_type = other DNA
gtgacttgcacgtactcccc

SEQ ID NO: 19746 - DNA, 20 bp, synthetic construct
  source 1..20: mol_type = other DNA
gagcgctgctcagatagcga

SEQ ID NO: 19747 - DNA, 20 bp, synthetic construct
  source 1..20: mol_type = other DNA
tgtaacagttcctgcatggg

SEQ ID NO: 19748 - DNA, 20 bp, synthetic construct
  source 1..20: mol_type = other DNA
gcatttgcacctacctcaca

SEQ ID NO: 19749 - DNA, 20 bp, synthetic construct
  source 1..20: mol_type = other DNA
ttttttcttttttttttttt

SEQ ID NO: 19750 - DNA, 20 bp, synthetic construct
  source 1..20: mol_type = other DNA
cagccaacttttgcatgttt

SEQ ID NO: 19751 - DNA, 20 bp, synthetic construct
  source 1..20: mol_type = other DNA
acctgccctgtgcagctgtg

SEQ ID NO: 19752 - DNA, 20 bp, synthetic construct
  source 1..20: mol_type = other DNA
aaaaagggtcagtctacctc

SEQ ID NO: 19753 - DNA, 20 bp, synthetic construct
  source 1..20: mol_type = other DNA
gtcagaagcacccaggactt

SEQ ID NO: 19754 - DNA, 20 bp, synthetic construct
  source 1..20: mol_type = other DNA
cttggtgaaccttagtacct

SEQ ID NO: 19755 - DNA, 20 bp, synthetic construct
  source 1..20: mol_type = other DNA
ttgcccaggctggagtggag

SEQ ID NO: 19756 - DNA, 20 bp, synthetic construct
  source 1..20: mol_type = other DNA
catcgccttgagctgcccac

SEQ ID NO: 19757 - DNA, 20 bp, synthetic construct
  source 1..20: mol_type = other DNA
gctgcctccgacagcgccgc

SEQ ID NO: 19758 - DNA, 20 bp, synthetic construct
  source 1..20: mol_type = other DNA
ctgcatcacggagcactggg

SEQ ID NO: 19759 - DNA, 20 bp, synthetic construct
  source 1..20: mol_type = other DNA
accctgccaggcgcacgaca

SEQ ID NO: 19760 - DNA, 20 bp, synthetic construct
  source 1..20: mol_type = other DNA
cgagcgggaacacaccgaag

SEQ ID NO: 19761 - DNA, 20 bp, synthetic construct
  source 1..20: mol_type = other DNA
gctgaccgacatcgagcaga

SEQ ID NO: 19762 - DNA, 20 bp, synthetic construct
  source 1..20: mol_type = other DNA
atatgaagacttcccgacct

SEQ ID NO: 19763 - DNA, 20 bp, synthetic construct
  source 1..20: mol_type = other DNA
gcccagccgcggcttctact

SEQ ID NO: 19764 - DNA, 20 bp, synthetic construct
  source 1..20: mol_type = other DNA
agatagaagacctggactcc

SEQ ID NO: 19765 - DNA, 20 bp, synthetic construct
  source 1..20: mol_type = other DNA
ccccagtagctctgaacaag

SEQ ID NO: 19766 - DNA, 20 bp, synthetic construct
  source 1..20: mol_type = other DNA
gcaggaagccactatgccag

SEQ ID NO: 19767 - DNA, 20 bp, synthetic construct
  source 1..20: mol_type = other DNA
agccagaagattttatctag

SEQ ID NO: 19768 - DNA, 20 bp, synthetic construct
  source 1..20: mol_type = other DNA
ttgcgcttagtgtcctacat

SEQ ID NO: 19769 - DNA, 20 bp, synthetic construct
  source 1..20: mol_type = other DNA
tagtactgtgcctctttctt

SEQ ID NO: 19770 - DNA, 20 bp, synthetic construct
  source 1..20: mol_type = other DNA
gaagtaaatccttgttcact

SEQ ID NO: 19771 - DNA, 20 bp, synthetic construct
  source 1..20: mol_type = other DNA
ggggcgtgatttgactgcat

SEQ ID NO: 19772 - DNA, 20 bp, synthetic construct
  source 1..20: mol_type = other DNA
cggagcgtcaggtcccgttt

SEQ ID NO: 19773 - DNA, 20 bp, synthetic construct
  source 1..20: mol_type = other DNA
cccggcaatgttccctcgaa

SEQ ID NO: 19774 - DNA, 20 bp, synthetic construct
  source 1..20: mol_type = other DNA
acaaagcctgaacctccttt

SEQ ID NO: 19775 - DNA, 20 bp, synthetic construct
  source 1..20: mol_type = other DNA
cccagtatctagaaaactct

SEQ ID NO: 19776 - DNA, 20 bp, synthetic construct
  source 1..20: mol_type = other DNA
gctaccatattctcaggcgg

SEQ ID NO: 19777 - DNA, 20 bp, synthetic construct
  source 1..20: mol_type = other DNA
tcttcaaacagcaatgtcct

SEQ ID NO: 19778 - DNA, 20 bp, synthetic construct
  source 1..20: mol_type = other DNA
tttcccgttgaaggtgctac

SEQ ID NO: 19779 - DNA, 20 bp, synthetic construct
  source 1..20: mol_type = other DNA
caaagaactaatagagaaaa

SEQ ID NO: 19780 - DNA, 20 bp, synthetic construct
  source 1..20: mol_type = other DNA
ctcaggaccaaccgcatagc

SEQ ID NO: 19781 - DNA, 20 bp, synthetic construct
  source 1..20: mol_type = other DNA
ggcagtggaatgattggaaa

SEQ ID NO: 19782 - DNA, 20 bp, synthetic construct
  source 1..20: mol_type = other DNA
gaaagagatgatctcttaca

SEQ ID NO: 19783 - DNA, 20 bp, synthetic construct
  source 1..20: mol_type = other DNA
tctaaggcttgtcttaagtc

SEQ ID NO: 19784 - DNA, 20 bp, synthetic construct
  source 1..20: mol_type = other DNA
atgatggatggctcactgcc

SEQ ID NO: 19785 - DNA, 20 bp, synthetic construct
  source 1..20: mol_type = other DNA
atggtcactctgtggtcatc

SEQ ID NO: 19786 - DNA, 20 bp, synthetic construct
  source 1..20: mol_type = other DNA
ggacaccaggccgactcaga

SEQ ID NO: 19787 - DNA, 20 bp, synthetic construct
  source 1..20: mol_type = other DNA
atgaagaacagaccaatgtg

SEQ ID NO: 19788 - DNA, 20 bp, synthetic construct
  source 1..20: mol_type = other DNA
tgggctttcacgtactgggt

SEQ ID NO: 19789 - DNA, 20 bp, synthetic construct
  source 1..20: mol_type = other DNA
aggctggctgctgaggttaa

SEQ ID NO: 19790 - DNA, 20 bp, synthetic construct
  source 1..20: mol_type = other DNA
ttggaggctatgtaggcttg

SEQ ID NO: 19791 - DNA, 20 bp, synthetic construct
  source 1..20: mol_type = other DNA
ttaaggtctgtttaggaagg

SEQ ID NO: 19792 - DNA, 20 bp, synthetic construct
  source 1..20: mol_type = other DNA
tctcagttgcagcactgagt

SEQ ID NO: 19793 - DNA, 20 bp, synthetic construct
  source 1..20: mol_type = other DNA
taggttgccagggctgcacg

SEQ ID NO: 19794 - DNA, 20 bp, synthetic construct
  source 1..20: mol_type = other DNA
ctgaaggagggcctgatgtc

SEQ ID NO: 19795 - DNA, 20 bp, synthetic construct
  source 1..20: mol_type = other DNA
gaccaggacatggccaacaa

SEQ ID NO: 19796 - DNA, 20 bp, synthetic construct
  source 1..20: mol_type = other DNA
catagttacttttggccatt

SEQ ID NO: 19797 - DNA, 20 bp, synthetic construct
  source 1..20: mol_type = other DNA
accaaaaagcagctggacag

SEQ ID NO: 19798 - DNA, 20 bp, synthetic construct
  source 1..20: mol_type = other DNA
ccaaatccaaggcgaagttt

SEQ ID NO: 19799 - DNA, 20 bp, synthetic construct
  source 1..20: mol_type = other DNA
caccattatttgtcatggag

SEQ ID NO: 19800 - DNA, 20 bp, synthetic construct
  source 1..20: mol_type = other DNA
taggcagcagagcccctgac

SEQ ID NO: 19801 - DNA, 20 bp, synthetic construct
  source 1..20: mol_type = other DNA
tgaaattagaacagtaggcg

SEQ ID NO: 19802 - DNA, 20 bp, synthetic construct
  source 1..20: mol_type = other DNA
gaagtaccttatgagccata

SEQ ID NO: 19803 - DNA, 20 bp, synthetic construct
  source 1..20: mol_type = other DNA
aatgtctatgcagatggtag

SEQ ID NO: 19804 - DNA, 20 bp, synthetic construct
  source 1..20: mol_type = other DNA
cactcatgccaagtttcaga

SEQ ID NO: 19805 - DNA, 20 bp, synthetic construct
  source 1..20: mol_type = other DNA
gtaccaggagaacaaacggg

SEQ ID NO: 19806 - DNA, 20 bp, synthetic construct
  source 1..20: mol_type = other DNA
agtgaataaactcaattgtc

SEQ ID NO: 19807 - DNA, 20 bp, synthetic construct
  source 1..20: mol_type = other DNA
tggcagattatgaagcacgg

SEQ ID NO: 19808 - DNA, 20 bp, synthetic construct
  source 1..20: mol_type = other DNA
atgctaaatggtatccaggg

SEQ ID NO: 19809 - DNA, 20 bp, synthetic construct
  source 1..20: mol_type = other DNA
aagctatacgaatggggttc

SEQ ID NO: 19810 - DNA, 20 bp, synthetic construct
  source 1..20: mol_type = other DNA
tttttatgtcttaatctaac

SEQ ID NO: 19811 - DNA, 20 bp, synthetic construct
  source 1..20: mol_type = other DNA
cttttcagataggcttaaca

SEQ ID NO: 19812 - DNA, 20 bp, synthetic construct
  source 1..20: mol_type = other DNA
tttcttttaaagttataaac

SEQ ID NO: 19813 - DNA, 20 bp, synthetic construct
  source 1..20: mol_type = other DNA
gaattttttataagtatgta

SEQ ID NO: 19814 - DNA, 20 bp, synthetic construct
  source 1..20: mol_type = other DNA
gaatagttgtttaaatattt

SEQ ID NO: 19815 - DNA, 20 bp, synthetic construct
  source 1..20: mol_type = other DNA
ctcaaggactgaattgtttt

SEQ ID NO: 19816 - DNA, 20 bp, synthetic construct
  source 1..20: mol_type = other DNA
tgtttctcatagataagata

SEQ ID NO: 19817 - DNA, 20 bp, synthetic construct
  source 1..20: mol_type = other DNA
gctcatgcctgtaatcccag

SEQ ID NO: 19818 - DNA, 20 bp, synthetic construct
  source 1..20: mol_type = other DNA
tattgtattaggtattaaag

SEQ ID NO: 19819 - DNA, 20 bp, synthetic construct
  source 1..20: mol_type = other DNA
cacatgcagactatcttttg

SEQ ID NO: 19820 - DNA, 20 bp, synthetic construct
  source 1..20: mol_type = other DNA
caaattcaacaaatcttcca

SEQ ID NO: 19821 - DNA, 20 bp, synthetic construct
  source 1..20: mol_type = other DNA
agtcaagtcagacttcatta

SEQ ID NO: 19822 - DNA, 20 bp, synthetic construct
  source 1..20: mol_type = other DNA
gattctcatatcatcttgta

SEQ ID NO: 19823 - DNA, 20 bp, synthetic construct
  source 1..20: mol_type = other DNA
ttggaaattataaaaatatt

SEQ ID NO: 19824 - DNA, 20 bp, synthetic construct
  source 1..20: mol_type = other DNA
gtttcaccatgttggccagg

SEQ ID NO: 19825 - DNA, 20 bp, synthetic construct
  source 1..20: mol_type = other DNA
ttgatcatttgcaaagtcaa

SEQ ID NO: 19826 - DNA, 20 bp, synthetic construct
  source 1..20: mol_type = other DNA
agggtagagtgggtgtagtg

SEQ ID NO: 19827 - DNA, 20 bp, synthetic construct
  source 1..20: mol_type = other DNA
gtttcacatgatataccctt

SEQ ID NO: 19828 - DNA, 20 bp, synthetic construct
  source 1..20: mol_type = other DNA
ttcatctgtgaaaggaaaat

SEQ ID NO: 19829 - DNA, 20 bp, synthetic construct
  source 1..20: mol_type = other DNA
ctactaaaaatacaaaatta

SEQ ID NO: 19830 - DNA, 20 bp, synthetic construct
  source 1..20: mol_type = other DNA
cagagtgagaccccatctct

SEQ ID NO: 19831 - DNA, 20 bp, synthetic construct
  source 1..20: mol_type = other DNA
gaatttcttcctcagcataa

SEQ ID NO: 19832 - DNA, 20 bp, synthetic construct
  source 1..20: mol_type = other DNA
tgaaaaacttcaccaagcta

SEQ ID NO: 19833 - DNA, 20 bp, synthetic construct
  source 1..20: mol_type = other DNA
aaaaaaagcaattattttta

SEQ ID NO: 19834 - DNA, 20 bp, synthetic construct
  source 1..20: mol_type = other DNA
ggagcctgaggtgggaggat

SEQ ID NO: 19835 - DNA, 20 bp, synthetic construct
  source 1..20: mol_type = other DNA
aatttctgacctcaagtgat

SEQ ID NO: 19836 - DNA, 20 bp, synthetic construct
  source 1..20: mol_type = other DNA
acatatggaggctcctgtca

SEQ ID NO: 19837 - DNA, 20 bp, synthetic construct
  source 1..20: mol_type = other DNA
caaaaccacatctaagagaa

SEQ ID NO: 19838 - DNA, 20 bp, synthetic construct
  source 1..20: mol_type = other DNA
ctgttaaaccaaaatatttt

SEQ ID NO: 19839 - DNA, 20 bp, synthetic construct
  source 1..20: mol_type = other DNA
gtgccagacactgttctgga

SEQ ID NO: 19840 - DNA, 20 bp, synthetic construct
  source 1..20: mol_type = other DNA
ctgaatgaaatggacatttt

SEQ ID NO: 19841 - DNA, 20 bp, synthetic construct
  source 1..20: mol_type = other DNA
tgccattttcctcaccagta

SEQ ID NO: 19842 - DNA, 20 bp, synthetic construct
  source 1..20: mol_type = other DNA
gttcccaatgtccttctagt

SEQ ID NO: 19843 - DNA, 20 bp, synthetic construct
  source 1..20: mol_type = other DNA
atgacagagtgagacttcat

SEQ ID NO: 19844 - DNA, 20 bp, synthetic construct
  source 1..20: mol_type = other DNA
ttacggcagcatacgacctg

SEQ ID NO: 19845 - DNA, 20 bp, synthetic construct
  source 1..20: mol_type = other DNA
tcattggaatggtaagagtt

SEQ ID NO: 19846 - DNA, 20 bp, synthetic construct
  source 1..20: mol_type = other DNA
aacggccagaatgaattcta

SEQ ID NO: 19847 - DNA, 20 bp, synthetic construct
  source 1..20: mol_type = other DNA
gagccgccagagcgatcccc

SEQ ID NO: 19848 - DNA, 20 bp, synthetic construct
  source 1..20: mol_type = other DNA
cgctcagccctacatccagc

SEQ ID NO: 19849 - DNA, 20 bp, synthetic construct
  source 1..20: mol_type = other DNA
catgaaccccgcgagcatgg

SEQ ID NO: 19850 - DNA, 20 bp, synthetic construct
  source 1..20: mol_type = other DNA
aaagaggccataccctggag

SEQ ID NO: 19851 - DNA, 20 bp, synthetic construct
  source 1..20: mol_type = other DNA
ccccacggtcaacatggggc

SEQ ID NO: 19852 - DNA, 20 bp, synthetic construct
  source 1..20: mol_type = other DNA
catgacccctgggagcagca

SEQ ID NO: 19853 - DNA, 20 bp, synthetic construct
  source 1..20: mol_type = other DNA
ccgcctggagcacaacctgg

SEQ ID NO: 19854 - DNA, 20 bp, synthetic construct
  source 1..20: mol_type = other DNA
actcctcaagaagcgcctcc

SEQ ID NO: 19855 - DNA, 20 bp, synthetic construct
  source 1..20: mol_type = other DNA
cgagctcctgtcttatctgg

SEQ ID NO: 19856 - DNA, 20 bp, synthetic construct
  source 1..20: mol_type = other DNA
taagccaagataccccataa

SEQ ID NO: 19857 - DNA, 20 bp, synthetic construct
  source 1..20: mol_type = other DNA
tggggaacagagagagcagg

SEQ ID NO: 19858 - DNA, 20 bp, synthetic construct
  source 1..20: mol_type = other DNA
agaaaccagagcccagggca

SEQ ID NO: 19859 - DNA, 20 bp, synthetic construct
  source 1..20: mol_type = other DNA
agcctaccctgcctgcactc

SEQ ID NO: 19860 - DNA, 20 bp, synthetic construct
  source 1..20: mol_type = other DNA
ccgtgagccacatggcctag

SEQ ID NO: 19861 - DNA, 20 bp, synthetic construct
  source 1..20: mol_type = other DNA
tgacttccagtcactgtccc

SEQ ID NO: 19862 - DNA, 20 bp, synthetic construct
  source 1..20: mol_type = other DNA
agatgccttccttaggagtt

SEQ ID NO: 19863 - DNA, 20 bp, synthetic construct
  source 1..20: mol_type = other DNA
gcaaccatctctgggctcag

SEQ ID NO: 19864 - DNA, 20 bp, synthetic construct
  source 1..20: mol_type = other DNA
tgcaagccacttttccatgc

SEQ ID NO: 19865 - DNA, 20 bp, synthetic construct
  source 1..20: mol_type = other DNA
tattttttaagaaactgcta

SEQ ID NO: 19866 - DNA, 20 bp, synthetic construct
  source 1..20: mol_type = other DNA
actgttatctttttgatgga

SEQ ID NO: 19867 - DNA, 20 bp, synthetic construct
  source 1..20: mol_type = other DNA
ctgtgccaggagctgttctt

SEQ ID NO: 19868 - DNA, 20 bp, synthetic construct
  source 1..20: mol_type = other DNA
ctaaagagcttagtttgccc

SEQ ID NO: 19869 - DNA, 20 bp, synthetic construct
  source 1..20: mol_type = other DNA
cgctccgccaatacaataga

SEQ ID NO: 19870 - DNA, 20 bp, synthetic construct
  source 1..20: mol_type = other DNA
gcttaggtatctgtgctgtg

SEQ ID NO: 19871 - DNA, 20 bp, synthetic construct
  source 1..20: mol_type = other DNA
aggcttggaaccagcacagc

SEQ ID NO: 19872 - DNA, 20 bp, synthetic construct
  source 1..20: mol_type = other DNA
ccaagtgctgttcaactcag

SEQ ID NO: 19873 - DNA, 20 bp, synthetic construct
  source 1..20: mol_type = other DNA
ggttgtgtagatgtggccgg

SEQ ID NO: 19874 - DNA, 20 bp, synthetic construct
  source 1..20: mol_type = other DNA
gcctttccagaccggagacg

SEQ ID NO: 19875 - DNA, 20 bp, synthetic construct
  source 1..20: mol_type = other DNA
cagccaaaacctgctaagtc

SEQ ID NO: 19876 - DNA, 20 bp, synthetic construct
  source 1..20: mol_type = other DNA
gtttcaagtgatcctcccgc

SEQ ID NO: 19877 - DNA, 20 bp, synthetic construct
  source 1..20: mol_type = other DNA
tgcccctccctccgggtgga

SEQ ID NO: 19878 - DNA, 20 bp, synthetic construct
  source 1..20: mol_type = other DNA
cggcgaggtgaaggccgacc

SEQ ID NO: 19879 - DNA, 20 bp, synthetic construct
  source 1..20: mol_type = other DNA
tcttagatctcgttttgagg

SEQ ID NO: 19880 - DNA, 20 bp, synthetic construct
  source 1..20: mol_type = other DNA
atcccccacagaagccccct

SEQ ID NO: 19881 - DNA, 20 bp, synthetic construct
  source 1..20: mol_type = other DNA
ccctgaggccggcccgcgtc

SEQ ID NO: 19882 - DNA, 20 bp, synthetic construct
  source 1..20: mol_type = other DNA
ctgacgggtgacgccagcgg

SEQ ID NO: 19883 - DNA, 20 bp, synthetic construct
  source 1..20: mol_type = other DNA
accttagacaaggaaagttt

SEQ ID NO: 19884 - DNA, 20 bp, synthetic construct
  source 1..20: mol_type = other DNA
ctggcagagcctgtagttgg

SEQ ID NO: 19885 - DNA, 20 bp, synthetic construct
  source 1..20: mol_type = other DNA
agttgtctctgatcacttgt

SEQ ID NO: 19886 - DNA, 20 bp, synthetic construct
  source 1..20: mol_type = other DNA
ccaaaaataatccggagaca

SEQ ID NO: 19887 - DNA, 20 bp, synthetic construct
  source 1..20: mol_type = other DNA
ccatttgaccagaacgtgtg

SEQ ID NO: 19888 - DNA, 20 bp, synthetic construct
  source 1..20: mol_type = other DNA
tcgacccagcttgaggtctc

SEQ ID NO: 19889 - DNA, 20 bp, synthetic construct
  source 1..20: mol_type = other DNA
gcgcgcggggcgcccccgcg

SEQ ID NO: 19890 - DNA, 20 bp, synthetic construct
  source 1..20: mol_type = other DNA
agctccggccccgccgttcc

SEQ ID NO: 19891 - DNA, 20 bp, synthetic construct
  source 1..20: mol_type = other DNA
ggctctgacgcggcgcccca

SEQ ID NO: 19892 - DNA, 20 bp, synthetic construct
  source 1..20: mol_type = other DNA
tctccagcttgcatggcctg

SEQ ID NO: 19893 - DNA, 20 bp, synthetic construct
  source 1..20: mol_type = other DNA
aggaaggaacgctcgagatt

SEQ ID NO: 19894 - DNA, 20 bp, synthetic construct
  source 1..20: mol_type = other DNA
cagagatcccggtcctccgg

SEQ ID NO: 19895 - DNA, 20 bp, synthetic construct
  source 1..20: mol_type = other DNA
gcgaaggtgtcgctgccaag

SEQ ID NO: 19896 - DNA, 20 bp, synthetic construct
  source 1..20: mol_type = other DNA
cgggcactgccccaggtctt

SEQ ID NO: 19897 - DNA, 20 bp, synthetic construct
  source 1..20: mol_type = other DNA
agattttggagcggagcgtt

SEQ ID NO: 19898 - DNA, 20 bp, synthetic construct
  source 1..20: mol_type = other DNA
tgctcgcgttcgcaagctcc

SEQ ID NO: 19899 - DNA, 20 bp, synthetic construct
  source 1..20: mol_type = other DNA
ccggggctgaggctggggct

SEQ ID NO: 19900 - DNA, 20 bp, synthetic construct
  source 1..20: mol_type = other DNA
cccgagcatgagcagagatc

SEQ ID NO: 19901 - DNA, 20 bp, synthetic construct
  source 1..20: mol_type = other DNA
cccggcttcagcggcaccgc

SEQ ID NO: 19902 - DNA, 20 bp, synthetic construct
  source 1..20: mol_type = other DNA
tggcaaagacacgctggctg

SEQ ID NO: 19903 - DNA, 20 bp, synthetic construct
  source 1..20: mol_type = other DNA
aaagaatggagaattattga

SEQ ID NO: 19904 - DNA, 20 bp, synthetic construct
  source 1..20: mol_type = other DNA
gctgacaccgacccaacgtc

SEQ ID NO: 19905 - DNA, 20 bp, synthetic construct
  source 1..20: mol_type = other DNA
aagtgtaattctggaccaat

SEQ ID NO: 19906 - DNA, 20 bp, synthetic construct
  source 1..20: mol_type = other DNA
agccgtagtcttggcccacg

SEQ ID NO: 19907 - DNA, 20 bp, synthetic construct
  source 1..20: mol_type = other DNA
gtagctcggcagccctgcca

SEQ ID NO: 19908 - DNA, 20 bp, synthetic construct
  source 1..20: mol_type = other DNA
aaccctacagcttggggcct

SEQ ID NO: 19909 - DNA, 20 bp, synthetic construct
  source 1..20: mol_type = other DNA
caggcgactgaagacgatgg

SEQ ID NO: 19910 - DNA, 20 bp, synthetic construct
  source 1..20: mol_type = other DNA
ggggctgtttttcaactcct

SEQ ID NO: 19911 - DNA, 20 bp, synthetic construct
  source 1..20: mol_type = other DNA
gtggacacaattctcacctg

SEQ ID NO: 19912 - DNA, 20 bp, synthetic construct
  source 1..20: mol_type = other DNA
ggagctctggaggctgggct

SEQ ID NO: 19913 - DNA, 20 bp, synthetic construct
  source 1..20: mol_type = other DNA
acaatgaaagtcgctgaaga

SEQ ID NO: 19914 - DNA, 20 bp, synthetic construct
  source 1..20: mol_type = other DNA
ggcaccaagagagtggacgc

SEQ ID NO: 19915 - DNA, 20 bp, synthetic construct
  source 1..20: mol_type = other DNA
tccaaggaggtggctgtgca

SEQ ID NO: 19916 - DNA, 20 bp, synthetic construct
  source 1..20: mol_type = other DNA
ggtggagccgcctcggcgtt

SEQ ID NO: 19917 - DNA, 20 bp, synthetic construct
  source 1..20: mol_type = other DNA
caaagatcaactcccactga

SEQ ID NO: 19918 - DNA, 20 bp, synthetic construct
  source 1..20: mol_type = other DNA
gcagaaagggacggagaaca

SEQ ID NO: 19919 - DNA, 20 bp, synthetic construct
  source 1..20: mol_type = other DNA
ctggtaaatccacaggaatt

SEQ ID NO: 19920 - DNA, 20 bp, synthetic construct
  source 1..20: mol_type = other DNA
tgtactttgacgacaagaaa

SEQ ID NO: 19921 - DNA, 20 bp, synthetic construct
  source 1..20: mol_type = other DNA
gcttcagtggccaaagatct

SEQ ID NO: 19922 - DNA, 20 bp, synthetic construct
  source 1..20: mol_type = other DNA
agagtgatggctgttttagt

SEQ ID NO: 19923 - DNA, 20 bp, synthetic construct
  source 1..20: mol_type = other DNA
aaaccccgagtgctataccg

SEQ ID NO: 19924 - DNA, 20 bp, synthetic construct
  source 1..20: mol_type = other DNA
gactgacccaccatgacacc

SEQ ID NO: 19925 - DNA, 20 bp, synthetic construct
  source 1..20: mol_type = other DNA
cataaactgtcagaggcagc

SEQ ID NO: 19926 - DNA, 20 bp, synthetic construct
  source 1..20: mol_type = other DNA
ccgctcccaaactgtacctg

SEQ ID NO: 19927 - DNA, 20 bp, synthetic construct
  source 1..20: mol_type = other DNA
ggtacggggagctcgcaaat

SEQ ID NO: 19928 - DNA, 20 bp, synthetic construct
  source 1..20: mol_type = other DNA
gtatcagttctccgtcaact

SEQ ID NO: 19929 - DNA, 20 bp, synthetic construct
  source 1..20: mol_type = other DNA
agcccttgtctcgggaccgc

SEQ ID NO: 19930 - DNA, 20 bp, synthetic construct
  source 1..20: mol_type = other DNA
aagggaggaaggagtcccag

SEQ ID NO: 19931 - DNA, 20 bp, synthetic construct
  source 1..20: mol_type = other DNA
gtgtattcctgggacgatgc

SEQ ID NO: 19932 - DNA, 20 bp, synthetic construct
  source 1..20: mol_type = other DNA
cgggcgcaccgcggccccca

SEQ ID NO: 19933 - DNA, 20 bp, synthetic construct
  source 1..20: mol_type = other DNA
acagcaacttttctaagacc

SEQ ID NO: 19934 - DNA, 20 bp, synthetic construct
  source 1..20: mol_type = other DNA
tccaagatgtccacgccctg

SEQ ID NO: 19935 - DNA, 20 bp, synthetic construct
  source 1..20: mol_type = other DNA
gcgagccggagaccgagccc

SEQ ID NO: 19936 - DNA, 20 bp, synthetic construct
  source 1..20: mol_type = other DNA
acctgatttgtgaacctatc

SEQ ID NO: 19937 - DNA, 20 bp, synthetic construct
  source 1..20: mol_type = other DNA
agtttcgatgctgccggcgc

SEQ ID NO: 19938 - DNA, 20 bp, synthetic construct
  source 1..20: mol_type = other DNA
acccttaccggcacccggcc

SEQ ID NO: 19939 - DNA, 20 bp, synthetic construct
  source 1..20: mol_type = other DNA
cgcttccattgtcagaatgg

SEQ ID NO: 19940 - DNA, 20 bp, synthetic construct
  source 1..20: mol_type = other DNA
actggtgctgactgcaacca

SEQ ID NO: 19941 - DNA, 20 bp, synthetic construct
  source 1..20: mol_type = other DNA
gggctgtttggaaagaccca

SEQ ID NO: 19942 - DNA, 20 bp, synthetic construct
  source 1..20: mol_type = other DNA
attgccagtacctgcctcca

SEQ ID NO: 19943 - DNA, 20 bp, synthetic construct
  source 1..20: mol_type = other DNA
gtcggagcccgggcgggcga

SEQ ID NO: 19944 - DNA, 20 bp, synthetic construct
  source 1..20: mol_type = other DNA
tcggattgctcaaggaccca

SEQ ID NO: 19945 - DNA, 20 bp, synthetic construct
  source 1..20: mol_type = other DNA
agaccacccagcccagccaa

SEQ ID NO: 19946 - DNA, 20 bp, synthetic construct
  source 1..20: mol_type = other DNA
cggggccctggaagctccta

SEQ ID NO: 19947 - DNA, 20 bp, synthetic construct
  source 1..20: mol_type = other DNA
aagatcctgatcctcctgct

SEQ ID NO: 19948 - DNA, 20 bp, synthetic construct
  source 1..20: mol_type = other DNA
ccccttcatgggactcccaa

SEQ ID NO: 19949 - DNA, 20 bp, synthetic construct
  source 1..20: mol_type = other DNA
ggttgctgacaccctgtgcc

SEQ ID NO: 19950 - DNA, 20 bp, synthetic construct
  source 1..20: mol_type = other DNA
tctagccggaacctgggggc

SEQ ID NO: 19951 - DNA, 20 bp, synthetic construct
  source 1..20: mol_type = other DNA
cggggcgaccctgcagtggc

SEQ ID NO: 19952 - DNA, 20 bp, synthetic construct
  source 1..20: mol_type = other DNA
tcctgctcccccccacaccg

SEQ ID NO: 19953 - DNA, 20 bp, synthetic construct
  source 1..20: mol_type = other DNA
ttcgcctagcgcgtgctcag

SEQ ID NO: 19954 - DNA, 20 bp, synthetic construct
  source 1..20: mol_type = other DNA
gagcctggggaaactattat

SEQ ID NO: 19955 - DNA, 20 bp, synthetic construct
  source 1..20: mol_type = other DNA
accgatcccagggctgtggt

SEQ ID NO: 19956 - DNA, 20 bp, synthetic construct
  source 1..20: mol_type = other DNA
aacgtagagaaatcctttca

SEQ ID NO: 19957 - DNA, 20 bp, synthetic construct
  source 1..20: mol_type = other DNA
gtggggccgctgccggctcc

SEQ ID NO: 19958 - DNA, 20 bp, synthetic construct
  source 1..20: mol_type = other DNA
actgcctctgcctccaagct

SEQ ID NO: 19959 - DNA, 20 bp, synthetic construct
  source 1..20: mol_type = other DNA
tggtggccctcctggtggcc

SEQ ID NO: 19960 - DNA, 20 bp, synthetic construct
  source 1..20: mol_type = other DNA
cccgggagatcggggctggg

SEQ ID NO: 19961 - DNA, 20 bp, synthetic construct
  source 1..20: mol_type = other DNA
agaaaagcaggtggaaggag

SEQ ID NO: 19962 - DNA, 20 bp, synthetic construct
  source 1..20: mol_type = other DNA
aggaagcggatgccgtgggg

SEQ ID NO: 19963 - DNA, 20 bp, synthetic construct
  source 1..20: mol_type = other DNA
gtggacagctcacctagcgg

SEQ ID NO: 19964 - DNA, 20 bp, synthetic construct
  source 1..20: mol_type = other DNA
gcacgcaccgcgccaggcca

SEQ ID NO: 19965 - DNA, 20 bp, synthetic construct
  source 1..20: mol_type = other DNA
atccattccccctcagatct

SEQ ID NO: 19966 - DNA, 20 bp, synthetic construct
  source 1..20: mol_type = other DNA
gggcttggcgcggcggccag

SEQ ID NO: 19967 - DNA, 20 bp, synthetic construct
  source 1..20: mol_type = other DNA
tcccctccgggttttcacac

SEQ ID NO: 19968 - DNA, 20 bp, synthetic construct
  source 1..20: mol_type = other DNA
gagagcgtctaccccgaact

SEQ ID NO: 19969 - DNA, 20 bp, synthetic construct
  source 1..20: mol_type = other DNA
ccgccgccgccgccgcctcc

SEQ ID NO: 19970 - DNA, 20 bp, synthetic construct
  source 1..20: mol_type = other DNA
tcccgtctctccgtctcgac

SEQ ID NO: 19971 - DNA, 20 bp, synthetic construct
  source 1..20: mol_type = other DNA
ggcgccgcccgcctgctgcc

SEQ ID NO: 19972 - DNA, 20 bp, synthetic construct
  source 1..20: mol_type = other DNA
ggcagggaagctgagggccc

SEQ ID NO: 19973 - DNA, 20 bp, synthetic construct
  source 1..20: mol_type = other DNA
ctgggtgagtagccgggaac

SEQ ID NO: 19974 - DNA, 20 bp, synthetic construct
  source 1..20: mol_type = other DNA
agggccccaacccagaacga

SEQ ID NO: 19975 - DNA, 20 bp, synthetic construct
  source 1..20: mol_type = other DNA
attggaaatatgctacagat

SEQ ID NO: 19976 - DNA, 20 bp, synthetic construct
  source 1..20: mol_type = other DNA
gttttcaaaggagcattctt

SEQ ID NO: 19977 - DNA, 20 bp, synthetic construct
  source 1..20: mol_type = other DNA
ttcacctgtggattcgtcag

SEQ ID NO: 19978 - DNA, 20 bp, synthetic construct
  source 1..20: mol_type = other DNA
gattttggaagaaacgaatt

SEQ ID NO: 19979 - DNA, 20 bp, synthetic construct
  source 1..20: mol_type = other DNA
cacagagaatgctctgcacc

SEQ ID NO: 19980 - DNA, 20 bp, synthetic construct
  source 1..20: mol_type = other DNA
cgaagaaggtgagcgcagtg

SEQ ID NO: 19981 - DNA, 20 bp, synthetic construct
  source 1..20: mol_type = other DNA
gaggcgcagggaacctggag

SEQ ID NO: 19982 - DNA, 20 bp, synthetic construct
  source 1..20: mol_type = other DNA
catctcagtcctgacatcgc

SEQ ID NO: 19983 - DNA, 20 bp, synthetic construct
  source 1..20: mol_type = other DNA
acagagatcaatgcattttc

SEQ ID NO: 19984 - DNA, 20 bp, synthetic construct
  source 1..20: mol_type = other DNA
aggcactgcgggttttgcag

SEQ ID NO: 19985 - DNA, 20 bp, synthetic construct
  source 1..20: mol_type = other DNA
ccacatgcttccattgcttg

SEQ ID NO: 19986 - DNA, 20 bp, synthetic construct
  source 1..20: mol_type = other DNA
ctcccaggccgatacagtgc

SEQ ID NO: 19987 - DNA, 20 bp, synthetic construct
  source 1..20: mol_type = other DNA
ggttctccagcttcttgtcc

SEQ ID NO: 19988 - DNA, 20 bp, synthetic construct
  source 1..20: mol_type = other DNA
gtcgcgaggacttctaccgc

SEQ ID NO: 19989 - DNA, 20 bp, synthetic construct
  source 1..20: mol_type = other DNA
cacgtcgggagggtccgggc

SEQ ID NO: 19990 - DNA, 20 bp, synthetic construct
  source 1..20: mol_type = other DNA
gggtccccgagggcgctgcg

SEQ ID NO: 19991 - DNA, 20 bp, synthetic construct
  source 1..20: mol_type = other DNA
attccaagataaataggatt

SEQ ID NO: 19992 - DNA, 20 bp, synthetic construct
  source 1..20: mol_type = other DNA
caggctgccacacacgcact

SEQ ID NO: 19993 - DNA, 20 bp, synthetic construct
  source 1..20: mol_type = other DNA
gagccagagattcgagccgg

SEQ ID NO: 19994 - DNA, 20 bp, synthetic construct
  source 1..20: mol_type = other DNA
tacacgtggatgtgaaatga

SEQ ID NO: 19995 - DNA, 20 bp, synthetic construct
  source 1..20: mol_type = other DNA
aggagctccaggcccgtcgg

SEQ ID NO: 19996 - DNA, 20 bp, synthetic construct
  source 1..20: mol_type = other DNA
caccccctattttactgcag

SEQ ID NO: 19997 - DNA, 20 bp, synthetic construct
  source 1..20: mol_type = other DNA
gccccaactgctcttcccgc

SEQ ID NO: 19998 - DNA, 20 bp, synthetic construct
  source 1..20: mol_type = other DNA
gcccctcccacgagcccaag

SEQ ID NO: 19999 - DNA, 20 bp, synthetic construct
  source 1..20: mol_type = other DNA
agccagcagcagccggcggg

SEQ ID NO: 20000 - DNA, 20 bp, synthetic construct
  source 1..20: mol_type = other DNA
ggcagaagtacaagcgcagg

SEQ ID NO: 20001 - DNA, 20 bp, synthetic construct
  source 1..20: mol_type = other DNA
agtgaacaaaactttaatgt

SEQ ID NO: 20002 - DNA, 20 bp, synthetic construct
  source 1..20: mol_type = other DNA
taacctgctgcagttctgac

SEQ ID NO: 20003 - DNA, 20 bp, synthetic construct
  source 1..20: mol_type = other DNA
ccggtggcttcctcacctcc

SEQ ID NO: 20004 - DNA, 20 bp, synthetic construct
  source 1..20: mol_type = other DNA
atgagctgctccagtacatc

SEQ ID NO: 20005 - DNA, 20 bp, synthetic construct
  source 1..20: mol_type = other DNA
ttcttccggggttggtggcg

SEQ ID NO: 20006 - DNA, 20 bp, synthetic construct
  source 1..20: mol_type = other DNA
gacttcccttcccaaggact

SEQ ID NO: 20007 - DNA, 20 bp, synthetic construct
  source 1..20: mol_type = other DNA
gaactggggcctgggggatg

SEQ ID NO: 20008 - DNA, 20 bp, synthetic construct
  source 1..20: mol_type = other DNA
ggacgagcttgggcttagcg

SEQ ID NO: 20009 - DNA, 20 bp, synthetic construct
  source 1..20: mol_type = other DNA
aaagatggacaaacagagat

SEQ ID NO: 20010 - DNA, 20 bp, synthetic construct
  source 1..20: mol_type = other DNA
gctccagctgctttccaaaa

SEQ ID NO: 20011 - DNA, 20 bp, synthetic construct
  source 1..20: mol_type = other DNA
ctgcctggagtggagctgag

SEQ ID NO: 20012 - DNA, 20 bp, synthetic construct
  source 1..20: mol_type = other DNA
aggaaggaggaaacctggaa

SEQ ID NO: 20013 - DNA, 20 bp, synthetic construct
  source 1..20: mol_type = other DNA
agatgtggagccttgtcacc

SEQ ID NO: 20014 - DNA, 20 bp, synthetic construct
  source 1..20: mol_type = other DNA
ccgagacagctgcgcgggcg

SEQ ID NO: 20015 - DNA, 20 bp, synthetic construct
  source 1..20: mol_type = other DNA
aattctttctctgggtcatc

SEQ ID NO: 20016 - DNA, 20 bp, synthetic construct
  source 1..20: mol_type = other DNA
agaggggtgtcctgaaggtc

SEQ ID NO: 20017 - DNA, 20 bp, synthetic construct
  source 1..20: mol_type = other DNA
tccgagttgtcggaggaagg

SEQ ID NO: 20018 - DNA, 20 bp, synthetic construct
  source 1..20: mol_type = other DNA
gccagggcgcgcgtgcgcgg

SEQ ID NO: 20019 - DNA, 20 bp, synthetic construct
  source 1..20: mol_type = other DNA
ggccctcgccccctcctccc

SEQ ID NO: 20020 - DNA, 20 bp, synthetic construct
  source 1..20: mol_type = other DNA
tcgcatcgagcagtttccag

SEQ ID NO: 20021 - DNA, 20 bp, synthetic construct
  source 1..20: mol_type = other DNA
gcatccctaaaagcttcggc

SEQ ID NO: 20022 - DNA, 20 bp, synthetic construct
  source 1..20: mol_type = other DNA
atcagtcactcagccagggt

SEQ ID NO: 20023 - DNA, 20 bp, synthetic construct
  source 1..20: mol_type = other DNA
caagctgcgcgcccacgagc

SEQ ID NO: 20024 - DNA, 20 bp, synthetic construct
  source 1..20: mol_type = other DNA
ccggtgcacggcggctggcg

SEQ ID NO: 20025 - DNA, 20 bp, synthetic construct
  source 1..20: mol_type = other DNA
ggatggagctgaactttggg

SEQ ID NO: 20026 - DNA, 20 bp, synthetic construct
  source 1..20: mol_type = other DNA
caggattccttctggaactg

SEQ ID NO: 20027 - DNA, 20 bp, synthetic construct
  source 1..20: mol_type = other DNA
ctgccgccgccgaagctgga

SEQ ID NO: 20028 - DNA, 20 bp, synthetic construct
  source 1..20: mol_type = other DNA
aggctcgcgctctgcctgct

SEQ ID NO: 20029 - DNA, 20 bp, synthetic construct
  source 1..20: mol_type = other DNA
tatgaaaaggcctagtaagt

SEQ ID NO: 20030 - DNA, 20 bp, synthetic construct
  source 1..20: mol_type = other DNA
ggaaaggaacctcctccctg

SEQ ID NO: 20031 - DNA, 20 bp, synthetic construct
  source 1..20: mol_type = other DNA
aactcttgtttccaagctta

SEQ ID NO: 20032 - DNA, 20 bp, synthetic construct
  source 1..20: mol_type = other DNA
ggcagaattccttcctttag

SEQ ID NO: 20033 - DNA, 20 bp, synthetic construct
  source 1..20: mol_type = other DNA
aaacttggctcagcccactc

SEQ ID NO: 20034 - DNA, 20 bp, synthetic construct
  source 1..20: mol_type = other DNA
ggtctgtgatttcgaggcag

SEQ ID NO: 20035 - DNA, 20 bp, synthetic construct
  source 1..20: mol_type = other DNA
gaagcaagcaagcaaggaag

SEQ ID NO: 20036 - DNA, 20 bp, synthetic construct
  source 1..20: mol_type = other DNA
tgactattggtgttcctgtt

SEQ ID NO: 20037 - DNA, 20 bp, synthetic construct
  source 1..20: mol_type = other DNA
agcagccgctgtctccagtg

SEQ ID NO: 20038 - DNA, 20 bp, synthetic construct
  source 1..20: mol_type = other DNA
tggcatagtgagtttggagt

SEQ ID NO: 20039 - DNA, 20 bp, synthetic construct
  source 1..20: mol_type = other DNA
atttccgaagctcctgctca

SEQ ID NO: 20040 - DNA, 20 bp, synthetic construct
  source 1..20: mol_type = other DNA
ccagacttgaagccacacag

SEQ ID NO: 20041 - DNA, 20 bp, synthetic construct
  source 1..20: mol_type = other DNA
gagctgcctgacagtgacaa

SEQ ID NO: 20042 - DNA, 20 bp, synthetic construct
  source 1..20: mol_type = other DNA
tatgcctggataaggaggat

SEQ ID NO: 20043 - DNA, 20 bp, synthetic construct
  source 1..20: mol_type = other DNA
gctgagaagagggtgcagaa

SEQ ID NO: 20044 - DNA, 20 bp, synthetic construct
  source 1..20: mol_type = other DNA
gagaccgagccaaactcctg

SEQ ID NO: 20045 - DNA, 20 bp, synthetic construct
  source 1..20: mol_type = other DNA
acaatctctggacaaaattt

SEQ ID NO: 20046 - DNA, 20 bp, synthetic construct
  source 1..20: mol_type = other DNA
ccaattataccccgttggag

SEQ ID NO: 20047 - DNA, 20 bp, synthetic construct
  source 1..20: mol_type = other DNA
tcgctgggactcggaagtgc

SEQ ID NO: 20048 - DNA, 20 bp, synthetic construct
  source 1..20: mol_type = other DNA
gtgcgcacccactcgtaact

SEQ ID NO: 20049 - DNA, 20 bp, synthetic construct
  source 1..20: mol_type = other DNA
tgagagagggtcttagcagg

SEQ ID NO: 20050 - DNA, 20 bp, synthetic construct
  source 1..20: mol_type = other DNA
cgtcttgggtttggctccca

SEQ ID NO: 20051 - DNA, 20 bp, synthetic construct
  source 1..20: mol_type = other DNA
ttaaacgcgtagcattcctg

SEQ ID NO: 20052 - DNA, 20 bp, synthetic construct
  source 1..20: mol_type = other DNA
agtgctcccagtaaccttcc

SEQ ID NO: 20053 - DNA, 20 bp, synthetic construct
  source 1..20: mol_type = other DNA
ccgcggcgtggaggcaggga

SEQ ID NO: 20054 - DNA, 20 bp, synthetic construct
  source 1..20: mol_type = other DNA
tgggagggcggagggcgggg

SEQ ID NO: 20055 - DNA, 20 bp, synthetic construct
  source 1..20: mol_type = other DNA
aggagctggcctatcactac

SEQ ID NO: 20056 - DNA, 20 bp, synthetic construct
  source 1..20: mol_type = other DNA
cagataatgagaggaaatgc

SEQ ID NO: 20057 - DNA, 20 bp, synthetic construct
  source 1..20: mol_type = other DNA
gcatgcactgctgagcccga

SEQ ID NO: 20058 - DNA, 20 bp, synthetic construct
  source 1..20: mol_type = other DNA
ctctccgatgactttgccca

SEQ ID NO: 20059 - DNA, 20 bp, synthetic construct
  source 1..20: mol_type = other DNA
aggccctgccacccaccttc

SEQ ID NO: 20060 - DNA, 20 bp, synthetic construct
  source 1..20: mol_type = other DNA
cccatcccggctgcttttgc

SEQ ID NO: 20061 - DNA, 20 bp, synthetic construct
  source 1..20: mol_type = other DNA
cttcaagcccagcgagcatg

SEQ ID NO: 20062 - DNA, 20 bp, synthetic construct
  source 1..20: mol_type = other DNA
gccgaagcaggagccggcgg

SEQ ID NO: 20063 - DNA, 20 bp, synthetic construct
  source 1..20: mol_type = other DNA
tgtctgagcagtggaatgtg

SEQ ID NO: 20064 - DNA, 20 bp, synthetic construct
  source 1..20: mol_type = other DNA
atggaagaagttagctgtag

SEQ ID NO: 20065 - DNA, 20 bp, synthetic construct
  source 1..20: mol_type = other DNA
cagagctcagcttggtcccg

SEQ ID NO: 20066 - DNA, 20 bp, synthetic construct
  source 1..20: mol_type = other DNA
ggaggaggagccgccgccac

SEQ ID NO: 20067 - DNA, 20 bp, synthetic construct
  source 1..20: mol_type = other DNA
tcctcaaagcttctcgccat

SEQ ID NO: 20068 - DNA, 20 bp, synthetic construct
  source 1..20: mol_type = other DNA
ggctccgtccgctccctgga

SEQ ID NO: 20069 - DNA, 20 bp, synthetic construct
  source 1..20: mol_type = other DNA
tctttatatcctgacactat

SEQ ID NO: 20070 - DNA, 20 bp, synthetic construct
  source 1..20: mol_type = other DNA
ctttgcagcagatgtgtgac

SEQ ID NO: 20071 - DNA, 20 bp, synthetic construct
  source 1..20: mol_type = other DNA
cgctcccgtgcagacccgtg

SEQ ID NO: 20072 - DNA, 20 bp, synthetic construct
  source 1..20: mol_type = other DNA
agcggttattgagcattcgc

SEQ ID NO: 20073 - DNA, 20 bp, synthetic construct
  source 1..20: mol_type = other DNA
aagttctgagccccacaggt

SEQ ID NO: 20074 - DNA, 20 bp, synthetic construct
  source 1..20: mol_type = other DNA
atccccatagtgctgggtta

SEQ ID NO: 20075 - DNA, 20 bp, synthetic construct
  source 1..20: mol_type = other DNA
cccccacaggcagagctgac

SEQ ID NO: 20076 - DNA, 20 bp, synthetic construct
  source 1..20: mol_type = other DNA
cccacggaagccagttccaa

SEQ ID NO: 20077 - DNA, 20 bp, synthetic construct
  source 1..20: mol_type = other DNA
gttctctccatcgccttgtc

SEQ ID NO: 20078 - DNA, 20 bp, synthetic construct
  source 1..20: mol_type = other DNA
gcaaaaaaccgaatcttcag

SEQ ID NO: 20079 - DNA, 20 bp, synthetic construct
  source 1..20: mol_type = other DNA
acaagattattgatggcgcc

SEQ ID NO: 20080 - DNA, 20 bp, synthetic construct
  source 1..20: mol_type = other DNA
ccaggctggagtgcagtggt

SEQ ID NO: 20081 - DNA, 20 bp, synthetic construct
  source 1..20: mol_type = other DNA
tgcggggtgagaggccaggg

SEQ ID NO: 20082 - DNA, 20 bp, synthetic construct
  source 1..20: mol_type = other DNA
aggagggaggacagaggcca

SEQ ID NO: 20083 - DNA, 20 bp, synthetic construct
  source 1..20: mol_type = other DNA
aacaagtcaactaaggggtt

SEQ ID NO: 20084 - DNA, 20 bp, synthetic construct
  source 1..20: mol_type = other DNA
gtaggtttgctgtggaacgt

SEQ ID NO: 20085 - DNA, 20 bp, synthetic construct
  source 1..20: mol_type = other DNA
gtggcccagcctgctgagaa

SEQ ID NO: 20086 - DNA, 20 bp, synthetic construct
  source 1..20: mol_type = other DNA
acaggtgaaaattctggatc

SEQ ID NO: 20087 - DNA, 20 bp, synthetic construct
  source 1..20: mol_type = other DNA
ttcgtcagctgacaaagaca

SEQ ID NO: 20088 - DNA, 20 bp, synthetic construct
  source 1..20: mol_type = other DNA
ggaaggagacatcgaagcag

SEQ ID NO: 20089 - DNA, 20 bp, synthetic construct
  source 1..20: mol_type = other DNA
caggggacagggagagcaag

SEQ ID NO: 20090 - DNA, 20 bp, synthetic construct
  source 1..20: mol_type = other DNA
cacaggggcccccatgtagt

SEQ ID NO: 20091 - DNA, 20 bp, synthetic construct
  source 1..20: mol_type = other DNA
atccaggagtacaactcgaa

SEQ ID NO: 20092 - DNA, 20 bp, synthetic construct
  source 1..20: mol_type = other DNA
acctggaagagcggaagaag

SEQ ID NO: 20093 - DNA, 20 bp, synthetic construct
  source 1..20: mol_type = other DNA
actcctggcctcaagtgatc

SEQ ID NO: 20094 - DNA, 20 bp, synthetic construct
  source 1..20: mol_type = other DNA
ttggaagctggctcaagtac

SEQ ID NO: 20095 - DNA, 20 bp, synthetic construct
  source 1..20: mol_type = other DNA
tcaccacctgaaccacgggc

SEQ ID NO: 20096 - DNA, 20 bp, synthetic construct
  source 1..20: mol_type = other DNA
gccaggaggcgcctgagatt

SEQ ID NO: 20097 - DNA, 20 bp, synthetic construct
  source 1..20: mol_type = other DNA
atccagcacatgcacattga

SEQ ID NO: 20098 - DNA, 20 bp, synthetic construct
  source 1..20: mol_type = other DNA
tgctctcagccaaccgcctc

SEQ ID NO: 20099 - DNA, 20 bp, synthetic construct
  source 1..20: mol_type = other DNA
gccaggccacccgggactac

SEQ ID NO: 20100 - DNA, 20 bp, synthetic construct
  source 1..20: mol_type = other DNA
gaagaaaggtgcatggctgc

SEQ ID NO: 20101 - DNA, 20 bp, synthetic construct
  source 1..20: mol_type = other DNA
tgcaatcgcatctttgtaat

SEQ ID NO: 20102 - DNA, 20 bp, synthetic construct
  source 1..20: mol_type = other DNA
gagccaggagtccggggtcg

SEQ ID NO: 20103 - DNA, 20 bp, synthetic construct
  source 1..20: mol_type = other DNA
agaaaaggactctctggaac

SEQ ID NO: 20104 - DNA, 20 bp, synthetic construct
  source 1..20: mol_type = other DNA
gcggcggcggcatcagtcga

SEQ ID NO: 20105 - DNA, 20 bp, synthetic construct
  source 1..20: mol_type = other DNA
caggaggcttccgaccccac

SEQ ID NO: 20106 - DNA, 20 bp, synthetic construct
  source 1..20: mol_type = other DNA
cccaggctggagtgcagtgg

SEQ ID NO: 20107 - DNA, 20 bp, synthetic construct
  source 1..20: mol_type = other DNA
cctaggctggagtgcattgg

SEQ ID NO: 20108 - DNA, 20 bp, synthetic construct
  source 1..20: mol_type = other DNA
cgtcagtgcgcgctggcgca

SEQ ID NO: 20109 - DNA, 20 bp, synthetic construct
  source 1..20: mol_type = other DNA
cgcgcggcaggcgcggccat

SEQ ID NO: 20110 - DNA, 20 bp, synthetic construct
  source 1..20: mol_type = other DNA
gcaggccaggggcactgtga

SEQ ID NO: 20111 - DNA, 20 bp, synthetic construct
  source 1..20: mol_type = other DNA
ggggaccctcagccttgggg

SEQ ID NO: 20112 - DNA, 20 bp, synthetic construct
  source 1..20: mol_type = other DNA
tcctccttaccccgcctccc

SEQ ID NO: 20113 - DNA, 20 bp, synthetic construct
  source 1..20: mol_type = other DNA
gagaggcatgggcacgtggc

SEQ ID NO: 20114 - DNA, 20 bp, synthetic construct
  source 1..20: mol_type = other DNA
ggtggtgaggcaggctcgcc

SEQ ID NO: 20115 - DNA, 20 bp, synthetic construct
  source 1..20: mol_type = other DNA
cccgagcggcagccccaacc

SEQ ID NO: 20116 - DNA, 20 bp, synthetic construct
  source 1..20: mol_type = other DNA
ccgtcggccgcggtgaatcc

SEQ ID NO: 20117 - DNA, 20 bp, synthetic construct
  source 1..20: mol_type = other DNA
ctctggaggaagactggagc

SEQ ID NO: 20118 - DNA, 20 bp, synthetic construct
  source 1..20: mol_type = other DNA
gacagattgtccgggcaaac

SEQ ID NO: 20119 - DNA, 20 bp, synthetic construct
  source 1..20: mol_type = other DNA
agacacacacactcttggag

SEQ ID NO: 20120 - DNA, 20 bp, synthetic construct
  source 1..20: mol_type = other DNA
gaatcacatttcagcatgag

SEQ ID NO: 20121 - DNA, 20 bp, synthetic construct
  source 1..20: mol_type = other DNA
ggctggagcttccgggccct

SEQ ID NO: 20122 - DNA, 20 bp, synthetic construct
  source 1..20: mol_type = other DNA
tccatcgtgtgggaagaacg

SEQ ID NO: 20123 - DNA, 20 bp, synthetic construct
  source 1..20: mol_type = other DNA
cacccttctcccctcagaga

SEQ ID NO: 20124 - DNA, 20 bp, synthetic construct
  source 1..20: mol_type = other DNA
aagctcccggcgtctgcacc

SEQ ID NO: 20125 - DNA, 20 bp, synthetic construct
  source 1..20: mol_type = other DNA
gggggagggcgtcgcgggca

SEQ ID NO: 20126 - DNA, 20 bp, synthetic construct
  source 1..20: mol_type = other DNA
gggccgctggaccccgttgc

SEQ ID NO: 20127 - DNA, 20 bp, synthetic construct
  source 1..20: mol_type = other DNA
cccatctcgggcagaggctg

SEQ ID NO: 20128 - DNA, 20 bp, synthetic construct
  source 1..20: mol_type = other DNA
tgggctcagtaaggtcctcc

SEQ ID NO: 20129 - DNA, 20 bp, synthetic construct
  source 1..20: mol_type = other DNA
cgccgggcactgctgatgct

SEQ ID NO: 20130 - DNA, 20 bp, synthetic construct
  source 1..20: mol_type = other DNA
ataaagggggaagactttaa

SEQ ID NO: 20131 - DNA, 20 bp, synthetic construct
  source 1..20: mol_type = other DNA
tttaaaacagtttttgttaa

SEQ ID NO: 20132 - DNA, 20 bp, synthetic construct
  source 1..20: mol_type = other DNA
ccggttgtcttcctgtcggt

SEQ ID NO: 20133 - DNA, 20 bp, synthetic construct
  source 1..20: mol_type = other DNA
ctcatgtgccggcaccgggc

SEQ ID NO: 20134 - DNA, 20 bp, synthetic construct
  source 1..20: mol_type = other DNA
gttggctcgccgctctttgc

SEQ ID NO: 20135 - DNA, 20 bp, synthetic construct
  source 1..20: mol_type = other DNA
atcgatggacgcattcagaa

SEQ ID NO: 20136 - DNA, 20 bp, synthetic construct
  source 1..20: mol_type = other DNA
atccctccagagcattcaaa

SEQ ID NO: 20137 - DNA, 20 bp, synthetic construct
  source 1..20: mol_type = other DNA
tgagtggatgtgattggcga

SEQ ID NO: 20138 - DNA, 20 bp, synthetic construct
  source 1..20: mol_type = other DNA
aggcaccgtgatgtggagtc

SEQ ID NO: 20139 - DNA, 20 bp, synthetic construct
  source 1..20: mol_type = other DNA
cacggggctgcgtggaaaga

SEQ ID NO: 20140 - DNA, 20 bp, synthetic construct
  source 1..20: mol_type = other DNA
ctgggaggtctcctcccacc

SEQ ID NO: 20141 - DNA, 20 bp, synthetic construct
  source 1..20: mol_type = other DNA
gagtcctcgcgtgaaataag

SEQ ID NO: 20142 - DNA, 20 bp, synthetic construct
  source 1..20: mol_type = other DNA
gtaaattaccataaagcctc

SEQ ID NO: 20143 - DNA, 20 bp, synthetic construct
  source 1..20: mol_type = other DNA
ccatcctctgggtgaggagc

SEQ ID NO: 20144 - DNA, 20 bp, synthetic construct
  source 1..20: mol_type = other DNA
gcacggatgctgagcagaga

SEQ ID NO: 20145 - DNA, 20 bp, synthetic construct
  source 1..20: mol_type = other DNA
tcgttgtggctccttgggct

SEQ ID NO: 20146 - DNA, 20 bp, synthetic construct
  source 1..20: mol_type = other DNA
ccagggcctggagacccgtg

SEQ ID NO: 20147 - DNA, 20 bp, synthetic construct
  source 1..20: mol_type = other DNA
agagagattccctgctctcc

SEQ ID NO: 20148 - DNA, 20 bp, synthetic construct
  source 1..20: mol_type = other DNA
ggagctgcaaaagctgggga

SEQ ID NO: 20149 - DNA, 20 bp, synthetic construct
  source 1..20: mol_type = other DNA
gcctcatgcctctgacaacc

SEQ ID NO: 20150 - DNA, 20 bp, synthetic construct
  source 1..20: mol_type = other DNA
cgatcgcccagggccccgga

SEQ ID NO: 20151 - DNA, 20 bp, synthetic construct
  source 1..20: mol_type = other DNA
gcgagaagcagtcgggtttg

SEQ ID NO: 20152 - DNA, 20 bp, synthetic construct
  source 1..20: mol_type = other DNA
gctgcctctcccgtggtctg

SEQ ID NO: 20153 - DNA, 20 bp, synthetic construct
  source 1..20: mol_type = other DNA
cgtttcctgggtggctcccc

SEQ ID NO: 20154 - DNA, 20 bp, synthetic construct
  source 1..20: mol_type = other DNA
gtccacaatggaaggcttct

SEQ ID NO: 20155 - DNA, 20 bp, synthetic construct
  source 1..20: mol_type = other DNA
cggagagcgtagcgcggcct

SEQ ID NO: 20156 - DNA, 20 bp, synthetic construct
  source 1..20: mol_type = other DNA
gatgtaaatggaccaaaagt

SEQ ID NO: 20157 - DNA, 20 bp, synthetic construct
  source 1..20: mol_type = other DNA
acccaggcttcacacatttg

SEQ ID NO: 20158 - DNA, 20 bp, synthetic construct
  source 1..20: mol_type = other DNA
aacttgacaactttcctttc

SEQ ID NO: 20159 - DNA, 20 bp, synthetic construct
  source 1..20: mol_type = other DNA
ggggaccatgcagcggagcc

SEQ ID NO: 20160 - DNA, 20 bp, synthetic construct
  source 1..20: mol_type = other DNA
tcaccaacagatgaagacag

SEQ ID NO: 20161 - DNA, 20 bp, synthetic construct
  source 1..20: mol_type = other DNA
ctgcctttctcctcccgttg

SEQ ID NO: 20162 - DNA, 20 bp, synthetic construct
  source 1..20: mol_type = other DNA
tatgtaagaaggatggggca

SEQ ID NO: 20163 - DNA, 20 bp, synthetic construct
  source 1..20: mol_type = other DNA
ggcaagggtccacccagcca

SEQ ID NO: 20164 - DNA, 20 bp, synthetic construct
  source 1..20: mol_type = other DNA
aactccaattgctccagttc

SEQ ID NO: 20165 - DNA, 20 bp, synthetic construct
  source 1..20: mol_type = other DNA
gaagtaaaatagaaagaaga

SEQ ID NO: 20166 - DNA, 20 bp, synthetic construct
  source 1..20: mol_type = other DNA
tgctgcccttctgaggcctg

SEQ ID NO: 20167 - DNA, 20 bp, synthetic construct
  source 1..20: mol_type = other DNA
cggggccggaagacaggtgc

SEQ ID NO: 20168 - DNA, 20 bp, synthetic construct
  source 1..20: mol_type = other DNA
ccgcccccagacacgccggg

SEQ ID NO: 20169 - DNA, 20 bp, synthetic construct
  source 1..20: mol_type = other DNA
ggcggcgatggcggtcgggg

SEQ ID NO: 20170 - DNA, 20 bp, synthetic construct
  source 1..20: mol_type = other DNA
tcgccgtcttccagcgcaag

SEQ ID NO: 20171 - DNA, 20 bp, synthetic construct
  source 1..20: mol_type = other DNA
actgggcaaggcggtggtgg

SEQ ID NO: 20172 - DNA, 20 bp, synthetic construct
  source 1..20: mol_type = other DNA
acccgagttacctgtagtca

SEQ ID NO: 20173 - DNA, 20 bp, synthetic construct
  source 1..20: mol_type = other DNA
taaagaagcagccccgccct

SEQ ID NO: 20174 - DNA, 20 bp, synthetic construct
  source 1..20: mol_type = other DNA
gccccaactgcaccatccct

SEQ ID NO: 20175 - DNA, 20 bp, synthetic construct
  source 1..20: mol_type = other DNA
agggtccccgtggccccgag

SEQ ID NO: 20176 - DNA, 20 bp, synthetic construct
  source 1..20: mol_type = other DNA
acaaaagaaagaacgtcttc

SEQ ID NO: 20177 - DNA, 20 bp, synthetic construct
  source 1..20: mol_type = other DNA
ggcctgacctcagttgttcc

SEQ ID NO: 20178 - DNA, 20 bp, synthetic construct
  source 1..20: mol_type = other DNA
cgggaccgggggggatagat

SEQ ID NO: 20179 - DNA, 20 bp, synthetic construct
  source 1..20: mol_type = other DNA
tcacttctcgccggagtgtg

SEQ ID NO: 20180 - DNA, 20 bp, synthetic construct
  source 1..20: mol_type = other DNA
ttgggccctctgctcctctg

SEQ ID NO: 20181 - DNA, 20 bp, synthetic construct
  source 1..20: mol_type = other DNA
tgcccgggtcaccagtcggg

SEQ ID NO: 20182 - DNA, 20 bp, synthetic construct
  source 1..20: mol_type = other DNA
tgggctgggaacccgcggtg

SEQ ID NO: 20183 - DNA, 20 bp, synthetic construct
  source 1..20: mol_type = other DNA
tggctcggagactcctgcct

SEQ ID NO: 20184 - DNA, 20 bp, synthetic construct
  source 1..20: mol_type = other DNA
gtgcttccactgataacata

SEQ ID NO: 20185 - DNA, 20 bp, synthetic construct
  source 1..20: mol_type = other DNA
attacaggcctttgagccca

SEQ ID NO: 20186 - DNA, 20 bp, synthetic construct
  source 1..20: mol_type = other DNA
ctgttgctttgtaaaaatgc

SEQ ID NO: 20187 - DNA, 20 bp, synthetic construct
  source 1..20: mol_type = other DNA
gaactgcccagggaccatcc

SEQ ID NO: 20188 - DNA, 20 bp, synthetic construct
  source 1..20: mol_type = other DNA
cgctcttgttgcccaggctg

SEQ ID NO: 20189 - DNA, 20 bp, synthetic construct
  source 1..20: mol_type = other DNA
ccggcgactgcagcttcccc

SEQ ID NO: 20190 - DNA, 20 bp, synthetic construct
  source 1..20: mol_type = other DNA
ggagtttcttggtcacagga

SEQ ID NO: 20191 - DNA, 20 bp, synthetic construct
  source 1..20: mol_type = other DNA
ccaaggtggagaaaccagga

SEQ ID NO: 20192 - DNA, 20 bp, synthetic construct
  source 1..20: mol_type = other DNA
ggaatggccaaatatcaaga

SEQ ID NO: 20193 - DNA, 20 bp, synthetic construct
  source 1..20: mol_type = other DNA
ggtttctttcactacttatc

SEQ ID NO: 20194 - DNA, 20 bp, synthetic construct
  source 1..20: mol_type = other DNA
aggggtgaggcggtgtctcc

SEQ ID NO: 20195 - DNA, 20 bp, synthetic construct
  source 1..20: mol_type = other DNA
agaacactaccgttcaagag

SEQ ID NO: 20196 - DNA, 20 bp, synthetic construct
  source 1..20: mol_type = other DNA
tgtcccatgacgctctggga

SEQ ID NO: 20197 - DNA, 20 bp, synthetic construct
  source 1..20: mol_type = other DNA
tttccttaccaatcggctgc

SEQ ID NO: 20198 - DNA, 20 bp, synthetic construct
  source 1..20: mol_type = other DNA
cgtccgttccctaagcagac

SEQ ID NO: 20199 - DNA, 20 bp, synthetic construct
  source 1..20: mol_type = other DNA
ggctagtgcaaggatcagat

SEQ ID NO: 20200 - DNA, 20 bp, synthetic construct
  source 1..20: mol_type = other DNA
aacctggatctggagccggg

SEQ ID NO: 20201 - DNA, 20 bp, synthetic construct
  source 1..20: mol_type = other DNA
ccaggccccgcagcccatgg

SEQ ID NO: 20202 - DNA, 20 bp, synthetic construct
  source 1..20: mol_type = other DNA
cccggagcctctccctgggc

SEQ ID NO: 20203 - DNA, 20 bp, synthetic construct
  source 1..20: mol_type = other DNA
gtgggtcgctgatttcttgg

SEQ ID NO: 20204 - DNA, 20 bp, synthetic construct
  source 1..20: mol_type = other DNA
ctgcaccctccacctcccgc

SEQ ID NO: 20205 - DNA, 20 bp, synthetic construct
  source 1..20: mol_type = other DNA
gtacggcttgcggcttaagc

SEQ ID NO: 20206 - DNA, 20 bp, synthetic construct
  source 1..20: mol_type = other DNA
catgtctgtgttctggctcc

SEQ ID NO: 20207 - DNA, 20 bp, synthetic construct
  source 1..20: mol_type = other DNA
cctgcatcctcctctgctca

SEQ ID NO: 20208 - DNA, 20 bp, synthetic construct
  source 1..20: mol_type = other DNA
atggcggcgctggcagcagc

SEQ ID NO: 20209 - DNA, 20 bp, synthetic construct
  source 1..20: mol_type = other DNA
ttccctcaccaggaacccag

SEQ ID NO: 20210 - DNA, 20 bp, synthetic construct
  source 1..20: mol_type = other DNA
atgagatgaagtgagtttcc

SEQ ID NO: 20211 - DNA, 20 bp, synthetic construct
  source 1..20: mol_type = other DNA
catcttcacctccacaatcg

SEQ ID NO: 20212 - DNA, 20 bp, synthetic construct
  source 1..20: mol_type = other DNA
agtcgggggagtcgtaaaca

SEQ ID NO: 20213 - DNA, 20 bp, synthetic construct
  source 1..20: mol_type = other DNA
gaggaggtgagcgccaggtc

SEQ ID NO: 20214 - DNA, 20 bp, synthetic construct
  source 1..20: mol_type = other DNA
acaaccaccgccacctccta

SEQ ID NO: 20215 - DNA, 20 bp, synthetic construct
  source 1..20: mol_type = other DNA
agagttcagagagggggtgt

SEQ ID NO: 20216 - DNA, 20 bp, synthetic construct
  source 1..20: mol_type = other DNA
tcttgctgagcacattgaaa

SEQ ID NO: 20217 - DNA, 20 bp, synthetic construct
  source 1..20: mol_type = other DNA
gcggccctgcgcccccagcc

SEQ ID NO: 20218 - DNA, 20 bp, synthetic construct
  source 1..20: mol_type = other DNA
ctctggctacactgaaaggc

SEQ ID NO: 20219 - DNA, 20 bp, synthetic construct
  source 1..20: mol_type = other DNA
gaagataaatgttactcctc

SEQ ID NO: 20220 - DNA, 20 bp, synthetic construct
  source 1..20: mol_type = other DNA
cgcgatgggcctcttggaac

SEQ ID NO: 20221 - DNA, 20 bp, synthetic construct
  source 1..20: mol_type = other DNA
cccgccgatcaggttccttt

SEQ ID NO: 20222 - DNA, 20 bp, synthetic construct
  source 1..20: mol_type = other DNA
acggaggcttcgcgggaaga

SEQ ID NO: 20223 - DNA, 20 bp, synthetic construct
  source 1..20: mol_type = other DNA
ctctctctgccaccatttcg

SEQ ID NO: 20224 - DNA, 20 bp, synthetic construct
  source 1..20: mol_type = other DNA
tagggcgtggtgcttgctcc

SEQ ID NO: 20225 - DNA, 20 bp, synthetic construct
  source 1..20: mol_type = other DNA
tcattatacctctttatcca

SEQ ID NO: 20226 - DNA, 20 bp, synthetic construct
  source 1..20: mol_type = other DNA
gctgaactccctgaggtctc

SEQ ID NO: 20227 - DNA, 20 bp, synthetic construct
  source 1..20: mol_type = other DNA
agatccacttcttcctagcc

SEQ ID NO: 20228 - DNA, 20 bp, synthetic construct
  source 1..20: mol_type = other DNA
ccgttgcccggccctctccc

SEQ ID NO: 20229 - DNA, 20 bp, synthetic construct
  source 1..20: mol_type = other DNA
tccgccgcccgccccgaccc

SEQ ID NO: 20230 - DNA, 20 bp, synthetic construct
  source 1..20: mol_type = other DNA
cagggcaagctccccgtctc

SEQ ID NO: 20231 - DNA, 20 bp, synthetic construct
  source 1..20: mol_type = other DNA
tggccgctgcacaagaacct

SEQ ID NO: 20232 - DNA, 20 bp, synthetic construct
  source 1..20: mol_type = other DNA
aggcattgaggaactcaatc

SEQ ID NO: 20233 - DNA, 20 bp, synthetic construct
  source 1..20: mol_type = other DNA
aaatcgatcctcctaccttg

SEQ ID NO: 20234 - DNA, 20 bp, synthetic construct
  source 1..20: mol_type = other DNA
tcttgcttcaggaaggtgaa

SEQ ID NO: 20235 - DNA, 20 bp, synthetic construct
  source 1..20: mol_type = other DNA
ccttgggaacatgggagagg

SEQ ID NO: 20236 - DNA, 20 bp, synthetic construct
  source 1..20: mol_type = other DNA
aaaaaaaaggattcaatagt

SEQ ID NO: 20237 - DNA, 20 bp, synthetic construct
  source 1..20: mol_type = other DNA
tgtaagtaaaccagagcgaa

SEQ ID NO: 20238 - DNA, 20 bp, synthetic construct
  source 1..20: mol_type = other DNA
acgcggtggcttagacgcgc

SEQ ID NO: 20239 - DNA, 20 bp, synthetic construct
  source 1..20: mol_type = other DNA
atcactcctgaagatcttct

SEQ ID NO: 20240 - DNA, 20 bp, synthetic construct
  source 1..20: mol_type = other DNA
ccgtgtatgcctcccacaag

SEQ ID NO: 20241 - DNA, 20 bp, synthetic construct
  source 1..20: mol_type = other DNA
ccctcagagtgctcccttca

SEQ ID NO: 20242 - DNA, 20 bp, synthetic construct
  source 1..20: mol_type = other DNA
ccctttgcccatccttcctt

SEQ ID NO: 20243 - DNA, 20 bp, synthetic construct
  source 1..20: mol_type = other DNA
cattttcaatagaaacgaag

SEQ ID NO: 20244 - DNA, 20 bp, synthetic construct
  source 1..20: mol_type = other DNA
ggctggaatatagtggcaca

SEQ ID NO: 20245 - DNA, 20 bp, synthetic construct
  source 1..20: mol_type = other DNA
cactaagccgtagcggcagc

SEQ ID NO: 20246 - DNA, 20 bp, synthetic construct
  source 1..20: mol_type = other DNA
gtccctgcagacggcttccc

SEQ ID NO: 20247 - DNA, 20 bp, synthetic construct
  source 1..20: mol_type = other DNA
atagaaggcagaacaacaac

SEQ ID NO: 20248 - DNA, 20 bp, synthetic construct
  source 1..20: mol_type = other DNA
tgaggagctgtccgtgtgca

SEQ ID NO: 20249 - DNA, 20 bp, synthetic construct
  source 1..20: mol_type = other DNA
caaggctcccaccccgcctg

SEQ ID NO: 20250 - DNA, 20 bp, synthetic construct
  source 1..20: mol_type = other DNA
tcaagaaccagggtctgtca

SEQ ID NO: 20251 - DNA, 20 bp, synthetic construct
  source 1..20: mol_type = other DNA
tcagcctgcagacagcctat

SEQ ID NO: 20252 - DNA, 20 bp, synthetic construct
  source 1..20: mol_type = other DNA
gaccgcagtcgagtctgcag

SEQ ID NO: 20253 - DNA, 20 bp, synthetic construct
  source 1..20: mol_type = other DNA
tacagattgtggagagctgc

SEQ ID NO: 20254 - DNA, 20 bp, synthetic construct
  source 1..20: mol_type = other DNA
ggaggaaaggaaaagacaga

SEQ ID NO: 20255 - DNA, 20 bp, synthetic construct
  source 1..20: mol_type = other DNA
cgggaagggcgcggggcgga

SEQ ID NO: 20256 - DNA, 20 bp, synthetic construct
  source 1..20: mol_type = other DNA
acggccctgctcatcacatg

SEQ ID NO: 20257 - DNA, 20 bp, synthetic construct
  source 1..20: mol_type = other DNA
ggtctgaagacggatggagt

SEQ ID NO: 20258 - DNA, 20 bp, synthetic construct
  source 1..20: mol_type = other DNA
ttaagtgtatcgagctgata

SEQ ID NO: 20259 - DNA, 20 bp, synthetic construct
  source 1..20: mol_type = other DNA
gacgcgagcgcggggcgggt

SEQ ID NO: 20260 - DNA, 20 bp, synthetic construct
  source 1..20: mol_type = other DNA
cctaggagtgctacgggggg

SEQ ID NO: 20261 - DNA, 20 bp, synthetic construct
  source 1..20: mol_type = other DNA
cggagcccaggccgggagca

SEQ ID NO: 20262 - DNA, 20 bp, synthetic construct
  source 1..20: mol_type = other DNA
cctggcttccctgcgctgca

SEQ ID NO: 20263 - DNA, 20 bp, synthetic construct
  source 1..20: mol_type = other DNA
tcaatgacaggagccagcct

SEQ ID NO: 20264 - DNA, 20 bp, synthetic construct
  source 1..20: mol_type = other DNA
tgcggagcctctcccgctcg

SEQ ID NO: 20265 - DNA, 20 bp, synthetic construct
  source 1..20: mol_type = other DNA
tgtccttccgaacgcacact

SEQ ID NO: 20266 - DNA, 20 bp, synthetic construct
  source 1..20: mol_type = other DNA
cctctgaggttttccattta

SEQ ID NO: 20267 - DNA, 20 bp, synthetic construct
  source 1..20: mol_type = other DNA
gcctgaaaggcagctctcag

SEQ ID NO: 20268 - DNA, 20 bp, synthetic construct
  source 1..20: mol_type = other DNA
gtagagatgacttctacccg

SEQ ID NO: 20269 - DNA, 20 bp, synthetic construct
  source 1..20: mol_type = other DNA
accgtccctgtgttccccac

SEQ ID NO: 20270 - DNA, 20 bp, synthetic construct
  source 1..20: mol_type = other DNA
cccagctgggaggctgtggc

SEQ ID NO: 20271 - DNA, 20 bp, synthetic construct
  source 1..20: mol_type = other DNA
gagtgttgttctacctgcgc

SEQ ID NO: 20272 - DNA, 20 bp, synthetic construct
  source 1..20: mol_type = other DNA
cggctggcaagaagaggatg

SEQ ID NO: 20273 - DNA, 20 bp, synthetic construct
  source 1..20: mol_type = other DNA
agctcttctgcctggaacac

SEQ ID NO: 20274 - DNA, 20 bp, synthetic construct
  source 1..20: mol_type = other DNA
atggcatcgaccccagcggc

SEQ ID NO: 20275 - DNA, 20 bp, synthetic construct
  source 1..20: mol_type = other DNA
cagagttggaggtggtggcg

SEQ ID NO: 20276 - DNA, 20 bp, synthetic construct
  source 1..20: mol_type = other DNA
cctcaaactagccaatgaga

SEQ ID NO: 20277 - DNA, 20 bp, synthetic construct
  source 1..20: mol_type = other DNA
cgacgctcctcgggaagcca

SEQ ID NO: 20278 - DNA, 20 bp, synthetic construct
  source 1..20: mol_type = other DNA
cagaaaacagctgaaacgga

SEQ ID NO: 20279 - DNA, 20 bp, synthetic construct
  source 1..20: mol_type = other DNA
cccacccaccgcccccactg

SEQ ID NO: 20280 - DNA, 20 bp, synthetic construct
  source 1..20: mol_type = other DNA
atccagaggagtggaaggct

SEQ ID NO: 20281 - DNA, 20 bp, synthetic construct
  source 1..20: mol_type = other DNA
gctgttgtttccagcaagac

SEQ ID NO: 20282 - DNA, 20 bp, synthetic construct
  source 1..20: mol_type = other DNA
acacatttcctgaaggagtt

SEQ ID NO: 20283 - DNA, 20 bp, synthetic construct
  source 1..20: mol_type = other DNA
taggagggagcccgccgggg

SEQ ID NO: 20284 - DNA, 20 bp, synthetic construct
  source 1..20: mol_type = other DNA
ctcggaagggtctttgttcc

SEQ ID NO: 20285 - DNA, 20 bp, synthetic construct
  source 1..20: mol_type = other DNA
aggaggagaagcggcggcgc

SEQ ID NO: 20286 - DNA, 20 bp, synthetic construct
  source 1..20: mol_type = other DNA
ggggccggcggtggcggagc

SEQ ID NO: 20287 - DNA, 20 bp, synthetic construct
  source 1..20: mol_type = other DNA
tgttttcttgcataaaattc

SEQ ID NO: 20288 - DNA, 20 bp, synthetic construct
  source 1..20: mol_type = other DNA
tggtttcatagccttctccc

SEQ ID NO: 20289 - DNA, 20 bp, synthetic construct
  source 1..20: mol_type = other DNA
ccgacgaggagctgaaccag

SEQ ID NO: 20290 - DNA, 20 bp, synthetic construct
  source 1..20: mol_type = other DNA
ctgctaatgagacttgttga

SEQ ID NO: 20291 - DNA, 20 bp, synthetic construct
  source 1..20: mol_type = other DNA
cggcggcggcggcggtggag

SEQ ID NO: 20292 - DNA, 20 bp, synthetic construct
  source 1..20: mol_type = other DNA
cgcctgcacgtacgtagcct

SEQ ID NO: 20293 - DNA, 20 bp, synthetic construct
  source 1..20: mol_type = other DNA
tgaaccagttattaggggcg

SEQ ID NO: 20294 - DNA, 20 bp, synthetic construct
  source 1..20: mol_type = other DNA
accgggagatccagaagtga

SEQ ID NO: 20295 - DNA, 20 bp, synthetic construct
  source 1..20: mol_type = other DNA
ctcctggtctgcaacctctc

SEQ ID NO: 20296 - DNA, 20 bp, synthetic construct
  source 1..20: mol_type = other DNA
atttggacacacagagagat

SEQ ID NO: 20297 - DNA, 20 bp, synthetic construct
  source 1..20: mol_type = other DNA
gctagggagtgggactggca

SEQ ID NO: 20298 - DNA, 20 bp, synthetic construct
  source 1..20: mol_type = other DNA
gggtccagagagagggtcta

SEQ ID NO: 20299 - DNA, 20 bp, synthetic construct
  source 1..20: mol_type = other DNA
ttgacaaactgctgacagct

SEQ ID NO: 20300 - DNA, 20 bp, synthetic construct
  source 1..20: mol_type = other DNA
cccagtgctccataaaggat

SEQ ID NO: 20301 - DNA, 20 bp, synthetic construct
  source 1..20: mol_type = other DNA
ccatgtgttgctgagagatg

SEQ ID NO: 20302 - DNA, 20 bp, synthetic construct
  source 1..20: mol_type = other DNA
catgagttgctcctgacggc

SEQ ID NO: 20303 - DNA, 20 bp, synthetic construct
  source 1..20: mol_type = other DNA
caggaattcgaacgtttcgt

SEQ ID NO: 20304 - DNA, 20 bp, synthetic construct
  source 1..20: mol_type = other DNA
acgacatacaagatttttgc

SEQ ID NO: 20305 - DNA, 20 bp, synthetic construct
  source 1..20: mol_type = other DNA
agagaaaatttatgacattg

SEQ ID NO: 20306 - DNA, 20 bp, synthetic construct
  source 1..20: mol_type = other DNA
tcacggaggaggagaggaaa

SEQ ID NO: 20307 - DNA, 20 bp, synthetic construct
  source 1..20: mol_type = other DNA
tctacaagtccatctttgtc

SEQ ID NO: 20308 - DNA, 20 bp, synthetic construct
  source 1..20: mol_type = other DNA
gcaatgcctctccttgtttg

SEQ ID NO: 20309 - DNA, 20 bp, synthetic construct
  source 1..20: mol_type = other DNA
gcaaatgaaggggaaacaac

SEQ ID NO: 20310 - DNA, 20 bp, synthetic construct
  source 1..20: mol_type = other DNA
gtatgttgagtctaaaaagg

SEQ ID NO: 20311 - DNA, 20 bp, synthetic construct
  source 1..20: mol_type = other DNA
tggacaaaacaggacatgtt

SEQ ID NO: 20312 - DNA, 20 bp, synthetic construct
  source 1..20: mol_type = other DNA
gcagaggaagacaagaagaa

SEQ ID NO: 20313 - DNA, 20 bp, synthetic construct
  source 1..20: mol_type = other DNA
gagaaagaaagatctatgct

SEQ ID NO: 20314 - DNA, 20 bp, synthetic construct
  source 1..20: mol_type = other DNA
agccacgctattcaaagaca

SEQ ID NO: 20315 - DNA, 20 bp, synthetic construct
  source 1..20: mol_type = other DNA
agaacaatcaacctgtggag

SEQ ID NO: 20316 - DNA, 20 bp, synthetic construct
  source 1..20: mol_type = other DNA
agatctggacgatatgattg

SEQ ID NO: 20317 - DNA, 20 bp, synthetic construct
  source 1..20: mol_type = other DNA
aggaagaaagagggaagaca

SEQ ID NO: 20318 - DNA, 20 bp, synthetic construct
  source 1..20: mol_type = other DNA
gcctacatttaaaactgcaa

SEQ ID NO: 20319 - DNA, 20 bp, synthetic construct
  source 1..20: mol_type = other DNA
attgctggaaatcatcacca

SEQ ID NO: 20320 - DNA, 20 bp, synthetic construct
  source 1..20: mol_type = other DNA
ggtagcataaaaaaacaata

SEQ ID NO: 20321 - DNA, 20 bp, synthetic construct
  source 1..20: mol_type = other DNA
acgtggatagaatcacctaa

SEQ ID NO: 20322 - DNA, 20 bp, synthetic construct
  source 1..20: mol_type = other DNA
caaattcctccggaaacagg

SEQ ID NO: 20323 - DNA, 20 bp, synthetic construct
  source 1..20: mol_type = other DNA
gcagctggggccggacctgg

SEQ ID NO: 20324 - DNA, 20 bp, synthetic construct
  source 1..20: mol_type = other DNA
cgctgcgcaacagcatcgga

SEQ ID NO: 20325 - DNA, 20 bp, synthetic construct
  source 1..20: mol_type = other DNA
actgggtgcgcgactcggtt

SEQ ID NO: 20326 - DNA, 20 bp, synthetic construct
  source 1..20: mol_type = other DNA
gtcgccgccagaggagctgc

SEQ ID NO: 20327 - DNA, 20 bp, synthetic construct
  source 1..20: mol_type = other DNA
tgtggtgagctgtttgattc

SEQ ID NO: 20328 - DNA, 20 bp, synthetic construct
  source 1..20: mol_type = other DNA
gcgacggcgacggggacgac

SEQ ID NO: 20329 - DNA, 20 bp, synthetic construct
  source 1..20: mol_type = other DNA
cctcttcccgactggccatt

SEQ ID NO: 20330 - DNA, 20 bp, synthetic construct
  source 1..20: mol_type = other DNA
caacaaagcccgccaagagt

SEQ ID NO: 20331 - DNA, 20 bp, synthetic construct
  source 1..20: mol_type = other DNA
ttcccaactttgacgcggtg

SEQ ID NO: 20332 - DNA, 20 bp, synthetic construct
  source 1..20: mol_type = other DNA
gtttgtacctattgtcagct

SEQ ID NO: 20333 - DNA, 20 bp, synthetic construct
  source 1..20: mol_type = other DNA
gggatatgctccaggcgggc

SEQ ID NO: 20334 - DNA, 20 bp, synthetic construct
  source 1..20: mol_type = other DNA
atctgcagcctcgtcactgt

SEQ ID NO: 20335 - DNA, 20 bp, synthetic construct
  source 1..20: mol_type = other DNA
agatgccatgaaccacccta

SEQ ID NO: 20336 - DNA, 20 bp, synthetic construct
  source 1..20: mol_type = other DNA
gcgctggtccgtgcagacct

SEQ ID NO: 20337 - DNA, 20 bp, synthetic construct
  source 1..20: mol_type = other DNA
tacggtcacgccggcatggc

SEQ ID NO: 20338 - DNA, 20 bp, synthetic construct
  source 1..20: mol_type = other DNA
cgagtggtgttttttaatag

SEQ ID NO: 20339 - DNA, 20 bp, synthetic construct
  source 1..20: mol_type = other DNA
cgcgagccttcgtctcagag

SEQ ID NO: 20340 - DNA, 20 bp, synthetic construct
  source 1..20: mol_type = other DNA
acggggacacggacagcctt

SEQ ID NO: 20341 - DNA, 20 bp, synthetic construct
  source 1..20: mol_type = other DNA
gcgagtagagttttctcctc

SEQ ID NO: 20342 - DNA, 20 bp, synthetic construct
  source 1..20: mol_type = other DNA
aacgccacaacataaagaag

SEQ ID NO: 20343 - DNA, 20 bp, synthetic construct
  source 1..20: mol_type = other DNA
ggggttggggttattctctg

SEQ ID NO: 20344 - DNA, 20 bp, synthetic construct
  source 1..20: mol_type = other DNA
atttgcatttattgtcagct

SEQ ID NO: 20345 - DNA, 20 bp, synthetic construct
  source 1..20: mol_type = other DNA
ccacccaactttccccgcgc

SEQ ID NO: 20346 - DNA, 20 bp, synthetic construct
  source 1..20: mol_type = other DNA
cctcctgttcctgtccatcc

SEQ ID NO: 20347 - DNA, 20 bp, synthetic construct
  source 1..20: mol_type = other DNA
tgtgcaacatcttacaaatg

SEQ ID NO: 20348 - DNA, 20 bp, synthetic construct
  source 1..20: mol_type = other DNA
tcttcattttgaggttttgg

SEQ ID NO: 20349 - DNA, 20 bp, synthetic construct
  source 1..20: mol_type = other DNA
ttacgtcattttttagtcct

SEQ ID NO: 20350 - DNA, 20 bp, synthetic construct
  source 1..20: mol_type = other DNA
ggggtcttatgtagttttgt

SEQ ID NO: 20351 - DNA, 20 bp, synthetic construct
  source 1..20: mol_type = other DNA
tatgatctggaattggaaga

SEQ ID NO: 20352 - DNA, 20 bp, synthetic construct
  source 1..20: mol_type = other DNA
gcaacccgttcgctcatctg

SEQ ID NO: 20353 - DNA, 20 bp, synthetic construct
  source 1..20: mol_type = other DNA
gcgaccgagcgtgcgttcgt

SEQ ID NO: 20354 - DNA, 20 bp, synthetic construct
  source 1..20: mol_type = other DNA
tagtcgcgccgcgcgttctt

SEQ ID NO: 20355 - DNA, 20 bp, synthetic construct
  source 1..20: mol_type = other DNA
gtgtttatttaatgtgacgt

SEQ ID NO: 20356 - DNA, 20 bp, synthetic construct
  source 1..20: mol_type = other DNA
cagcaaattgactcccgccg

SEQ ID NO: 20357 - DNA, 20 bp, synthetic construct
  source 1..20: mol_type = other DNA
agaatggactctgacgctcc

SEQ ID NO: 20358 - DNA, 20 bp, synthetic construct
  source 1..20: mol_type = other DNA
agaggagaaaggaagaggtc

SEQ ID NO: 20359 - DNA, 20 bp, synthetic construct
  source 1..20: mol_type = other DNA
ctgcggtctggccttggaag

SEQ ID NO: 20360 - DNA, 20 bp, synthetic construct
  source 1..20: mol_type = other DNA
ggaactctccagttcgtgga

SEQ ID NO: 20361 - DNA, 20 bp, synthetic construct
  source 1..20: mol_type = other DNA
agtgcggattaccatcgaag

SEQ ID NO: 20362 - DNA, 20 bp, synthetic construct
  source 1..20: mol_type = other DNA
aaagagaaaatgccttaacc

SEQ ID NO: 20363 - DNA, 20 bp, synthetic construct
  source 1..20: mol_type = other DNA
tctaagatcttttttttttt

SEQ ID NO: 20364 - DNA, 20 bp, synthetic construct
  source 1..20: mol_type = other DNA
gtgtagcatagtctgcctgg

SEQ ID NO: 20365 - DNA, 20 bp, synthetic construct
  source 1..20: mol_type = other DNA
ataccgcaatcaaaatgttg

SEQ ID NO: 20366 - DNA, 20 bp, synthetic construct
  source 1..20: mol_type = other DNA
cagcacctcacttccctctt

SEQ ID NO: 20367 - DNA, 20 bp, synthetic construct
  source 1..20: mol_type = other DNA
aagcagtttggtgataatat

SEQ ID NO: 20368 - DNA, 20 bp, synthetic construct
  source 1..20: mol_type = other DNA
aggttttacgagggtcgagc

SEQ ID NO: 20369 - DNA, 20 bp, synthetic construct
  source 1..20: mol_type = other DNA
tggagcggagttcggttcca

SEQ ID NO: 20370 - DNA, 20 bp, synthetic construct
  source 1..20: mol_type = other DNA
gcctgttgctgcatcacgct

SEQ ID NO: 20371 - DNA, 20 bp, synthetic construct
  source 1..20: mol_type = other DNA
gtactagacacagataacaa

SEQ ID NO: 20372 - DNA, 20 bp, synthetic construct
  source 1..20: mol_type = other DNA
tcctgtgtttttacgtaggt

SEQ ID NO: 20373 - DNA, 20 bp, synthetic construct
  source 1..20: mol_type = other DNA
agaagagttttctccttcgc

SEQ ID NO: 20374 - DNA, 20 bp, synthetic construct
  source 1..20: mol_type = other DNA
aataggtgaccggaggtcgg

SEQ ID NO: 20375 - DNA, 20 bp, synthetic construct
  source 1..20: mol_type = other DNA
gatagggtccttgcgagggg

SEQ ID NO: 20376 - DNA, 20 bp, synthetic construct
  source 1..20: mol_type = other DNA
aaagaggttaaaacattaca

SEQ ID NO: 20377 - DNA, 20 bp, synthetic construct
  source 1..20: mol_type = other DNA
cgcctccgggtaagggacgc

SEQ ID NO: 20378 - DNA, 20 bp, synthetic construct
  source 1..20: mol_type = other DNA
aactcgtaagcggggcaacc

SEQ ID NO: 20379 - DNA, 20 bp, synthetic construct
  source 1..20: mol_type = other DNA
tggatccaccactctcgact

SEQ ID NO: 20380 - DNA, 20 bp, synthetic construct
  source 1..20: mol_type = other DNA
ccagtgtcttccgtttgtac

SEQ ID NO: 20381 - DNA, 20 bp, synthetic construct
  source 1..20: mol_type = other DNA
gaaagtggtgaaccgaaaac

SEQ ID NO: 20382 - DNA, 20 bp, synthetic construct
  source 1..20: mol_type = other DNA
ggaagggcaagttaattgta

SEQ ID NO: 20383 - DNA, 20 bp, synthetic construct
  source 1..20: mol_type = other DNA
acaggttttcccatttcctt

SEQ ID NO: 20384 - DNA, 20 bp, synthetic construct
  source 1..20: mol_type = other DNA
ttttgttgtcagtgtaagtc

SEQ ID NO: 20385 - DNA, 20 bp, synthetic construct
  source 1..20: mol_type = other DNA
ctccttaacttattgaaatt

SEQ ID NO: 20386 - DNA, 20 bp, synthetic construct
  source 1..20: mol_type = other DNA
aagaatgccctggaggcaag

SEQ ID NO: 20387 - DNA, 20 bp, synthetic construct
  source 1..20: mol_type = other DNA
cagcagcaggaacgcgggag

SEQ ID NO: 20388 - DNA, 20 bp, synthetic construct
  source 1..20: mol_type = other DNA
atttacatttccaaatccat

SEQ ID NO: 20389 - DNA, 20 bp, synthetic construct
  source 1..20: mol_type = other DNA
tttcctgccttttatataca

SEQ ID NO: 20390 - DNA, 20 bp, synthetic construct
  source 1..20: mol_type = other DNA
gggaacaccctttagtcctg

SEQ ID NO: 20391 - DNA, 20 bp, synthetic construct
  source 1..20: mol_type = other DNA
tgttgctgtggatgtgacag

SEQ ID NO: 20392 - DNA, 20 bp, synthetic construct
  source 1..20: mol_type = other DNA
ctgaggtactcaggggcatt

SEQ ID NO: 20393 - DNA, 20 bp, synthetic construct
  source 1..20: mol_type = other DNA
tactcaggggcatttaggtt

SEQ ID NO: 20394 - DNA, 20 bp, synthetic construct
  source 1..20: mol_type = other DNA
cgggccgaggtaccaaaggc

SEQ ID NO: 20395 - DNA, 20 bp, synthetic construct
  source 1..20: mol_type = other DNA
attggccagacaaggggagg

SEQ ID NO: 20396 - DNA, 20 bp, synthetic construct
  source 1..20: mol_type = other DNA
ccgccagctgattcgcctct

SEQ ID NO: 20397 - DNA, 20 bp, synthetic construct
  source 1..20: mol_type = other DNA
ggaaagtactaccccaaggg

SEQ ID NO: 20398 - DNA, 20 bp, synthetic construct
  source 1..20: mol_type = other DNA
cgaccactcatacaaccccc

SEQ ID NO: 20399 - DNA, 20 bp, synthetic construct
  source 1..20: mol_type = other DNA
gcccacggcaagtaccgcgg

SEQ ID NO: 20400 - DNA, 20 bp, synthetic construct
  source 1..20: mol_type = other DNA
ctatgaaaactgggcaataa

SEQ ID NO: 20401 - DNA, 20 bp, synthetic construct
  source 1..20: mol_type = other DNA
taatggatggaaatttcgag

SEQ ID NO: 20402 - DNA, 20 bp, synthetic construct
  source 1..20: mol_type = other DNA
taaccttaaaaattctccag

SEQ ID NO: 20403 - DNA, 20 bp, synthetic construct
  source 1..20: mol_type = other DNA
aattatgacagtaaccatga

SEQ ID NO: 20404 - DNA, 20 bp, synthetic construct
  source 1..20: mol_type = other DNA
gacgacgataagtcggcttt

SEQ ID NO: 20405 - DNA, 20 bp, synthetic construct
  source 1..20: mol_type = other DNA
aatgggcaaacccgagttct

SEQ ID NO: 20406 - DNA, 20 bp, synthetic construct
  source 1..20: mol_type = other DNA
agcagtttctttcgcctttc

SEQ ID NO: 20407 - DNA, 20 bp, synthetic construct
  source 1..20: mol_type = other DNA
ctcagtgcacttgtcatttc

SEQ ID NO: 20408 - DNA, 20 bp, synthetic construct
  source 1..20: mol_type = other DNA
tatatagaagaagaaatacc

SEQ ID NO: 20409 - DNA, 20 bp, synthetic construct
  source 1..20: mol_type = other DNA
tcaaaactcaccgccgagtc

SEQ ID NO: 20410 - DNA, 20 bp, synthetic construct
  source 1..20: mol_type = other DNA
ccatatcgttctttttgggt

SEQ ID NO: 20411 - DNA, 20 bp, synthetic construct
  source 1..20: mol_type = other DNA
cgtgtagcatttcaataaaa

SEQ ID NO: 20412 - DNA, 20 bp, synthetic construct
  source 1..20: mol_type = other DNA
tatgtcgaatgcgctgtaaa

SEQ ID NO: 20413 - DNA, 20 bp, synthetic construct
  source 1..20: mol_type = other DNA
tgcgacaaaaaaataaacgc

SEQ ID NO: 20414 - DNA, 20 bp, synthetic construct
  source 1..20: mol_type = other DNA
aaaaatccaaacaagcaaat

SEQ ID NO: 20415 - DNA, 20 bp, synthetic construct
  source 1..20: mol_type = other DNA
gtgtgggatttgccagactt

SEQ ID NO: 20416 - DNA, 20 bp, synthetic construct
  source 1..20: mol_type = other DNA
tgccttaatgtatgcaccct

SEQ ID NO: 20417 - DNA, 20 bp, synthetic construct
  source 1..20: mol_type = other DNA
aatgtcaccacgggtaaact

SEQ ID NO: 20418 - DNA, 20 bp, synthetic construct
  source 1..20: mol_type = other DNA
ataacacaggacatcgccgg

SEQ ID NO: 20419 - DNA, 20 bp, synthetic construct
  source 1..20: mol_type = other DNA
ccaacccgctgccccaccca

SEQ ID NO: 20420 - DNA, 20 bp, synthetic construct
  source 1..20: mol_type = other DNA
tctctctacatttctccgcc

SEQ ID NO: 20421 - DNA, 20 bp, synthetic construct
  source 1..20: mol_type = other DNA
taaatttcaagtttttcacc

SEQ ID NO: 20422 - DNA, 20 bp, synthetic construct
  source 1..20: mol_type = other DNA
tcagtctgttccacactacg

SEQ ID NO: 20423 - DNA, 20 bp, synthetic construct
  source 1..20: mol_type = other DNA
tttccgtgtcacggcgcgcg

SEQ ID NO: 20424 - DNA, 20 bp, synthetic construct
  source 1..20: mol_type = other DNA
gaggagtgcgtaatcgcaag

SEQ ID NO: 20425 - DNA, 20 bp, synthetic construct
  source 1..20: mol_type = other DNA
tgtccaacattcgcaggaaa

SEQ ID NO: 20426 - DNA, 20 bp, synthetic construct
  source 1..20: mol_type = other DNA
gtttttagtggcgcttcgag

SEQ ID NO: 20427 - DNA, 20 bp, synthetic construct
  source 1..20: mol_type = other DNA
cgcaaacgggatcgactgcg

SEQ ID NO: 20428 - DNA, 20 bp, synthetic construct
  source 1..20: mol_type = other DNA
tttaatagtcctttttttac

SEQ ID NO: 20429 - DNA, 20 bp, synthetic construct
  source 1..20: mol_type = other DNA
cggagagctgccgagctgag

SEQ ID NO: 20430 - DNA, 20 bp, synthetic construct
  source 1..20: mol_type = other DNA
cagattttttggaagaaatt

SEQ ID NO: 20431 - DNA, 20 bp, synthetic construct
  source 1..20: mol_type = other DNA
aaatcaatcggtgatggagt

SEQ ID NO: 20432 - DNA, 20 bp, synthetic construct
  source 1..20: mol_type = other DNA
atgcaaagacttgcagatga

SEQ ID NO: 20433 - DNA, 20 bp, synthetic construct
  source 1..20: mol_type = other DNA
aaggaacatacactctcgta

SEQ ID NO: 20434 - DNA, 20 bp, synthetic construct
  source 1..20: mol_type = other DNA
caatataaaataaccaacta

SEQ ID NO: 20435 - DNA, 20 bp, synthetic construct
  source 1..20: mol_type = other DNA
cggctagtaatgattctggg

SEQ ID NO: 20436 - DNA, 20 bp, synthetic construct
  source 1..20: mol_type = other DNA
taagcccgtgaatgttttct

SEQ ID NO: 20437 - DNA, 20 bp, synthetic construct
  source 1..20: mol_type = other DNA
gcttgtttcacacggttctg

SEQ ID NO: 20438 - DNA, 20 bp, synthetic construct
  source 1..20: mol_type = other DNA
tatctgtcaaggttgtcaga

SEQ ID NO: 20439 - DNA, 20 bp, synthetic construct
  source 1..20: mol_type = other DNA
ggttgcgattgtcagcatct

SEQ ID NO: 20440 - DNA, 20 bp, synthetic construct
  source 1..20: mol_type = other DNA
gctcatacaaaagttcaaga

SEQ ID NO: 20441 - DNA, 20 bp, synthetic construct
  source 1..20: mol_type = other DNA
aggatcaggtatagaggtta

SEQ ID NO: 20442 - DNA, 20 bp, synthetic construct
  source 1..20: mol_type = other DNA
cgaaacggatgagccgatga

SEQ ID NO: 20443 - DNA, 20 bp, synthetic construct
  source 1..20: mol_type = other DNA
agggcatttaaagccaaatt

SEQ ID NO: 20444 - DNA, 20 bp, synthetic construct
  source 1..20: mol_type = other DNA
gagctcgtttgtctctgtag

SEQ ID NO: 20445 - DNA, 20 bp, synthetic construct
  source 1..20: mol_type = other DNA
tagccagggcattcacaatc

SEQ ID NO: 20446 - DNA, 20 bp, synthetic construct
  source 1..20: mol_type = other DNA
tcaaagaatagcagaaccct

SEQ ID NO: 20447 - DNA, 20 bp, synthetic construct
  source 1..20: mol_type = other DNA
tttgtggaacgttgttcccg

SEQ ID NO: 20448 - DNA, 20 bp, synthetic construct
  source 1..20: mol_type = other DNA
tgatcccgccctcgtctgtt

SEQ ID NO: 20449 - DNA, 20 bp, synthetic construct
  source 1..20: mol_type = other DNA
attgtgagaacagcgcataa

SEQ ID NO: 20450 - DNA, 20 bp, synthetic construct
  source 1..20: mol_type = other DNA
tttaggtaaaatttcggtcg

SEQ ID NO: 20451 - DNA, 20 bp, synthetic construct
  source 1..20: mol_type = other DNA
acaaaaaaatacacacataa

SEQ ID NO: 20452 - DNA, 20 bp, synthetic construct
  source 1..20: mol_type = other DNA
tggagggatataggggtgtg

SEQ ID NO: 20453 - DNA, 20 bp, synthetic construct
  source 1..20: mol_type = other DNA
aaatatgcggtcgagggggg

SEQ ID NO: 20454 - DNA, 20 bp, synthetic construct
  source 1..20: mol_type = other DNA
cgagagcgtttggaaaactc

SEQ ID NO: 20455 - DNA, 20 bp, synthetic construct
  source 1..20: mol_type = other DNA
ggtctgccgtgtttggatat

SEQ ID NO: 20456 - DNA, 20 bp, synthetic construct
  source 1..20: mol_type = other DNA
ccattttacccaagtagcct

SEQ ID NO: 20457 - DNA, 20 bp, synthetic construct
  source 1..20: mol_type = other DNA
agcgtcgagtcggttttaag

SEQ ID NO: 20458 - DNA, 20 bp, synthetic construct
  source 1..20: mol_type = other DNA
atacaatggtttggctcgtg

SEQ ID NO: 20459 - DNA, 20 bp, synthetic construct
  source 1..20: mol_type = other DNA
ccccattacaacaaggataa

SEQ ID NO: 20460 - DNA, 20 bp, synthetic construct
  source 1..20: mol_type = other DNA
cgaattgcgtggttttaagt

SEQ ID NO: 20461 - DNA, 20 bp, synthetic construct
  source 1..20: mol_type = other DNA
gaacgtttcctagccacacc

SEQ ID NO: 20462 - DNA, 20 bp, synthetic construct
  source 1..20: mol_type = other DNA
ttaacaaaacccgcgccttt

SEQ ID NO: 20463 - DNA, 20 bp, synthetic construct
  source 1..20: mol_type = other DNA
ttacatatgattactttttc

SEQ ID NO: 20464 - DNA, 20 bp, synthetic construct
  source 1..20: mol_type = other DNA
gctgtgaaacctttcacaag

SEQ ID NO: 20465 - DNA, 20 bp, synthetic construct
  source 1..20: mol_type = other DNA
aagatacaggcaactgcaaa

SEQ ID NO: 20466 - DNA, 20 bp, synthetic construct
  source 1..20: mol_type = other DNA
ctgttgttgctagtattttc

SEQ ID NO: 20467 - DNA, 20 bp, synthetic construct
  source 1..20: mol_type = other DNA
aaccgtgtgatactacatcg

SEQ ID NO: 20468 - DNA, 20 bp, synthetic construct
  source 1..20: mol_type = other DNA
atgcttaatacatggggaaa

SEQ ID NO: 20469 - DNA, 20 bp, synthetic construct
  source 1..20: mol_type = other DNA
cagggcggctccttgggggt

SEQ ID NO: 20470 - DNA, 20 bp, synthetic construct
  source 1..20: mol_type = other DNA
tttaatttattaataaaaat

SEQ ID NO: 20471 - DNA, 20 bp, synthetic construct
  source 1..20: mol_type = other DNA
ctgttccgcatttaaaggtt

SEQ ID NO: 20472 - DNA, 20 bp, synthetic construct
  source 1..20: mol_type = other DNA
gcctccacaccgtgagtatt

SEQ ID NO: 20473 - DNA, 20 bp, synthetic construct
  source 1..20: mol_type = other DNA
gtaccggtttatattcacgc

SEQ ID NO: 20474 - DNA, 20 bp, synthetic construct
  source 1..20: mol_type = other DNA
ggttgtttttccaattccat

SEQ ID NO: 20475 - DNA, 20 bp, synthetic construct
  source 1..20: mol_type = other DNA
ctttttgagtacatcgtaaa

SEQ ID NO: 20476 - DNA, 20 bp, synthetic construct
  source 1..20: mol_type = other DNA
agttccgtcccagaagataa

SEQ ID NO: 20477 - DNA, 20 bp, synthetic construct
  source 1..20: mol_type = other DNA
tcacgggacggcaagttcga

SEQ ID NO: 20478 - DNA, 20 bp, synthetic construct
  source 1..20: mol_type = other DNA
caccccaagcccgcgtctcg

SEQ ID NO: 20479 - DNA, 20 bp, synthetic construct
  source 1..20: mol_type = other DNA
tatttataattaccgccccc

SEQ ID NO: 20480 - DNA, 20 bp, synthetic construct
  source 1..20: mol_type = other DNA
cttcctcttccgcgataatt

SEQ ID NO: 20481 - DNA, 20 bp, synthetic construct
  source 1..20: mol_type = other DNA
gcctgacatgaccaaagtga

SEQ ID NO: 20482 - DNA, 20 bp, synthetic construct
  source 1..20: mol_type = other DNA
cgtacatatttctttttttt

SEQ ID NO: 20483 - DNA, 20 bp, synthetic construct
  source 1..20: mol_type = other DNA
accagaatctcttcatatgt

SEQ ID NO: 20484 - DNA, 20 bp, synthetic construct
  source 1..20: mol_type = other DNA
caatgacatttaacatcaat

SEQ ID NO: 20485 - DNA, 20 bp, synthetic construct
  source 1..20: mol_type = other DNA
aaagacacaggaaacaacgc

SEQ ID NO: 20486 - DNA, 20 bp, synthetic construct
  source 1..20: mol_type = other DNA
ccaattgcagttccaggcta

SEQ ID NO: 20487 - DNA, 20 bp, synthetic construct
  source 1..20: mol_type = other DNA
tactggacgcatagacggcg

SEQ ID NO: 20488 - DNA, 20 bp, synthetic construct
  source 1..20: mol_type = other DNA
cgtacggcgagactttttca

SEQ ID NO: 20489 - DNA, 20 bp, synthetic construct
  source 1..20: mol_type = other DNA
aacggggcggtaaattttga

SEQ ID NO: 20490 - DNA, 20 bp, synthetic construct
  source 1..20: mol_type = other DNA
cgcagaaattagcgatcaca

SEQ ID NO: 20491 - DNA, 20 bp, synthetic construct
  source 1..20: mol_type = other DNA
tcgccattgtcccgtgttcc

SEQ ID NO: 20492 - DNA, 20 bp, synthetic construct
  source 1..20: mol_type = other DNA
tggtgtacgtgttaactatg

SEQ ID NO: 20493 - DNA, 20 bp, synthetic construct
  source 1..20: mol_type = other DNA
ggtggtaactacctgctgta

SEQ ID NO: 20494 - DNA, 20 bp, synthetic construct
  source 1..20: mol_type = other DNA
acacacacacagtatataag

SEQ ID NO: 20495 - DNA, 20 bp, synthetic construct
  source 1..20: mol_type = other DNA
ggcgtcacctaaatctaaaa

SEQ ID NO: 20496 - DNA, 20 bp, synthetic construct
  source 1..20: mol_type = other DNA
ggtcggggcgctttttttgt

SEQ ID NO: 20497 - DNA, 20 bp, synthetic construct
  source 1..20: mol_type = other DNA
tgtttcgcgcacacgcagaa

SEQ ID NO: 20498 - DNA, 20 bp, synthetic construct
  source 1..20: mol_type = other DNA
tgaattgcaggaaatagatt

SEQ ID NO: 20499 - DNA, 20 bp, synthetic construct
  source 1..20: mol_type = other DNA
aaaaaacgcaaacgtgttta

SEQ ID NO: 20500 - DNA, 20 bp, synthetic construct
  source 1..20: mol_type = other DNA
gtgcatagaattggcgggat

SEQ ID NO: 20501 - DNA, 20 bp, synthetic construct
  source 1..20: mol_type = other DNA
agagagtcagtgtccatttt

SEQ ID NO: 20502 - DNA, 20 bp, synthetic construct
  source 1..20: mol_type = other DNA
ggtcaacagtcaccttgacc

SEQ ID NO: 20503 - DNA, 20 bp, synthetic construct
  source 1..20: mol_type = other DNA
atcatacgatttgtatgcgt

SEQ ID NO: 20504 - DNA, 20 bp, synthetic construct
  source 1..20: mol_type = other DNA
cacgcctgtgtcgagcagaa

SEQ ID NO: 20505 - DNA, 20 bp, synthetic construct
  source 1..20: mol_type = other DNA
aacggttcaaccgaaaacgg

SEQ ID NO: 20506 - DNA, 20 bp, synthetic construct
  source 1..20: mol_type = other DNA
aacagtttttagatgttgta

SEQ ID NO: 20507 - DNA, 20 bp, synthetic construct
  source 1..20: mol_type = other DNA
tactgtcccgcattgtatat

SEQ ID NO: 20508 - DNA, 20 bp, synthetic construct
  source 1..20: mol_type = other DNA
agagtaaaccgttttttata

SEQ ID NO: 20509 - DNA, 20 bp, synthetic construct
  source 1..20: mol_type = other DNA
aagctaaattgtacgtggaa

SEQ ID NO: 20510 - DNA, 20 bp, synthetic construct
  source 1..20: mol_type = other DNA
gtattttgcacgtaaacgcc

SEQ ID NO: 20511 - DNA, 20 bp, synthetic construct
  source 1..20: mol_type = other DNA
acactaaacatagtgtgtcc

SEQ ID NO: 20512 - DNA, 20 bp, synthetic construct
  source 1..20: mol_type = other DNA
agaagtaagcctataaaata

SEQ ID NO: 20513 - DNA, 20 bp, synthetic construct
  source 1..20: mol_type = other DNA
ttcccctcctacccccacat

SEQ ID NO: 20514 - DNA, 20 bp, synthetic construct
  source 1..20: mol_type = other DNA
ggattttgagttacatccta

SEQ ID NO: 20515 - DNA, 20 bp, synthetic construct
  source 1..20: mol_type = other DNA
ttcctgtgcctattgcgaga

SEQ ID NO: 20516 - DNA, 20 bp, synthetic construct
  source 1..20: mol_type = other DNA
atctttgaacatcgtgtgcc

SEQ ID NO: 20517 - DNA, 20 bp, synthetic construct
  source 1..20: mol_type = other DNA
agggaggagagcgaaggagg

SEQ ID NO: 20518 - DNA, 20 bp, synthetic construct
  source 1..20: mol_type = other DNA
caatcagtcacaaacttaca

SEQ ID NO: 20519 - DNA, 20 bp, synthetic construct
  source 1..20: mol_type = other DNA
ggtcttggttttctcttttt

SEQ ID NO: 20520 - DNA, 20 bp, synthetic construct
  source 1..20: mol_type = other DNA
acaaccacgccgacgcggag

SEQ ID NO: 20521 - DNA, 20 bp, synthetic construct
  source 1..20: mol_type = other DNA
ggttgaggaacctgttaaga

SEQ ID NO: 20522 - DNA, 20 bp, synthetic construct
  source 1..20: mol_type = other DNA
gaaccggaaaggcgggccag

SEQ ID NO: 20523 - DNA, 20 bp, synthetic construct
  source 1..20: mol_type = other DNA
acgcagggtctccattttga

SEQ ID NO: 20524 - DNA, 20 bp, synthetic construct
  source 1..20: mol_type = other DNA
ccaattctgatgcgccggtg

SEQ ID NO: 20525 - DNA, 20 bp, synthetic construct
  source 1..20: mol_type = other DNA
tgagcagtccaccccaggcg

SEQ ID NO: 20526 - DNA, 20 bp, synthetic construct
  source 1..20: mol_type = other DNA
gtataggtctctacatcgta

SEQ ID NO: 20527 - DNA, 20 bp, synthetic construct
  source 1..20: mol_type = other DNA
cagatatgctcttgcatagg

SEQ ID NO: 20528 - DNA, 20 bp, synthetic construct
  source 1..20: mol_type = other DNA
gcgtaccactgtggccaggc

SEQ ID NO: 20529 - DNA, 20 bp, synthetic construct
  source 1..20: mol_type = other DNA
cgagacgggtctttggagcg

SEQ ID NO: 20530 - DNA, 20 bp, synthetic construct
  source 1..20: mol_type = other DNA
cccgacgaccaccccaggca

SEQ ID NO: 20531 - DNA, 20 bp, synthetic construct
  source 1..20: mol_type = other DNA
aaacaaaaaattgaaaagtg

SEQ ID NO: 20532 - DNA, 20 bp, synthetic construct
  source 1..20: mol_type = other DNA
tctgttggtacccgttagga

SEQ ID NO: 20533 - DNA, 20 bp, synthetic construct
  source 1..20: mol_type = other DNA
tggaggaaagccaattggct

SEQ ID NO: 20534 - DNA, 20 bp, synthetic construct
  source 1..20: mol_type = other DNA
tcggcgccctctagcggcca

SEQ ID NO: 20535 - DNA, 20 bp, synthetic construct
  source 1..20: mol_type = other DNA
gacccaccccctcggcggcg

SEQ ID NO: 20536 - DNA, 20 bp, synthetic construct
  source 1..20: mol_type = other DNA
cccggccctagtcgaagcct

SEQ ID NO: 20537 - DNA, 20 bp, synthetic construct
  source 1..20: mol_type = other DNA
atgcccaaagaacgacggtc

SEQ ID NO: 20538 - DNA, 20 bp, synthetic construct
  source 1..20: mol_type = other DNA
ctactgctattgagcaggct

SEQ ID NO: 20539 - DNA, 20 bp, synthetic construct
  source 1..20: mol_type = other DNA
tcaatcctgtgtcgggtgga

SEQ ID NO: 20540 - DNA, 20 bp, synthetic construct
  source 1..20: mol_type = other DNA
ggtggaatgaataacatgtc

SEQ ID NO: 20541 - DNA, 20 bp, synthetic construct
  source 1..20: mol_type = other DNA
cgaacagggacctgagaggg

SEQ ID NO: 20542 - DNA, 20 bp, synthetic construct
  source 1..20: mol_type = other DNA
aagtcttctggaggtgttcc

SEQ ID NO: 20543 - DNA, 20 bp, synthetic construct
  source 1..20: mol_type = other DNA
gtaattagggaagcacagat

SEQ ID NO: 20544 - DNA, 20 bp, synthetic construct
  source 1..20: mol_type = other DNA
cctggatctccagatacgga

SEQ ID NO: 20545 - DNA, 20 bp, synthetic construct
  source 1..20: mol_type = other DNA
ggacgaagactgagtttccc

SEQ ID NO: 20546 - DNA, 20 bp, synthetic construct
  source 1..20: mol_type = other DNA
gtccgccgccgctcaaggcg

SEQ ID NO: 20547 - DNA, 20 bp, synthetic construct
  source 1..20: mol_type = other DNA
taccaccctagcattctcgt

SEQ ID NO: 20548 - DNA, 20 bp, synthetic construct
  source 1..20: mol_type = other DNA
gttgattcccatcatcgccg

SEQ ID NO: 20549 - DNA, 20 bp, synthetic construct
  source 1..20: mol_type = other DNA
cgtacgccgttctcggccgg

SEQ ID NO: 20550 - DNA, 20 bp, synthetic construct
  source 1..20: mol_type = other DNA
ctccacttgctcattttcct

SEQ ID NO: 20551 - DNA, 20 bp, synthetic construct
  source 1..20: mol_type = other DNA
ctaaacacccgcgctttttt

SEQ ID NO: 20552 - DNA, 20 bp, synthetic construct
  source 1..20: mol_type = other DNA
tgtggacggctacgactgaa

SEQ ID NO: 20553 - DNA, 20 bp, synthetic construct
  source 1..20: mol_type = other DNA
ctccttccccttactactta

SEQ ID NO: 20554 - DNA, 20 bp, synthetic construct
  source 1..20: mol_type = other DNA
actgccatctgcagcattgc

SEQ ID NO: 20555 - DNA, 20 bp, synthetic construct
  source 1..20: mol_type = other DNA
gcagcgcgctccatcagtta

SEQ ID NO: 20556 - DNA, 20 bp, synthetic construct
  source 1..20: mol_type = other DNA
agacggggttgaagtcgtct

SEQ ID NO: 20557 - DNA, 20 bp, synthetic construct
  source 1..20: mol_type = other DNA
acagtgggtatgcttttacg

SEQ ID NO: 20558 - DNA, 20 bp, synthetic construct
  source 1..20: mol_type = other DNA
cttcgtgacttgcactttgg

SEQ ID NO: 20559 - DNA, 20 bp, synthetic construct
  source 1..20: mol_type = other DNA
ctgtttccatcacgctttcg

SEQ ID NO: 20560 - DNA, 20 bp, synthetic construct
  source 1..20: mol_type = other DNA
ccagctttttccttataaaa

SEQ ID NO: 20561 - DNA, 20 bp, synthetic construct
  source 1..20: mol_type = other DNA
tgaggtaatctatgatgagg

SEQ ID NO: 20562 - DNA, 20 bp, synthetic construct
  source 1..20: mol_type = other DNA
gggtaccatagcgaggaacc

SEQ ID NO: 20563 - DNA, 20 bp, synthetic construct
  source 1..20: mol_type = other DNA
gacccccagacacggagagg

SEQ ID NO: 20564 - DNA, 20 bp, synthetic construct
  source 1..20: mol_type = other DNA
gatgacgaagaccagtacga

SEQ ID NO: 20565 - DNA, 20 bp, synthetic construct
  source 1..20: mol_type = other DNA
attccacttattgctgcggc

SEQ ID NO: 20566 - DNA, 20 bp, synthetic construct
  source 1..20: mol_type = other DNA
ggcgggtaacgctaccacct

SEQ ID NO: 20567 - DNA, 20 bp, synthetic construct
  source 1..20: mol_type = other DNA
gtgcgtcttggggtatgagt

SEQ ID NO: 20568 - DNA, 20 bp, synthetic construct
  source 1..20: mol_type = other DNA
cctgtggctccagatccatc

SEQ ID NO: 20569 - DNA, 20 bp, synthetic construct
  source 1..20: mol_type = other DNA
gttcttcttcgctttcggaa

SEQ ID NO: 20570 - DNA, 20 bp, synthetic construct
  source 1..20: mol_type = other DNA
atacccaactttgacgcagt

SEQ ID NO: 20571 - DNA, 20 bp, synthetic construct
  source 1..20: mol_type = other DNA
tgtcagaataacagttgaaa

SEQ ID NO: 20572 - DNA, 20 bp, synthetic construct
  source 1..20: mol_type = other DNA
aggaataattggcttcagca

SEQ ID NO: 20573 - DNA, 20 bp, synthetic construct
  source 1..20: mol_type = other DNA
gaagaagtaaaagggggtgt

SEQ ID NO: 20574 - DNA, 20 bp, synthetic construct
  source 1..20: mol_type = other DNA
tctgtttcttcagcatactg

SEQ ID NO: 20575 - DNA, 20 bp, synthetic construct
  source 1..20: mol_type = other DNA
gcgagagtggttgtactttg

SEQ ID NO: 20576 - DNA, 20 bp, synthetic construct
  source 1..20: mol_type = other DNA
ctgttgttgaacatttggaa

SEQ ID NO: 20577 - DNA, 20 bp, synthetic construct
  source 1..20: mol_type = other DNA
tcattccgacgtgttttgcg

SEQ ID NO: 20578 - DNA, 20 bp, synthetic construct
  source 1..20: mol_type = other DNA
ttaccctgtcttgcctgcgg

SEQ ID NO: 20579 - DNA, 20 bp, synthetic construct
  source 1..20: mol_type = other DNA
gctaaaggccacgctacaga

SEQ ID NO: 20580 - DNA, 20 bp, synthetic construct
  source 1..20: mol_type = other DNA
tagggtggcgccgctgccat

SEQ ID NO: 20581 - DNA, 20 bp, synthetic construct
  source 1..20: mol_type = other DNA
cagaggcccactgtattgct

SEQ ID NO: 20582 - DNA, 20 bp, synthetic construct
  source 1..20: mol_type = other DNA
tgtgtttcaagtattgccat

SEQ ID NO: 20583 - DNA, 20 bp, synthetic construct
  source 1..20: mol_type = other DNA
gagacacataaggagagttc

SEQ ID NO: 20584 - DNA, 20 bp, synthetic construct
  source 1..20: mol_type = other DNA
gacggctccccccggtggat

SEQ ID NO: 20585 - DNA, 20 bp, synthetic construct
  source 1..20: mol_type = other DNA
tatgccacgatccagtggtt

SEQ ID NO: 20586 - DNA, 20 bp, synthetic construct
  source 1..20: mol_type = other DNA
cctaatttgtgcccacgctg

SEQ ID NO: 20587 - DNA, 20 bp, synthetic construct
  source 1..20: mol_type = other DNA
ccggtttcgggaaactgggt

SEQ ID NO: 20588 - DNA, 20 bp, synthetic construct
  source 1..20: mol_type = other DNA
gcgcccaacgtggggctcga

SEQ ID NO: 20589 - DNA, 20 bp, synthetic construct
  source 1..20: mol_type = other DNA
ccagcgtttttggggagaac

SEQ ID NO: 20590 - DNA, 20 bp, synthetic construct
  source 1..20: mol_type = other DNA
cacacagccgccagccaacc

SEQ ID NO: 20591 - DNA, 20 bp, synthetic construct
  source 1..20: mol_type = other DNA
gccgaggaccagaacaacat

SEQ ID NO: 20592 - DNA, 20 bp, synthetic construct
  source 1..20: mol_type = other DNA
aacgatatcggtagttaatt

SEQ ID NO: 20593 - DNA, 20 bp, synthetic construct
  source 1..20: mol_type = other DNA
tagacatcagaattaagaaa

SEQ ID NO: 20594 - DNA, 20 bp, synthetic construct
  source 1..20: mol_type = other DNA
gtcttcatcccctctcctgc

SEQ ID NO: 20595 - DNA, 20 bp, synthetic construct
  source 1..20: mol_type = other DNA
gagcatttcaaaggtctgca

SEQ ID NO: 20596 - DNA, 20 bp, synthetic construct
  source 1..20: mol_type = other DNA
acactccttatgaccctgag

SEQ ID NO: 20597 - DNA, 20 bp, synthetic construct
  source 1..20: mol_type = other DNA
gtaaaagcggcgacaacccc

SEQ ID NO: 20598 - DNA, 20 bp, synthetic construct
  source 1..20: mol_type = other DNA
ttctgtgttgtctctgtctg

SEQ ID NO: 20599 - DNA, 20 bp, synthetic construct
  source 1..20: mol_type = other DNA
cacgtgaaggctgccgaccc

SEQ ID NO: 20600 - DNA, 20 bp, synthetic construct
  source 1..20: mol_type = other DNA
tctggcggcagcctaccaag

SEQ ID NO: 20601 - DNA, 20 bp, synthetic construct
  source 1..20: mol_type = other DNA
tccatcgagccagtgtagag

SEQ ID NO: 20602 - DNA, 20 bp, synthetic construct
  source 1..20: mol_type = other DNA
atttctactattttgtgttc

SEQ ID NO: 20603 - DNA, 20 bp, synthetic construct
  source 1..20: mol_type = other DNA
gcagtctcgcctacagagaa

SEQ ID NO: 20604 - DNA, 20 bp, synthetic construct
  source 1..20: mol_type = other DNA
tataggtgttggagccctgc

SEQ ID NO: 20605 - DNA, 20 bp, synthetic construct
  source 1..20: mol_type = other DNA
cttgcaaaatggcgttactg

SEQ ID NO: 20606 - DNA, 20 bp, synthetic construct
  source 1..20: mol_type = other DNA
tttgtcatttgtctggttcg

SEQ ID NO: 20607 - DNA, 20 bp, synthetic construct
  source 1..20: mol_type = other DNA
aaggcgctgctgggggacag

SEQ ID NO: 20608 - DNA, 20 bp, synthetic construct
  source 1..20: mol_type = other DNA
aaggcagcgctagtaagaaa

SEQ ID NO: 20609 - DNA, 20 bp, synthetic construct
  source 1..20: mol_type = other DNA
ccttggtctatacaggattg

SEQ ID NO: 20610 - DNA, 20 bp, synthetic construct
  source 1..20: mol_type = other DNA
caggtagctggcgtctttta

SEQ ID NO: 20611 - DNA, 20 bp, synthetic construct
  source 1..20: mol_type = other DNA
tggctccctgagcgactaat

SEQ ID NO: 20612 - DNA, 20 bp, synthetic construct
  source 1..20: mol_type = other DNA
ccaaaaggctcgccctgagg

SEQ ID NO: 20613 - DNA, 20 bp, synthetic construct
  source 1..20: mol_type = other DNA
gtaaccggttccctgcacgg

SEQ ID NO: 20614 - DNA, 20 bp, synthetic construct
  source 1..20: mol_type = other DNA
gttcgttcctcatttcgacg

SEQ ID NO: 20615 - DNA, 20 bp, synthetic construct
  source 1..20: mol_type = other DNA
gacgtggtccagattaagtt

SEQ ID NO: 20616 - DNA, 20 bp, synthetic construct
  source 1..20: mol_type = other DNA
atatagtaaaaataaagtat

SEQ ID NO: 20617 - DNA, 20 bp, synthetic construct
  source 1..20: mol_type = other DNA
tttgttgcaagtgtgactct

SEQ ID NO: 20618 - DNA, 20 bp, synthetic construct
  source 1..20: mol_type = other DNA
tgctgacgatgcgaaaagat

SEQ ID NO: 20619 - DNA, 20 bp, synthetic construct
  source 1..20: mol_type = other DNA
acaaacaccacccccgcgac

SEQ ID NO: 20620 - DNA, 20 bp, synthetic construct
  source 1..20: mol_type = other DNA
gaggaacgcctggaagggaa

SEQ ID NO: 20621 - DNA, 20 bp, synthetic construct
  source 1..20: mol_type = other DNA
cggagatctgcagctcctgt

SEQ ID NO: 20622 - DNA, 20 bp, synthetic construct
  source 1..20: mol_type = other DNA
catgactcacagggaggagc

SEQ ID NO: 20623 - DNA, 20 bp, synthetic construct
  source 1..20: mol_type = other DNA
aaagactcctaggtaagtaa

SEQ ID NO: 20624 - DNA, 20 bp, synthetic construct
  source 1..20: mol_type = other DNA
ctggggctattgctgggttt

SEQ ID NO: 20625 - DNA, 20 bp, synthetic construct
  source 1..20: mol_type = other DNA
gatgtcctaaagtcaacatg

SEQ ID NO: 20626 - DNA, 20 bp, synthetic construct
  source 1..20: mol_type = other DNA
tcacaatcatctcgtgtttc

SEQ ID NO: 20627 - DNA, 20 bp, synthetic construct
  source 1..20: mol_type = other DNA
tcagaagaacaactggcaac

SEQ ID NO: 20628 - DNA, 20 bp, synthetic construct
  source 1..20: mol_type = other DNA
tattgcaaaaaatgctgtta

SEQ ID NO: 20629 - DNA, 20 bp, synthetic construct
  source 1..20: mol_type = other DNA
cctgaccctcctcatattca

SEQ ID NO: 20630 - DNA, 20 bp, synthetic construct
  source 1..20: mol_type = other DNA
tcaggtagggtgagagccta

SEQ ID NO: 20631 - DNA, 20 bp, synthetic construct
  source 1..20: mol_type = other DNA
tatgtggtagcctgtacgga

SEQ ID NO: 20632 - DNA, 20 bp, synthetic construct
  source 1..20: mol_type = other DNA
ttctttttctatttttgttt

SEQ ID NO: 20633 - DNA, 20 bp, synthetic construct
  source 1..20: mol_type = other DNA
aaaatatcagggtactggag

SEQ ID NO: 20634 - DNA, 20 bp, synthetic construct
  source 1..20: mol_type = other DNA
aaatgtaacaattccctttg

SEQ ID NO: 20635 - DNA, 20 bp, synthetic construct
  source 1..20: mol_type = other DNA
atatgtgcccctgtcacctg

SEQ ID NO: 20636 - DNA, 20 bp, synthetic construct
  source 1..20: mol_type = other DNA
cttctcccgacatcgtcgcc

SEQ ID NO: 20637 - DNA, 20 bp, synthetic construct
  source 1..20: mol_type = other DNA
tactaggcacattgaagctc

SEQ ID NO: 20638 - DNA, 20 bp, synthetic construct
  source 1..20: mol_type = other DNA
tactgtaatggtaattgcta

SEQ ID NO: 20639 - DNA, 20 bp, synthetic construct
  source 1..20: mol_type = other DNA
acaatgttgtatgtgtaata

SEQ ID NO: 20640 - DNA, 20 bp, synthetic construct
  source 1..20: mol_type = other DNA
gtctccgccctttattagta

SEQ ID NO: 20641 - DNA, 20 bp, synthetic construct
  source 1..20: mol_type = other DNA
ggttgtacacagtgtggacg

SEQ ID NO: 20642 - DNA, 20 bp, synthetic construct
  source 1..20: mol_type = other DNA
acactgggcattgtgtgtcc

SEQ ID NO: 20643 - DNA, 20 bp, synthetic construct
  source 1..20: mol_type = other DNA
ttttaccccaactgtacctg

SEQ ID NO: 20644 - DNA, 20 bp, synthetic construct
  source 1..20: mol_type = other DNA
aataggtttaggaccgaaaa

SEQ ID NO: 20645 - DNA, 20 bp, synthetic construct
  source 1..20: mol_type = other DNA
cgaaaacggtacatataaaa

SEQ ID NO: 20646 - DNA, 20 bp, synthetic construct
  source 1..20: mol_type = other DNA
aacatagtgtgtgtagcaga

SEQ ID NO: 20647 - DNA, 20 bp, synthetic construct
  source 1..20: mol_type = other DNA
gacatggtccagattagatt

SEQ ID NO: 20648 - DNA, 20 bp, synthetic construct
  source 1..20: mol_type = other DNA
cataaccacatttacactat

SEQ ID NO: 20649 - DNA, 20 bp, synthetic construct
  source 1..20: mol_type = other DNA
ataaatcacagtttttttgt

SEQ ID NO: 20650 - DNA, 20 bp, synthetic construct
  source 1..20: mol_type = other DNA
ttttttgaaacgtaggcgtc

SEQ ID NO: 20651 - DNA, 20 bp, synthetic construct
  source 1..20: mol_type = other DNA
ctgacatgctggagacacac

SEQ ID NO: 20652 - DNA, 20 bp, synthetic construct
  source 1..20: mol_type = other DNA
cagtgttgtaggtgtgagtc

SEQ ID NO: 20653 - DNA, 20 bp, synthetic construct
  source 1..20: mol_type = other DNA
agggtccgaccgaaaacggt

SEQ ID NO: 20654 - DNA, 20 bp, synthetic construct
  source 1..20: mol_type = other DNA
tcctgcaggtacaccatatt

SEQ ID NO: 20655 - DNA, 20 bp, synthetic construct
  source 1..20: mol_type = other DNA
tgcatactatttcagaaaac

SEQ ID NO: 20656 - DNA, 20 bp, synthetic construct
  source 1..20: mol_type = other DNA
cattgtgtattttgtcactg

SEQ ID NO: 20657 - DNA, 20 bp, synthetic construct
  source 1..20: mol_type = other DNA
ggcattgctactaacccata

SEQ ID NO: 20658 - DNA, 20 bp, synthetic construct
  source 1..20: mol_type = other DNA
cgtagctggctgtggttgcg

SEQ ID NO: 20659 - DNA, 20 bp, synthetic construct
  source 1..20: mol_type = other DNA
cgttgcctttcagtacagtc

SEQ ID NO: 20660 - DNA, 20 bp, synthetic construct
  source 1..20: mol_type = other DNA
gaatatattctcatatcact

SEQ ID NO: 20661 - DNA, 20 bp, synthetic construct
  source 1..20: mol_type = other DNA
tgcccataatccaatgggtt

SEQ ID NO: 20662 - DNA, 20 bp, synthetic construct
  source 1..20: mol_type = other DNA
ctcctcgcttcggtctcccc

SEQ ID NO: 20663 - DNA, 20 bp, synthetic construct
  source 1..20: mol_type = other DNA
cttagtctgtaagttttggg

SEQ ID NO: 20664 - DNA, 20 bp, synthetic construct
  source 1..20: mol_type = other DNA
cgtaaattaatggtgtctac

SEQ ID NO: 20665 - DNA, 20 bp, synthetic construct
  source 1..20: mol_type = other DNA
cagcgaaccgattttcgatt

SEQ ID NO: 20666 - DNA, 20 bp, synthetic construct
  source 1..20: mol_type = other DNA
tgcacagagcatcagcaaat

SEQ ID NO: 20667 - DNA, 20 bp, synthetic construct
  source 1..20: mol_type = other DNA
ggatttatatgggaatattc

SEQ ID NO: 20668 - DNA, 20 bp, synthetic construct
  source 1..20: mol_type = other DNA
aagatgttgttcccgtcgtg

SEQ ID NO: 20669 - DNA, 20 bp, synthetic construct
  source 1..20: mol_type = other DNA
aacaaaaatgcaaacaagga

SEQ ID NO: 20670 - DNA, 20 bp, synthetic construct
  source 1..20: mol_type = other DNA
cttattttccgtatacaact

SEQ ID NO: 20671 - DNA, 20 bp, synthetic construct
  source 1..20: mol_type = other DNA
cactaatcctcgcatccgca

SEQ ID NO: 20672 - DNA, 20 bp, synthetic construct
  source 1..20: mol_type = other DNA
gccccgcttgtttctacact

SEQ ID NO: 20673 - DNA, 20 bp, synthetic construct
  source 1..20: mol_type = other DNA
tcgacatcgcgggcggcaaa

SEQ ID NO: 20674 - DNA, 20 bp, synthetic construct
  source 1..20: mol_type = other DNA
gttccggcttctgtattgca

SEQ ID NO: 20675 - DNA, 20 bp, synthetic construct
  source 1..20: mol_type = other DNA
gtttgctttggatccgttgt

SEQ ID NO: 20676 - DNA, 20 bp, synthetic construct
  source 1..20: mol_type = other DNA
tcattttgtgtaattggtat

SEQ ID NO: 20677 - DNA, 20 bp, synthetic construct
  source 1..20: mol_type = other DNA
aaaataaccaactacatggt

SEQ ID NO: 20678 - DNA, 20 bp, synthetic construct
  source 1..20: mol_type = other DNA
tcggggttagtcgattaata

SEQ ID NO: 20679 - DNA, 20 bp, synthetic construct
  source 1..20: mol_type = other DNA
cgatagatatatattttctc

SEQ ID NO: 20680 - DNA, 20 bp, synthetic construct
  source 1..20: mol_type = other DNA
acaggagagtataaagcagt

SEQ ID NO: 20681 - DNA, 20 bp, synthetic construct
  source 1..20: mol_type = other DNA
cgatgctccggtctatgact

SEQ ID NO: 20682 - DNA, 20 bp, synthetic construct
  source 1..20: mol_type = other DNA
gacttctacataggatacta

SEQ ID NO: 20683 - DNA, 20 bp, synthetic construct
  source 1..20: mol_type = other DNA
agaatgtaaaagaggcagag

SEQ ID NO: 20684 - DNA, 20 bp, synthetic construct
  source 1..20: mol_type = other DNA
agaatgtgtgactaaaatag

SEQ ID NO: 20685 - DNA, 20 bp, synthetic construct
  source 1..20: mol_type = other DNA
cctaacagtcgtagtatcct

SEQ ID NO: 20686 - DNA, 20 bp, synthetic construct
  source 1..20: mol_type = other DNA
ttgttttccatttttaattt

SEQ ID NO: 20687 - DNA, 20 bp, synthetic construct
  source 1..20: mol_type = other DNA
cagtatttaaaaagggagat

SEQ ID NO: 20688 - DNA, 20 bp, synthetic construct
  source 1..20: mol_type = other DNA
tcctaatgtgcagtcaggtg

SEQ ID NO: 20689 - DNA, 20 bp, synthetic construct
  source 1..20: mol_type = other DNA
tcagaaggtacctaaccaag

SEQ ID NO: 20690 - DNA, 20 bp, synthetic construct
  source 1..20: mol_type = other DNA
gaaagttaactggtaagttt

SEQ ID NO: 20691 - DNA, 20 bp, synthetic construct
  source 1..20: mol_type = other DNA
tagcagcggttggtttgaaa

SEQ ID NO: 20692 - DNA, 20 bp, synthetic construct
  source 1..20: mol_type = other DNA
agagctttgtttattttgtc

SEQ ID NO: 20693 - DNA, 20 bp, synthetic construct
  source 1..20: mol_type = other DNA
tgaaatcgcaattcgctgtg

SEQ ID NO: 20694 - DNA, 20 bp, synthetic construct
  source 1..20: mol_type = other DNA
tacgtgtaagcattgtcatt

SEQ ID NO: 20695 - DNA, 20 bp, synthetic construct
  source 1..20: mol_type = other DNA
cgaaatgggattgttattaa

SEQ ID NO: 20696 - DNA, 20 bp, synthetic construct
  source 1..20: mol_type = other DNA
acatttggaacattaaactc

SEQ ID NO: 20697 - DNA, 20 bp, synthetic construct
  source 1..20: mol_type = other DNA
tctctttctgtacgctgttt

SEQ ID NO: 20698 - DNA, 20 bp, synthetic construct
  source 1..20: mol_type = other DNA
taggcgacgcaaacgaaaac

SEQ ID NO: 20699 - DNA, 20 bp, synthetic construct
  source 1..20: mol_type = other DNA
agaagtgttcctgacctgtt

SEQ ID NO: 20700 - DNA, 20 bp, synthetic construct
  source 1..20: mol_type = other DNA
tgtgcaatctggtgaattta

SEQ ID NO: 20701 - DNA, 20 bp, synthetic construct
  source 1..20: mol_type = other DNA
ccagccaagcatgagctcat

SEQ ID NO: 20702 - DNA, 20 bp, synthetic construct
  source 1..20: mol_type = other DNA
actgggatcataaagtttca

SEQ ID NO: 20703 - DNA, 20 bp, synthetic construct
  source 1..20: mol_type = other DNA
cacgccgctcacgtaaaggc

SEQ ID NO: 20704 - DNA, 20 bp, synthetic construct
  source 1..20: mol_type = other DNA
tggagagggactccaagtcc

SEQ ID NO: 20705 - DNA, 20 bp, synthetic construct
  source 1..20: mol_type = other DNA
aaagcgcaaaggaaaaatgc

SEQ ID NO: 20706 - DNA, 20 bp, synthetic construct
  source 1..20: mol_type = other DNA
ataattgatcattttgaagc

SEQ ID NO: 20707 - DNA, 20 bp, synthetic construct
  source 1..20: mol_type = other DNA
caatctgaaaacctacaaag

SEQ ID NO: 20708 - DNA, 20 bp, synthetic construct
  source 1..20: mol_type = other DNA
ccattccgaagcgagttttc

SEQ ID NO: 20709 - DNA, 20 bp, synthetic construct
  source 1..20: mol_type = other DNA
ggcaacattaataaaaagcc

SEQ ID NO: 20710 - DNA, 20 bp, synthetic construct
  source 1..20: mol_type = other DNA
taggaactcatcaacattga

SEQ ID NO: 20711 - DNA, 20 bp, synthetic construct
  source 1..20: mol_type = other DNA
acttttcgtcttagaaacaa

SEQ ID NO: 20712 - DNA, 20 bp, synthetic construct
  source 1..20: mol_type = other DNA
cctgcgcgcgcgggaactgt

SEQ ID NO: 20713 - DNA, 20 bp, synthetic construct
  source 1..20: mol_type = other DNA
actcacccttccatctcttc

SEQ ID NO: 20714 - DNA, 20 bp, synthetic construct
  source 1..20: mol_type = other DNA
caaatacaaccacaaccaaa

SEQ ID NO: 20715 - DNA, 20 bp, synthetic construct
  source 1..20: mol_type = other DNA
tcataccaggattttttgga

SEQ ID NO: 20716 - DNA, 20 bp, synthetic construct
  source 1..20: mol_type = other DNA
aacctagtcacaactgctgt

SEQ ID NO: 20717 - DNA, 20 bp, synthetic construct
  source 1..20: mol_type = other DNA
aatttcttcggggtatgtat

SEQ ID NO: 20718 - DNA, 20 bp, synthetic construct
  source 1..20: mol_type = other DNA
atgttcgatatgggggtacg

SEQ ID NO: 20719 - DNA, 20 bp, synthetic construct
  source 1..20: mol_type = other DNA
aagattgttggaaagggatt

SEQ ID NO: 20720 - DNA, 20 bp, synthetic construct
  source 1..20: mol_type = other DNA
tactatgcatgtatttcagt

SEQ ID NO: 20721 - DNA, 20 bp, synthetic construct
  source 1..20: mol_type = other DNA
taatattctttgtggttttt

SEQ ID NO: 20722 - DNA, 20 bp, synthetic construct
  source 1..20: mol_type = other DNA
gttctgagttcatagaaaag

SEQ ID NO: 20723 - DNA, 20 bp, synthetic construct
  source 1..20: mol_type = other DNA
atttcaggtttcaaaattaa

SEQ ID NO: 20724 - DNA, 20 bp, synthetic construct
  source 1..20: mol_type = other DNA
aatataaaaggccgtttatg

SEQ ID NO: 20725 - DNA, 20 bp, synthetic construct
  source 1..20: mol_type = other DNA
ttcactagggttcttacata

SEQ ID NO: 20726 - DNA, 20 bp, synthetic construct
  source 1..20: mol_type = other DNA
atggaatattcaaaccattt

SEQ ID NO: 20727 - DNA, 20 bp, synthetic construct
  source 1..20: mol_type = other DNA
gtacgatttgctcgacaacg

SEQ ID NO: 20728 - DNA, 20 bp, synthetic construct
  source 1..20: mol_type = other DNA
tttccctacgaacaaataca

SEQ ID NO: 20729 - DNA, 20 bp, synthetic construct
  source 1..20: mol_type = other DNA
ccttacacaagaaaaaacgt

SEQ ID NO: 20730 - DNA, 20 bp, synthetic construct
  source 1..20: mol_type = other DNA
tttacgttttattgtagaaa

SEQ ID NO: 20731 - DNA, 20 bp, synthetic construct
  source 1..20: mol_type = other DNA
tgatccccgcttgctaattg

SEQ ID NO: 20732 - DNA, 20 bp, synthetic construct
  source 1..20: mol_type = other DNA
gactcgcctcttgatcgggc

SEQ ID NO: 20733 - DNA, 20 bp, synthetic construct
  source 1..20: mol_type = other DNA
aagcgtcaaccccggggaga

SEQ ID NO: 20734 - DNA, 20 bp, synthetic construct
  source 1..20: mol_type = other DNA
cgtaggacgatcggctgaag

SEQ ID NO: 20735 - DNA, 20 bp, synthetic construct
  source 1..20: mol_type = other DNA
acaaccatttataccgccaa

SEQ ID NO: 20736 - DNA, 20 bp, synthetic construct
  source 1..20: mol_type = other DNA
aacactaaatcaacacatca

SEQ ID NO: 20737 - DNA, 20 bp, synthetic construct
  source 1..20: mol_type = other DNA
gacaaaaggaaaatataaaa

SEQ ID NO: 20738 - DNA, 20 bp, synthetic construct
  source 1..20: mol_type = other DNA
ccggttcctaccccccgctc

SEQ ID NO: 20739 - DNA, 20 bp, synthetic construct
  source 1..20: mol_type = other DNA
tccgtctgcggggagggcgt

SEQ ID NO: 20740 - DNA, 20 bp, synthetic construct
  source 1..20: mol_type = other DNA
ggcgattcccttcgcgaggg

SEQ ID NO: 20741 - DNA, 20 bp, synthetic construct
  source 1..20: mol_type = other DNA
caggccctcgctgctctccc

SEQ ID NO: 20742 - DNA, 20 bp, synthetic construct
  source 1..20: mol_type = other DNA
gcaccacccagcggcccagt

SEQ ID NO: 20743 - DNA, 20 bp, synthetic construct
  source 1..20: mol_type = other DNA
gggtggggtgggggaaagcc

SEQ ID NO: 20744 - DNA, 20 bp, synthetic construct
  source 1..20: mol_type = other DNA
ctgcgccggctttcccccac

SEQ ID NO: 20745 - DNA, 20 bp, synthetic construct
  source 1..20: mol_type = other DNA
ttgggacgtgccagcatttc

SEQ ID NO: 20746 - DNA, 20 bp, synthetic construct
  source 1..20: mol_type = other DNA
ccaggaactcacggcagacg

SEQ ID NO: 20747 - DNA, 20 bp, synthetic construct
  source 1..20: mol_type = other DNA
cacggggacctcggttgggc

SEQ ID NO: 20748 - DNA, 20 bp, synthetic construct
  source 1..20: mol_type = other DNA
gcgatgacgtcattagcgag

SEQ ID NO: 20749 - DNA, 20 bp, synthetic construct
  source 1..20: mol_type = other DNA
tgcgcacgccagccgggacg

SEQ ID NO: 20750 - DNA, 20 bp, synthetic construct
  source 1..20: mol_type = other DNA
cgtggacgggacaccggtgt

SEQ ID NO: 20751 - DNA, 20 bp, synthetic construct
  source 1..20: mol_type = other DNA
ggcccgtcgctcggggtgct

SEQ ID NO: 20752 - DNA, 20 bp, synthetic construct
  source 1..20: mol_type = other DNA
ttgcgaacgactagtcgccg

SEQ ID NO: 20753 - DNA, 20 bp, synthetic construct
  source 1..20: mol_type = other DNA
ctacccccacccaaccagcg

SEQ ID NO: 20754 - DNA, 20 bp, synthetic construct
  source 1..20: mol_type = other DNA
gttggaccccgtgcatggac

SEQ ID NO: 20755 - DNA, 20 bp, synthetic construct
  source 1..20: mol_type = other DNA
catcattctcgaggcggctc

SEQ ID NO: 20756 - DNA, 20 bp, synthetic construct
  source 1..20: mol_type = other DNA
ctggggccgcgctcgttcga

SEQ ID NO: 20757 - DNA, 20 bp, synthetic construct
  source 1..20: mol_type = other DNA
cggctacacccccgcgcacc

SEQ ID NO: 20758 - DNA, 20 bp, synthetic construct
  source 1..20: mol_type = other DNA
acacagaggccagcaccagg

SEQ ID NO: 20759 - DNA, 20 bp, synthetic construct
  source 1..20: mol_type = other DNA
ccgcattcgcaccccggcac

SEQ ID NO: 20760 - DNA, 20 bp, synthetic construct
  source 1..20: mol_type = other DNA
gtcggtgtcgctgccgcccg

SEQ ID NO: 20761 - DNA, 20 bp, synthetic construct
  source 1..20: mol_type = other DNA
ccacgccccttccggcaccg

SEQ ID NO: 20762 - DNA, 20 bp, synthetic construct
  source 1..20: mol_type = other DNA
tgctgctgagccctgccccg

SEQ ID NO: 20763 - DNA, 20 bp, synthetic construct
  source 1..20: mol_type = other DNA
gtcgggttgccccttggggt

SEQ ID NO: 20764 - DNA, 20 bp, synthetic construct
  source 1..20: mol_type = other DNA
ttcccgagctcggcttgatg

SEQ ID NO: 20765 - DNA, 20 bp, synthetic construct
  source 1..20: mol_type = other DNA
tgtgtgtagaacccgcgcgg

SEQ ID NO: 20766 - DNA, 20 bp, synthetic construct
  source 1..20: mol_type = other DNA
cagcactactttcggttttg

SEQ ID NO: 20767 - DNA, 20 bp, synthetic construct
  source 1..20: mol_type = other DNA
ccaccccactattccccccc

SEQ ID NO: 20768 - DNA, 20 bp, synthetic construct
  source 1..20: mol_type = other DNA
tcaccccaccccatcctttg

SEQ ID NO: 20769 - DNA, 20 bp, synthetic construct
  source 1..20: mol_type = other DNA
agcgtgggcagctccggatc

SEQ ID NO: 20770 - DNA, 20 bp, synthetic construct
  source 1..20: mol_type = other DNA
acagcccctgggtgtcgacc

SEQ ID NO: 20771 - DNA, 20 bp, synthetic construct
  source 1..20: mol_type = other DNA
ccccccccaaaccttaacta

SEQ ID NO: 20772 - DNA, 20 bp, synthetic construct
  source 1..20: mol_type = other DNA
catctacaccttcaagacgt

SEQ ID NO: 20773 - DNA, 20 bp, synthetic construct
  source 1..20: mol_type = other DNA
tacataacagtagggggtgg

SEQ ID NO: 20774 - DNA, 20 bp, synthetic construct
  source 1..20: mol_type = other DNA
acgcgataccgggtgtgtgg

SEQ ID NO: 20775 - DNA, 20 bp, synthetic construct
  source 1..20: mol_type = other DNA
tcgacagattgttggcgact

SEQ ID NO: 20776 - DNA, 20 bp, synthetic construct
  source 1..20: mol_type = other DNA
ccgctgtttccgttcatcgc

SEQ ID NO: 20777 - DNA, 20 bp, synthetic construct
  source 1..20: mol_type = other DNA
agcgctccgatcggggtcag

SEQ ID NO: 20778 - DNA, 20 bp, synthetic construct
  source 1..20: mol_type = other DNA
tatacagctctgtagagaga

SEQ ID NO: 20779 - DNA, 20 bp, synthetic construct
  source 1..20: mol_type = other DNA
ggtcccccggcccccctaac

SEQ ID NO: 20780 - DNA, 20 bp, synthetic construct
  source 1..20: mol_type = other DNA
ttttatgcgggaacaagggg

SEQ ID NO: 20781 - DNA, 20 bp, synthetic construct
  source 1..20: mol_type = other DNA
taggttgggaggtggcacaa

SEQ ID NO: 20782 - DNA, 20 bp, synthetic construct
  source 1..20: mol_type = other DNA
tccggaagagagcgccccgc

SEQ ID NO: 20783 - DNA, 20 bp, synthetic construct
  source 1..20: mol_type = other DNA
gcctgccaacaccacgtcaa

SEQ ID NO: 20784 - DNA, 20 bp, synthetic construct
  source 1..20: mol_type = other DNA
ggtgagtacgccaaaaattt

SEQ ID NO: 20785 - DNA, 20 bp, synthetic construct
  source 1..20: mol_type = other DNA
tgacataaaagtagtgccaa

SEQ ID NO: 20786 - DNA, 20 bp, synthetic construct
  source 1..20: mol_type = other DNA
gttagccctaggtgtgaata

SEQ ID NO: 20787 - DNA, 20 bp, synthetic construct
  source 1..20: mol_type = other DNA
aagataaagccacctttgcc

SEQ ID NO: 20788 - DNA, 20 bp, synthetic construct
  source 1..20: mol_type = other DNA
gccagtagatcctagactag

SEQ ID NO: 20789 - DNA, 20 bp, synthetic construct
  source 1..20: mol_type = other DNA
catacctagaagaataagac

SEQ ID NO: 20790 - DNA, 20 bp, synthetic construct
  source 1..20: mol_type = other DNA
cattgttcatcagatctagt

SEQ ID NO: 20791 - DNA, 20 bp, synthetic construct
  source 1..20: mol_type = other DNA
ttcaaaattttctacaacat

SEQ ID NO: 20792 - DNA, 20 bp, synthetic construct
  source 1..20: mol_type = other DNA
ccggccccgtcgctcccgtc

SEQ ID NO: 20793 - DNA, 20 bp, synthetic construct
  source 1..20: mol_type = other DNA
ccaggcctaattgtccgcgc

SEQ ID NO: 20794 - DNA, 20 bp, synthetic construct
  source 1..20: mol_type = other DNA
ggttcagttgcacgactccg

SEQ ID NO: 20795 - DNA, 20 bp, synthetic construct
  source 1..20: mol_type = other DNA
catcgcgcccgccctcctcg

SEQ ID NO: 20796 - DNA, 20 bp, synthetic construct
  source 1..20: mol_type = other DNA
tcctgccccattgcgtccgc

SEQ ID NO: 20797 - DNA, 20 bp, synthetic construct
  source 1..20: mol_type = other DNA
agagaagccatcgcgggcgg

SEQ ID NO: 20798 - DNA, 20 bp, synthetic construct
  source 1..20: mol_type = other DNA
catttcctcgtggcgaaccg

SEQ ID NO: 20799 - DNA, 20 bp, synthetic construct
  source 1..20: mol_type = other DNA
gacagcaaccgcctgcacac

SEQ ID NO: 20800 - DNA, 20 bp, synthetic construct
  source 1..20: mol_type = other DNA
tgtgcagccgtgttccaacc

SEQ ID NO: 20801 - DNA, 20 bp, synthetic construct
  source 1..20: mol_type = other DNA
acaaaatccgccggggtgcc

SEQ ID NO: 20802 - DNA, 20 bp, synthetic construct
  source 1..20: mol_type = other DNA
tttaaagcggtggcggcggg

SEQ ID NO: 20803 - DNA, 20 bp, synthetic construct
  source 1..20: mol_type = other DNA
agttccgcgtcgacggcggg

SEQ ID NO: 20804 - DNA, 20 bp, synthetic construct
  source 1..20: mol_type = other DNA
aaatctgcaagtgccccaaa

SEQ ID NO: 20805 - DNA, 20 bp, synthetic construct
  source 1..20: mol_type = other DNA
cgcgcttcgccccagcgccg

SEQ ID NO: 20806 - DNA, 20 bp, synthetic construct
  source 1..20: mol_type = other DNA
gttggcacaaaaagaccccg

SEQ ID NO: 20807 - DNA, 20 bp, synthetic construct
  source 1..20: mol_type = other DNA
aaatacatgcccgggaccca

SEQ ID NO: 20808 - DNA, 20 bp, synthetic construct
  source 1..20: mol_type = other DNA
tggctatccggagaaacagc

SEQ ID NO: 20809 - DNA, 20 bp, synthetic construct
  source 1..20: mol_type = other DNA
cgatcatcagttatccttaa

SEQ ID NO: 20810 - DNA, 20 bp, synthetic construct
  source 1..20: mol_type = other DNA
ttcaggaagccggggagagg

SEQ ID NO: 20811 - DNA, 20 bp, synthetic construct
  source 1..20: mol_type = other DNA
ttgttgggctcccattttac

SEQ ID NO: 20812 - DNA, 20 bp, synthetic construct
  source 1..20: mol_type = other DNA
tgtgggattgcgtggtatgt

SEQ ID NO: 20813 - DNA, 20 bp, synthetic construct
  source 1..20: mol_type = other DNA
cttgggtgtggcacatcgaa

SEQ ID NO: 20814 - DNA, 20 bp, synthetic construct
  source 1..20: mol_type = other DNA
cacccgagtctctgggcgga

SEQ ID NO: 20815 - DNA, 20 bp, synthetic construct
  source 1..20: mol_type = other DNA
cggcggcgaccgttgcgtgg

SEQ ID NO: 20816 - DNA, 20 bp, synthetic construct
  source 1..20: mol_type = other DNA
ggcagcatgggacccacaga

SEQ ID NO: 20817 - DNA, 20 bp, synthetic construct
  source 1..20: mol_type = other DNA
ctcggcactcggagcgagac

SEQ ID NO: 20818 - DNA, 20 bp, synthetic construct
  source 1..20: mol_type = other DNA
agcaaggcgtccattctccc

SEQ ID NO: 20819 - DNA, 20 bp, synthetic construct
  source 1..20: mol_type = other DNA
atccagcgaagcagccgcct

SEQ ID NO: 20820 - DNA, 20 bp, synthetic construct
  source 1..20: mol_type = other DNA
cgagcttaagcctctcctgg

SEQ ID NO: 20821 - DNA, 20 bp, synthetic construct
  source 1..20: mol_type = other DNA
cacccggcggcgcgctcaac

SEQ ID NO: 20822 - DNA, 20 bp, synthetic construct
  source 1..20: mol_type = other DNA
acgcgagactatcagagcac

SEQ ID NO: 20823 - DNA, 20 bp, synthetic construct
  source 1..20: mol_type = other DNA
cgtgatcggggtacttcgcc

SEQ ID NO: 20824 - DNA, 20 bp, synthetic construct
  source 1..20: mol_type = other DNA
ggttttgtcgcaaggtgtcg

SEQ ID NO: 20825 - DNA, 20 bp, synthetic construct
  source 1..20: mol_type = other DNA
actcgggggacccgcatcgc

SEQ ID NO: 20826 - DNA, 20 bp, synthetic construct
  source 1..20: mol_type = other DNA
tttgggtccgggcccgtcgt

SEQ ID NO: 20827 - DNA, 20 bp, synthetic construct
  source 1..20: mol_type = other DNA
ctccccgggccaatatcgct

SEQ ID NO: 20828 - DNA, 20 bp, synthetic construct
  source 1..20: mol_type = other DNA
tatcaaaacactcgcctccg

SEQ ID NO: 20829 - DNA, 20 bp, synthetic construct
  source 1..20: mol_type = other DNA
aagcgaccctttgcggtttc

SEQ ID NO: 20830 - DNA, 20 bp, synthetic construct
  source 1..20: mol_type = other DNA
cgcacgaggacgagtccgcg

SEQ ID NO: 20831 - DNA, 20 bp, synthetic construct
  source 1..20: mol_type = other DNA
acatccaccgtagggggcct

SEQ ID NO: 20832 - DNA, 20 bp, synthetic construct
  source 1..20: mol_type = other DNA
caatacgcccgcgtttcttc

SEQ ID NO: 20833 - DNA, 20 bp, synthetic construct
  source 1..20: mol_type = other DNA
agccctgccatagccacggg

SEQ ID NO: 20834 - DNA, 20 bp, synthetic construct
  source 1..20: mol_type = other DNA
gcgtgaaactcccgcacctc

SEQ ID NO: 20835 - DNA, 20 bp, synthetic construct
  source 1..20: mol_type = other DNA
gccagacgcgggtccgctgt

SEQ ID NO: 20836 - DNA, 20 bp, synthetic construct
  source 1..20: mol_type = other DNA
ccggcggttggcgtgaacgc

SEQ ID NO: 20837 - DNA, 20 bp, synthetic construct
  source 1..20: mol_type = other DNA
caaccccggtctccaaccct

SEQ ID NO: 20838 - DNA, 20 bp, synthetic construct
  source 1..20: mol_type = other DNA
cgtcgtgccgggattacctc

SEQ ID NO: 20839 - DNA, 20 bp, synthetic construct
  source 1..20: mol_type = other DNA
gagcctcgttaagagccagg

SEQ ID NO: 20840 - DNA, 20 bp, synthetic construct
  source 1..20: mol_type = other DNA
ccctttggtgggtttacgcg

SEQ ID NO: 20841 - DNA, 20 bp, synthetic construct
  source 1..20: mol_type = other DNA
gccctcccgaccgacacccc

SEQ ID NO: 20842 - DNA, 20 bp, synthetic construct
  source 1..20: mol_type = other DNA
ctcgcaacgcctgcgggggt

SEQ ID NO: 20843 - DNA, 20 bp, synthetic construct
  source 1..20: mol_type = other DNA
tctcgtcgttggtctacgct

SEQ ID NO: 20844 - DNA, 20 bp, synthetic construct
  source 1..20: mol_type = other DNA
ctgctctcgcctactcttct

SEQ ID NO: 20845 - DNA, 20 bp, synthetic construct
  source 1..20: mol_type = other DNA
gccgacgtcccctctcgagc

SEQ ID NO: 20846 - DNA, 20 bp, synthetic construct
  source 1..20: mol_type = other DNA
aggcccgccgccactgtcgt

SEQ ID NO: 20847 - DNA, 20 bp, synthetic construct
  source 1..20: mol_type = other DNA
ctaacggattattgtcctct

SEQ ID NO: 20848 - DNA, 20 bp, synthetic construct
  source 1..20: mol_type = other DNA
ccaaccacgccttagttagg

SEQ ID NO: 20849 - DNA, 20 bp, synthetic construct
  source 1..20: mol_type = other DNA
cctggctgccatcaaaaccc

SEQ ID NO: 20850 - DNA, 20 bp, synthetic construct
  source 1..20: mol_type = other DNA
accgaagcccacctcgtcac

SEQ ID NO: 20851 - DNA, 20 bp, synthetic construct
  source 1..20: mol_type = other DNA
ctatcccgcccaccgctggg

SEQ ID NO: 20852 - DNA, 20 bp, synthetic construct
  source 1..20: mol_type = other DNA
ggagcaaaacgcctccccct

SEQ ID NO: 20853 - DNA, 20 bp, synthetic construct
  source 1..20: mol_type = other DNA
acctaccaacggaacgtctg

SEQ ID NO: 20854 - DNA, 20 bp, synthetic construct
  source 1..20: mol_type = other DNA
tacaaactccctggtcttac

SEQ ID NO: 20855 - DNA, 20 bp, synthetic construct
  source 1..20: mol_type = other DNA
aacaagtgggggctcgtccg

SEQ ID NO: 20856 - DNA, 20 bp, synthetic construct
  source 1..20: mol_type = other DNA
ttctgtgttgtctctgtttg

SEQ ID NO: 20857 - DNA, 20 bp, synthetic construct
  source 1..20: mol_type = other DNA
caacctcgtcacggagaatc

SEQ ID NO: 20858 - DNA, 20 bp, synthetic construct
  source 1..20: mol_type = other DNA
tacttccggtattaagccct

SEQ ID NO: 20859 - DNA, 20 bp, synthetic construct
  source 1..20: mol_type = other DNA
actaaagattggagaaggtc

SEQ ID NO: 20860 - DNA, 20 bp, synthetic construct
  source 1..20: mol_type = other DNA
aaggctcttgcttactatcc

SEQ ID NO: 20861 - DNA, 20 bp, synthetic construct
  source 1..20: mol_type = other DNA
cagccggggtcccgcccccg

SEQ ID NO: 20862 - DNA, 20 bp, synthetic construct
  source 1..20: mol_type = other DNA
ccacagtgtgagattaacat

SEQ ID NO: 20863 - DNA, 20 bp, synthetic construct
  source 1..20: mol_type = other DNA
tcgttgtgggcatcgttgga

SEQ ID NO: 20864 - DNA, 20 bp, synthetic construct
  source 1..20: mol_type = other DNA
gggataatacttatcatttt

SEQ ID NO: 20865 - DNA, 20 bp, synthetic construct
  source 1..20: mol_type = other DNA
agcaagggagaaacacgtgg

SEQ ID NO: 20866 - DNA, 20 bp, synthetic construct
  source 1..20: mol_type = other DNA
tagggatggccgaaaggcag

SEQ ID NO: 20867 - DNA, 20 bp, synthetic construct
  source 1..20: mol_type = other DNA
tactattgagttcgcccgct

SEQ ID NO: 20868 - DNA, 20 bp, synthetic construct
  source 1..20: mol_type = other DNA
cattcactttgcagtttgtt

SEQ ID NO: 20869 - DNA, 20 bp, synthetic construct
  source 1..20: mol_type = other DNA
acgagtgaggtcgacgtcat

SEQ ID NO: 20870 - DNA, 20 bp, synthetic construct
  source 1..20: mol_type = other DNA
acaagcctccccccaggccc

SEQ ID NO: 20871 - DNA, 20 bp, synthetic construct
  source 1..20: mol_type = other DNA
atcctcctctctacaccaac

SEQ ID NO: 20872 - DNA, 20 bp, synthetic construct
  source 1..20: mol_type = other DNA
attaaggcctaagtggagga

SEQ ID NO: 20873 - DNA, 20 bp, synthetic construct
  source 1..20: mol_type = other DNA
gaaatctgtgagtattgaca

SEQ ID NO: 20874 - DNA, 20 bp, synthetic construct
  source 1..20: mol_type = other DNA
tacgtcacaggagagcatac

SEQ ID NO: 20875 - DNA, 20 bp, synthetic construct
  source 1..20: mol_type = other DNA
agacacctagggatggaaga

SEQ ID NO: 20876 - DNA, 20 bp, synthetic construct
  source 1..20: mol_type = other DNA
taccgtaacaatccctcacc

SEQ ID NO: 20877 - DNA, 20 bp, synthetic construct
  source 1..20: mol_type = other DNA
ttctggaaagcctctgtgtc

SEQ ID NO: 20878 - DNA, 20 bp, synthetic construct
  source 1..20: mol_type = other DNA
acagtgacaattggtcttgg

SEQ ID NO: 20879 - DNA, 20 bp, synthetic construct
  source 1..20: mol_type = other DNA
attaaacagtgtctcaggtt

SEQ ID NO: 20880 - DNA, 20 bp, synthetic construct
  source 1..20: mol_type = other DNA
agacaatcattcagccccgt

SEQ ID NO: 20881 - DNA, 20 bp, synthetic construct
  source 1..20: mol_type = other DNA
ctgaaagtggtcaggattga

SEQ ID NO: 20882 - DNA, 20 bp, synthetic construct
  source 1..20: mol_type = other DNA
taattgtctacgggtagttt

SEQ ID NO: 20883 - DNA, 20 bp, synthetic construct
  source 1..20: mol_type = other DNA
gtcctcctgaccacccccac

SEQ ID NO: 20884 - DNA, 20 bp, synthetic construct
  source 1..20: mol_type = other DNA
accaatcaagacctctcgga

SEQ ID NO: 20885 - DNA, 20 bp, synthetic construct
  source 1..20: mol_type = other DNA
ctggccggcgaccatacctg

SEQ ID NO: 20886 - DNA, 20 bp, synthetic construct
  source 1..20: mol_type = other DNA
cctcggattgtggacaggag

SEQ ID NO: 20887 - DNA, 20 bp, synthetic construct
  source 1..20: mol_type = other DNA
gctagcagtgaaaatgctaa

SEQ ID NO: 20888 - DNA, 20 bp, synthetic construct
  source 1..20: mol_type = other DNA
ggggctagctcgggtccaca

SEQ ID NO: 20889 - DNA, 20 bp, synthetic construct
  source 1..20: mol_type = other DNA
aaacctactggtcctgttat

SEQ ID NO: 20890 - DNA, 20 bp, synthetic construct
  source 1..20: mol_type = other DNA
tgctataagcacaactttcc

SEQ ID NO: 20891 - DNA, 20 bp, synthetic construct
  source 1..20: mol_type = other DNA
atcgagttgctaggcaataa

SEQ ID NO: 20892 - DNA, 20 bp, synthetic construct
  source 1..20: mol_type = other DNA
atgcccacggcacatcttaa

SEQ ID NO: 20893 - DNA, 20 bp, synthetic construct
  source 1..20: mol_type = other DNA
gaggacgtatcggaaactct

SEQ ID NO: 20894 - DNA, 20 bp, synthetic construct
  source 1..20: mol_type = other DNA
cgagcaggatctccattttg

SEQ ID NO: 20895 - DNA, 20 bp, synthetic construct
  source 1..20: mol_type = other DNA
cctcacctttcattgtcgat

SEQ ID NO: 20896 - DNA, 20 bp, synthetic construct
  source 1..20: mol_type = other DNA
acatcataagaagcgccata

SEQ ID NO: 20897 - DNA, 20 bp, synthetic construct
  source 1..20: mol_type = other DNA
cacagaaccccagctgctat

SEQ ID NO: 20898 - DNA, 20 bp, synthetic construct
  source 1..20: mol_type = other DNA
agcgaccgaacggaccatat

SEQ ID NO: 20899 - DNA, 20 bp, synthetic construct
  source 1..20: mol_type = other DNA
ggcatagttgttatcgttct

SEQ ID NO: 20900 - DNA, 20 bp, synthetic construct
  source 1..20: mol_type = other DNA
acacaattgcctacctgctt

SEQ ID NO: 20901 - DNA, 20 bp, synthetic construct
  source 1..20: mol_type = other DNA
ctcgaagcttattgtcttca

SEQ ID NO: 20902 - DNA, 20 bp, synthetic construct
  source 1..20: mol_type = other DNA
agattaagccgacagtgagc

SEQ ID NO: 20903 - DNA, 20 bp, synthetic construct
  source 1..20: mol_type = other DNA
taaccaaaataaactccact

SEQ ID NO: 20904 - DNA, 20 bp, synthetic construct
  source 1..20: mol_type = other DNA
gggaaagaagcctttttatt

SEQ ID NO: 20905 - DNA, 20 bp, synthetic construct
  source 1..20: mol_type = other DNA
gtgtggaagcaaagttctgt

SEQ ID NO: 20906 - DNA, 20 bp, synthetic construct
  source 1..20: mol_type = other DNA
acaaacacttttggtcttgg

SEQ ID NO: 20907 - DNA, 20 bp, synthetic construct
  source 1..20: mol_type = other DNA
tactatatgtgtctcctata

SEQ ID NO: 20908 - DNA, 20 bp, synthetic construct
  source 1..20: mol_type = other DNA
ttctccagttacggagcgag

SEQ ID NO: 20909 - DNA, 20 bp, synthetic construct
  source 1..20: mol_type = other DNA
atgggcgcggacctgcactg

SEQ ID NO: 20910 - DNA, 20 bp, synthetic construct
  source 1..20: mol_type = other DNA
gagggcgagtacctggaaga

SEQ ID NO: 20911 - DNA, 20 bp, synthetic construct
  source 1..20: mol_type = other DNA
gtggtggtggtaacccgttc

SEQ ID NO: 20912 - DNA, 20 bp, synthetic construct
  source 1..20: mol_type = other DNA
ggccatggcgaccagcgtgc

SEQ ID NO: 20913 - DNA, 20 bp, synthetic construct
  source 1..20: mol_type = other DNA
aggtgatgtcagtatttata

SEQ ID NO: 20914 - DNA, 20 bp, synthetic construct
  source 1..20: mol_type = other DNA
agatgttcacttcgcgatgt

SEQ ID NO: 20915 - DNA, 20 bp, synthetic construct
  source 1..20: mol_type = other DNA
ctaccacccgagcattacca

SEQ ID NO: 20916 - DNA, 20 bp, synthetic construct
  source 1..20: mol_type = other DNA
gaatggactctgacgctcct

SEQ ID NO: 20917 - DNA, 20 bp, synthetic construct
  source 1..20: mol_type = other DNA
gagtgtgaagcgccgccgct

SEQ ID NO: 20918 - DNA, 20 bp, synthetic construct
  source 1..20: mol_type = other DNA
tgtccagaaggaggagtgaa

SEQ ID NO: 20919 - DNA, 20 bp, synthetic construct
  source 1..20: mol_type = other DNA
tcagccggtaacgccaccac

SEQ ID NO: 20920 - DNA, 20 bp, synthetic construct
  source 1..20: mol_type = other DNA
ttcctccgcggccggccatt

SEQ ID NO: 20921 - DNA, 20 bp, synthetic construct
  source 1..20: mol_type = other DNA
cagcgcacgcttgaggacgc

SEQ ID NO: 20922 - DNA, 20 bp, synthetic construct
  source 1..20: mol_type = other DNA
tcccgaacttcgatgccatc

SEQ ID NO: 20923 - DNA, 20 bp, synthetic construct
  source 1..20: mol_type = other DNA
agtgcggatcgtcgtcgaag

SEQ ID NO: 20924 - DNA, 20 bp, synthetic construct
  source 1..20: mol_type = other DNA
cgtcggtgtgctttgtgggt

SEQ ID NO: 20925 - DNA, 20 bp, synthetic construct
  source 1..20: mol_type = other DNA
ttcatcttctgccgccgcat

SEQ ID NO: 20926 - DNA, 20 bp, synthetic construct
  source 1..20: mol_type = other DNA
ggtctaaggaatcttctctt

SEQ ID NO: 20927 - DNA, 20 bp, synthetic construct
  source 1..20: mol_type = other DNA
taccgcgaccaaagagtggc

SEQ ID NO: 20928 - DNA, 20 bp, synthetic construct
  source 1..20: mol_type = other DNA
ggaatccatctgaagagacg

SEQ ID NO: 20929 - DNA, 20 bp, synthetic construct
  source 1..20: mol_type = other DNA
catcatccacccgcgcgcgc

SEQ ID NO: 20930 - DNA, 20 bp, synthetic construct
  source 1..20: mol_type = other DNA
tgtcaaattcctcctgtccc

SEQ ID NO: 20931 - DNA, 20 bp, synthetic construct
  source 1..20: mol_type = other DNA
gacctgcattttgaagtgtt

SEQ ID NO: 20932 - DNA, 20 bp, synthetic construct
  source 1..20: mol_type = other DNA
aggggcagaatgattaaaat

SEQ ID NO: 20933 - DNA, 20 bp, synthetic construct
  source 1..20: mol_type = other DNA
aaaaatttcggagaagatat

SEQ ID NO: 20934 - DNA, 20 bp, synthetic construct
  source 1..20: mol_type = other DNA
cgtgttggcgggtattttta

SEQ ID NO: 20935 - DNA, 20 bp, synthetic construct
  source 1..20: mol_type = other DNA
agctcagctttttctctgac

SEQ ID NO: 20936 - DNA, 20 bp, synthetic construct
  source 1..20: mol_type = other DNA
acggggacacggacagcctc

SEQ ID NO: 20937 - DNA, 20 bp, synthetic construct
  source 1..20: mol_type = other DNA
agggcgagctcaacgagccg

SEQ ID NO: 20938 - DNA, 20 bp, synthetic construct
  source 1..20: mol_type = other DNA
gtgtaggtttccacatcgta

SEQ ID NO: 20939 - DNA, 20 bp, synthetic construct
  source 1..20: mol_type = other DNA
ggtggaagccatctctggat

SEQ ID NO: 20940 - DNA, 20 bp, synthetic construct
  source 1..20: mol_type = other DNA
gagattacccagctcggagt

SEQ ID NO: 20941 - DNA, 20 bp, synthetic construct
  source 1..20: mol_type = other DNA
tccgggatcgatcacctctc

SEQ ID NO: 20942 - DNA, 20 bp, synthetic construct
  source 1..20: mol_type = other DNA
gatcattctctatctctatt

SEQ ID NO: 20943 - DNA, 20 bp, synthetic construct
  source 1..20: mol_type = other DNA
agacagatcccaaaatcata

SEQ ID NO: 20944 - DNA, 20 bp, synthetic construct
  source 1..20: mol_type = other DNA
actaaacgttccacaataaa

SEQ ID NO: 20945 - DNA, 20 bp, synthetic construct
  source 1..20: mol_type = other DNA
cagtggatacctcagcatcc

SEQ ID NO: 20946 - DNA, 20 bp, synthetic construct
  source 1..20: mol_type = other DNA
tcctgaagccgaaggagagg

SEQ ID NO: 20947 - DNA, 20 bp, synthetic construct
  source 1..20: mol_type = other DNA
gtacattgtagcatacatac

SEQ ID NO: 20948 - DNA, 20 bp, synthetic construct
  source 1..20: mol_type = other DNA
ccagtcgttttgacagttgg

SEQ ID NO: 20949 - DNA, 20 bp, synthetic construct
  source 1..20: mol_type = other DNA
cccaaaggagaccacctcag

SEQ ID NO: 20950 - DNA, 20 bp, synthetic construct
  source 1..20: mol_type = other DNA
gaggcccacgaataggctag

SEQ ID NO: 20951 - DNA, 20 bp, synthetic construct
  source 1..20: mol_type = other DNA
tgtgttgagaaaaagacagc

SEQ ID NO: 20952 - DNA, 20 bp, synthetic construct
  source 1..20: mol_type = other DNA
cgtgaacgtgttgagaaaaa

SEQ ID NO: 20953 - DNA, 20 bp, synthetic construct
  source 1..20: mol_type = other DNA
aactagtctatgaccagacg

SEQ ID NO: 20954 - DNA, 20 bp, synthetic construct
  source 1..20: mol_type = other DNA
agtatgaaagctactctcag

SEQ ID NO: 20955 - DNA, 20 bp, synthetic construct
  source 1..20: mol_type = other DNA
gatctggggtatcacattcc

SEQ ID NO: 20956 - DNA, 20 bp, synthetic construct
  source 1..20: mol_type = other DNA
taagcgactatggatctgat

SEQ ID NO: 20957 - DNA, 20 bp, synthetic construct
  source 1..20: mol_type = other DNA
ccccccacagggatgtgggg

SEQ ID NO: 20958 - DNA, 20 bp, synthetic construct
  source 1..20: mol_type = other DNA
ggaacctttgtggctcctct

SEQ ID NO: 20959 - DNA, 20 bp, synthetic construct
  source 1..20: mol_type = other DNA
aggggcctatattttcctgc

SEQ ID NO: 20960 - DNA, 20 bp, synthetic construct
  source 1..20: mol_type = other DNA
tttgtactaggaggctgtag

SEQ ID NO: 20961 - DNA, 20 bp, synthetic construct
  source 1..20: mol_type = other DNA
tgcagttaatcattacttca

SEQ ID NO: 20962 - DNA, 20 bp, synthetic construct
  source 1..20: mol_type = other DNA
tggggtggagccctcaggct

SEQ ID NO: 20963 - DNA, 20 bp, synthetic construct
  source 1..20: mol_type = other DNA
gaagaatgtcctgaaggcaa

SEQ ID NO: 20964 - DNA, 20 bp, synthetic construct
  source 1..20: mol_type = other DNA
aagcagcagcagaaacgcgg

SEQ ID NO: 20965 - DNA, 20 bp, synthetic construct
  source 1..20: mol_type = other DNA
tcgacgcggggtcaaaaact

SEQ ID NO: 20966 - DNA, 20 bp, synthetic construct
  source 1..20: mol_type = other DNA
ttgcatatccctaggcacct

SEQ ID NO: 20967 - DNA, 20 bp, synthetic construct
  source 1..20: mol_type = other DNA
gtcgcggctggccgcctgta

SEQ ID NO: 20968 - DNA, 20 bp, synthetic construct
  source 1..20: mol_type = other DNA
tacctttcctaatgcatttc

SEQ ID NO: 20969 - DNA, 20 bp, synthetic construct
  source 1..20: mol_type = other DNA
tggccatgtggaccatgcag

SEQ ID NO: 20970 - DNA, 20 bp, synthetic construct
  source 1..20: mol_type = other DNA
tgggaacactggcacctggg

SEQ ID NO: 20971 - DNA, 20 bp, synthetic construct
  source 1..20: mol_type = other DNA
gggtttgtgggtgtcataca

SEQ ID NO: 20972 - DNA, 20 bp, synthetic construct
  source 1..20: mol_type = other DNA
tttgtatttttcattttttt

SEQ ID NO: 20973 - DNA, 20 bp, synthetic construct
  source 1..20: mol_type = other DNA
aggtttgctacctaaaaaac

SEQ ID NO: 20974 - DNA, 20 bp, synthetic construct
  source 1..20: mol_type = other DNA
gtggtaacaagttgttgtag

SEQ ID NO: 20975 - DNA, 20 bp, synthetic construct
  source 1..20: mol_type = other DNA
agttgaaaccttggtttccg

SEQ ID NO: 20976 - DNA, 20 bp, synthetic construct
  source 1..20: mol_type = other DNA
gacagtcaaaatgattatga

SEQ ID NO: 20977 - DNA, 20 bp, synthetic construct
  source 1..20: mol_type = other DNA
ctcaagaaaagaaactgggc

SEQ ID NO: 20978 - DNA, 20 bp, synthetic construct
  source 1..20: mol_type = other DNA
ccaataatatcgtacatctt

SEQ ID NO: 20979 - DNA, 20 bp, synthetic construct
  source 1..20: mol_type = other DNA
attaaggcgacaacgagccg

SEQ ID NO: 20980 - DNA, 20 bp, synthetic construct
  source 1..20: mol_type = other DNA
gagattgtaggtagaaagga

SEQ ID NO: 20981 - DNA, 20 bp, synthetic construct
  source 1..20: mol_type = other DNA
aagatggatcctgtatctgt

SEQ ID NO: 20982 - DNA, 20 bp, synthetic construct
  source 1..20: mol_type = other DNA
gtttaagagttgacaaggtc

SEQ ID NO: 20983 - DNA, 20 bp, synthetic construct
  source 1..20: mol_type = other DNA
gcaagcgtatagttcgggat

SEQ ID NO: 20984 - DNA, 20 bp, synthetic construct
  source 1..20: mol_type = other DNA
ttgtaaaaaatgtgcttacc

SEQ ID NO: 20985 - DNA, 20 bp, synthetic construct
  source 1..20: mol_type = other DNA
aaaatgaaacagggtttcaa

SEQ ID NO: 20986 - DNA, 20 bp, synthetic construct
  source 1..20: mol_type = other DNA
tactactttagttcaatatg

SEQ ID NO: 20987 - DNA, 20 bp, synthetic construct
  source 1..20: mol_type = other DNA
tgtctttaattgcctcttgt

SEQ ID NO: 20988 - DNA, 20 bp, synthetic construct
  source 1..20: mol_type = other DNA
tccgaatgtcctattttgat

SEQ ID NO: 20989 - DNA, 20 bp, synthetic construct
  source 1..20: mol_type = other DNA
aagctcctttggttgttcgc

SEQ ID NO: 20990 - DNA, 20 bp, synthetic construct
  source 1..20: mol_type = other DNA
gaaatcacagagtatcattt

SEQ ID NO: 20991 - DNA, 20 bp, synthetic construct
  source 1..20: mol_type = other DNA
tgtggagatctaggacacat

SEQ ID NO: 20992 - DNA, 20 bp, synthetic construct
  source 1..20: mol_type = other DNA
agctatgcaaagtatagata

SEQ ID NO: 20993 - DNA, 20 bp, synthetic construct
  source 1..20: mol_type = other DNA
tgagtttgtaaataagtttc

SEQ ID NO: 20994 - DNA, 20 bp, synthetic construct
  source 1..20: mol_type = other DNA
tgagggacatttggactatc

SEQ ID NO: 20995 - DNA, 20 bp, synthetic construct
  source 1..20: mol_type = other DNA
agagttagaggagcttggaa

SEQ ID NO: 20996 - DNA, 20 bp, synthetic construct
  source 1..20: mol_type = other DNA
ctacaagatagtttcctcgt

SEQ ID NO: 20997 - DNA, 20 bp, synthetic construct
  source 1..20: mol_type = other DNA
ttattaacctctatatttct

SEQ ID NO: 20998 - DNA, 20 bp, synthetic construct
  source 1..20: mol_type = other DNA
tggcgtcgcaaggcaccaaa

SEQ ID NO: 20999 - DNA, 20 bp, synthetic construct
  source 1..20: mol_type = other DNA
tctaaccgaggtcgaaacgt

SEQ ID NO: 21000 - DNA, 20 bp, synthetic construct
  source 1..20: mol_type = other DNA
caacctggccatcgggctgc

SEQ ID NO: 21001 - DNA, 20 bp, synthetic construct
  source 1..20: mol_type = other DNA
gcaggtggcgcccaacgtgg

SEQ ID NO: 21002 - DNA, 20 bp, synthetic construct
  source 1..20: mol_type = other DNA
agtaaaatgggtgtctattt

SEQ ID NO: 21003 - DNA, 20 bp, synthetic construct
  source 1..20: mol_type = other DNA
ggtaaacagcatcaaggtat

SEQ ID NO: 21004 - DNA, 20 bp, synthetic construct
  source 1..20: mol_type = other DNA
caatctgtggtatggaccag

SEQ ID NO: 21005 - DNA, 20 bp, synthetic construct
  source 1..20: mol_type = other DNA
gctaaccaatttaatttggt

SEQ ID NO: 21006 - DNA, 20 bp, synthetic construct
  source 1..20: mol_type = other DNA
ctaaccaatttaatttggtg

SEQ ID NO: 21007 - DNA, 20 bp, synthetic construct
  source 1..20: mol_type = other DNA
tgagtaaaattttaaacaca

SEQ ID NO: 21008 - DNA, 20 bp, synthetic construct
  source 1..20: mol_type = other DNA
cagtaaatgaaataaaaagc

SEQ ID NO: 21009 - DNA, 20 bp, synthetic construct
  source 1..20: mol_type = other DNA
agacttgctgctagaagaac

SEQ ID NO: 21010 - DNA, 20 bp, synthetic construct
  source 1..20: mol_type = other DNA
atacacatcctggcagttca

SEQ ID NO: 21011 - DNA, 20 bp, synthetic construct
  source 1..20: mol_type = other DNA
gaagttatatacactgagcc

SEQ ID NO: 21012 - DNA, 20 bp, synthetic construct
  source 1..20: mol_type = other DNA
gtggataatgttactaggct

SEQ ID NO: 21013 - DNA, 20 bp, synthetic construct
  source 1..20: mol_type = other DNA
aaaccaccagtccttgatgt

SEQ ID NO: 21014 - DNA, 20 bp, synthetic construct
  source 1..20: mol_type = other DNA
ttgacaggataagcgatact

SEQ ID NO: 21015 - DNA, 20 bp, synthetic construct
  source 1..20: mol_type = other DNA
aataatggtcgttttggtgg

SEQ ID NO: 21016 - DNA, 20 bp, synthetic construct
  source 1..20: mol_type = other DNA
aagtgttgtattttctgtgt

SEQ ID NO: 21017 - DNA, 20 bp, synthetic construct
  source 1..20: mol_type = other DNA
gatctgtctgctgagggtag

SEQ ID NO: 21018 - DNA, 20 bp, synthetic construct
  source 1..20: mol_type = other DNA
cgcgagacctggtgtttgac

SEQ ID NO: 21019 - DNA, 20 bp, synthetic construct
  source 1..20: mol_type = other DNA
gagtcgattcggtcggttaa

SEQ ID NO: 21020 - DNA, 20 bp, synthetic construct
  source 1..20: mol_type = other DNA
cgggagactaggtcgtcttg

SEQ ID NO: 21021 - DNA, 20 bp, synthetic construct
  source 1..20: mol_type = other DNA
aaccaaaccacaaggcagac

SEQ ID NO: 21022 - DNA, 20 bp, synthetic construct
  source 1..20: mol_type = other DNA
aaccaccacctggatcacgc

SEQ ID NO: 21023 - DNA, 20 bp, synthetic construct
  source 1..20: mol_type = other DNA
agtctggagcgtagtgccta

SEQ ID NO: 21024 - DNA, 20 bp, synthetic construct
  source 1..20: mol_type = other DNA
cgacttgtgtaccgattctg

SEQ ID NO: 21025 - DNA, 20 bp, synthetic construct
  source 1..20: mol_type = other DNA
tcggagagggtatattcgtt

SEQ ID NO: 21026 - DNA, 20 bp, synthetic construct
  source 1..20: mol_type = other DNA
cctcttcgtccccgtcgcct

SEQ ID NO: 21027 - DNA, 20 bp, synthetic construct
  source 1..20: mol_type = other DNA
gacacgcaacttttggccgc

SEQ ID NO: 21028 - DNA, 20 bp, synthetic construct
  source 1..20: mol_type = other DNA
gttcacctttgcgcatcccc

SEQ ID NO: 21029 - DNA, 20 bp, synthetic construct
  source 1..20: mol_type = other DNA
acactcaataatccgcggtt

SEQ ID NO: 21030 - DNA, 20 bp, synthetic construct
  source 1..20: mol_type = other DNA
accgcaggttagcggcgagt

SEQ ID NO: 21031 - DNA, 20 bp, synthetic construct
  source 1..20: mol_type = other DNA
gttcgtctccgcttctcctc

SEQ ID NO: 21032 - DNA, 20 bp, synthetic construct
  source 1..20: mol_type = other DNA
gctgctttccccgagctccg

SEQ ID NO: 21033 - DNA, 20 bp, synthetic construct
  source 1..20: mol_type = other DNA
gccacatcgggcctgtgttc

SEQ ID NO: 21034 - DNA, 20 bp, synthetic construct
  source 1..20: mol_type = other DNA
gacggcagttctgaacccac

SEQ ID NO: 21035 - DNA, 20 bp, synthetic construct
  source 1..20: mol_type = other DNA
cgcccgtcccacaagccacg

SEQ ID NO: 21036 - DNA, 20 bp, synthetic construct
  source 1..20: mol_type = other DNA
gtggagtgcgtcaacgacat

SEQ ID NO: 21037 - DNA, 20 bp, synthetic construct
  source 1..20: mol_type = other DNA
ccactatcagtgcaatattt

SEQ ID NO: 21038 - DNA, 20 bp, synthetic construct
  source 1..20: mol_type = other DNA
tcatctggtagcgcttgcgg

SEQ ID NO: 21039 - DNA, 20 bp, synthetic construct
  source 1..20: mol_type = other DNA
aggaccttgacggtgactgc

SEQ ID NO: 21040 - DNA, 20 bp, synthetic construct
  source 1..20: mol_type = other DNA
ttccactgcgaccacatccc

SEQ ID NO: 21041 - DNA, 20 bp, synthetic construct
  source 1..20: mol_type = other DNA
ttagaccgttggagtcgcga

SEQ ID NO: 21042 - DNA, 20 bp, synthetic construct
  source 1..20: mol_type = other DNA
ccgcgcgcccccatcgcctc

SEQ ID NO: 21043 - DNA, 20 bp, synthetic construct
  source 1..20: mol_type = other DNA
gccgatgacgacaggctcgc

SEQ ID NO: 21044 - DNA, 20 bp, synthetic construct
  source 1..20: mol_type = other DNA
ctatcaacgtcttgtcgcta

SEQ ID NO: 21045 - DNA, 20 bp, synthetic construct
  source 1..20: mol_type = other DNA
agtctgaaacggggtgggag

SEQ ID NO: 21046 - DNA, 20 bp, synthetic construct
  source 1..20: mol_type = other DNA
ggcagacgaggagcggcgcg

SEQ ID NO: 21047 - DNA, 20 bp, synthetic construct
  source 1..20: mol_type = other DNA
gcacgcgcgtgccgccggcc

SEQ ID NO: 21048 - DNA, 20 bp, synthetic construct
  source 1..20: mol_type = other DNA
tgcacactccgtagagcagc

SEQ ID NO: 21049 - DNA, 20 bp, synthetic construct
  source 1..20: mol_type = other DNA
cctgggacgcgcagttgggc

SEQ ID NO: 21050 - DNA, 20 bp, synthetic construct
  source 1..20: mol_type = other DNA
gggtgttgctaggcgggctg

SEQ ID NO: 21051 - DNA, 20 bp, synthetic construct
  source 1..20: mol_type = other DNA
gcccgagctgaagcagacgc

SEQ ID NO: 21052 - DNA, 20 bp, synthetic construct
  source 1..20: mol_type = other DNA
cgccaactggctccttaccg

SEQ ID NO: 21053 - DNA, 20 bp, synthetic construct
  source 1..20: mol_type = other DNA
accctgtgcgcttccatcgt

SEQ ID NO: 21054 - DNA, 20 bp, synthetic construct
  source 1..20: mol_type = other DNA
cacttgccgctgtacaacga

SEQ ID NO: 21055 - DNA, 20 bp, synthetic construct
  source 1..20: mol_type = other DNA
tcagcctctgtgttcccaac

SEQ ID NO: 21056 - DNA, 20 bp, synthetic construct
  source 1..20: mol_type = other DNA
tcctgccacatatagctcgt

SEQ ID NO: 21057 - DNA, 20 bp, synthetic construct
  source 1..20: mol_type = other DNA
gtttaataaaagtagctttt

SEQ ID NO: 21058 - DNA, 20 bp, synthetic construct
  source 1..20: mol_type = other DNA
agacgtcagaaccgtcgcgg

SEQ ID NO: 21059 - DNA, 20 bp, synthetic construct
  source 1..20: mol_type = other DNA
gatggcggcgatatgggctc

SEQ ID NO: 21060 - DNA, 20 bp, synthetic construct
  source 1..20: mol_type = other DNA
cgtcgttcgcggacatagca

SEQ ID NO: 21061 - DNA, 20 bp, synthetic construct
  source 1..20: mol_type = other DNA
atgagtcgggcggtggccgg

SEQ ID NO: 21062 - DNA, 20 bp, synthetic construct
  source 1..20: mol_type = other DNA
gaacaacgcatttacgacgt

SEQ ID NO: 21063 - DNA, 20 bp, synthetic construct
  source 1..20: mol_type = other DNA
atgttaatgtaacaagacaa

SEQ ID NO: 21064 - DNA, 20 bp, synthetic construct
  source 1..20: mol_type = other DNA
ataagagcccggtgctatcg

SEQ ID NO: 21065 - DNA, 20 bp, synthetic construct
  source 1..20: mol_type = other DNA
cgtaggtggactttgtagta

SEQ ID NO: 21066 - DNA, 20 bp, synthetic construct
  source 1..20: mol_type = other DNA
gacaccgttcggccccatga

SEQ ID NO: 21067 - DNA, 20 bp, synthetic construct
  source 1..20: mol_type = other DNA
gttgcgggcatcccgggcga

SEQ ID NO: 21068 - DNA, 20 bp, synthetic construct
  source 1..20: mol_type = other DNA
gaacaggcgggcagcgtctc

SEQ ID NO: 21069 - DNA, 20 bp, synthetic construct
  source 1..20: mol_type = other DNA
acagtccctacggaacctga

SEQ ID NO: 21070 - DNA, 20 bp, synthetic construct
  source 1..20: mol_type = other DNA
tgcagagcgtcatgaaggac

SEQ ID NO: 21071 - DNA, 20 bp, synthetic construct
  source 1..20: mol_type = other DNA
acacgccttccctctttttc

SEQ ID NO: 21072 - DNA, 20 bp, synthetic construct
  source 1..20: mol_type = other DNA
tctccttcctcagtgtttgg

SEQ ID NO: 21073 - DNA, 20 bp, synthetic construct
  source 1..20: mol_type = other DNA
tttaagtcacggaggaagtt

SEQ ID NO: 21074 - DNA, 20 bp, synthetic construct
  source 1..20: mol_type = other DNA
tagacccacgcagatagcca

SEQ ID NO: 21075 - DNA, 20 bp, synthetic construct
  source 1..20: mol_type = other DNA
ctttcgcggcggacacgggg

SEQ ID NO: 21076 - DNA, 20 bp, synthetic construct
  source 1..20: mol_type = other DNA
ttaacgtcttcatccccccg

SEQ ID NO: 21077 - DNA, 20 bp, synthetic construct
  source 1..20: mol_type = other DNA
tcaacagcagacgttgtggg

SEQ ID NO: 21078 - DNA, 20 bp, synthetic construct
  source 1..20: mol_type = other DNA
tttgtgttgcttttagcagc

SEQ ID NO: 21079 - DNA, 20 bp, synthetic construct
  source 1..20: mol_type = other DNA
cgcgggtttgcttcctatat

SEQ ID NO: 21080 - DNA, 20 bp, synthetic construct
  source 1..20: mol_type = other DNA
tgattcccttcataaagctg

SEQ ID NO: 21081 - DNA, 20 bp, synthetic construct
  source 1..20: mol_type = other DNA
tgcggccttagcggctcggg

SEQ ID NO: 21082 - DNA, 20 bp, synthetic construct
  source 1..20: mol_type = other DNA
aggaggtgacctggctgctt

SEQ ID NO: 21083 - DNA, 20 bp, synthetic construct
  source 1..20: mol_type = other DNA
gtaggggaaacaacgtcacc

SEQ ID NO: 21084 - DNA, 20 bp, synthetic construct
  source 1..20: mol_type = other DNA
gaaaaacacgacgaaagcgt

SEQ ID NO: 21085 - DNA, 20 bp, synthetic construct
  source 1..20: mol_type = other DNA
atataatcgccgtttcgtaa

SEQ ID NO: 21086 - DNA, 20 bp, synthetic construct
  source 1..20: mol_type = other DNA
tgtatgtgaaaggttggctg

SEQ ID NO: 21087 - DNA, 20 bp, synthetic construct
  source 1..20: mol_type = other DNA
agtcgctcggaaacgactca

SEQ ID NO: 21088 - DNA, 20 bp, synthetic construct
  source 1..20: mol_type = other DNA
cagcttttgagtctagacag

SEQ ID NO: 21089 - DNA, 20 bp, synthetic construct
  source 1..20: mol_type = other DNA
gaccgtctttgccgccttca

SEQ ID NO: 21090 - DNA, 20 bp, synthetic construct
  source 1..20: mol_type = other DNA
gacaacggcacgctcagcgt

SEQ ID NO: 21091 - DNA, 20 bp, synthetic construct
  source 1..20: mol_type = other DNA
actccaccgagacgctcacc

SEQ ID NO: 21092 - DNA, 20 bp, synthetic construct
  source 1..20: mol_type = other DNA
ctcagcctggttttcactct

SEQ ID NO: 21093 - DNA, 20 bp, synthetic construct
  source 1..20: mol_type = other DNA
tagcttcgagaccttgcgga

SEQ ID NO: 21094 - DNA, 20 bp, synthetic construct
  source 1..20: mol_type = other DNA
aactggttttcggacagagc

SEQ ID NO: 21095 - DNA, 20 bp, synthetic construct
  source 1..20: mol_type = other DNA
tcaacaataaagctttttca

SEQ ID NO: 21096 - DNA, 20 bp, synthetic construct
  source 1..20: mol_type = other DNA
cgggtcggatacagggtgcc

SEQ ID NO: 21097 - DNA, 20 bp, synthetic construct
  source 1..20: mol_type = other DNA
atgcctataaaaccgcgccc

SEQ ID NO: 21098 - DNA, 20 bp, synthetic construct
  source 1..20: mol_type = other DNA
agcggcgtcgccccagttcg

SEQ ID NO: 21099 - DNA, 20 bp, synthetic construct
  source 1..20: mol_type = other DNA
cgcgcagcgcgctttatccg

SEQ ID NO: 21100 - DNA, 20 bp, synthetic construct
  source 1..20: mol_type = other DNA
tttctctgcttcttttctgg

SEQ ID NO: 21101 - DNA, 20 bp, synthetic construct
  source 1..20: mol_type = other DNA
cgtcgatgtcagtcttttcg

SEQ ID NO: 21102 - DNA, 20 bp, synthetic construct
  source 1..20: mol_type = other DNA
ccgaatcgtaccggcgtctg

SEQ ID NO: 21103 - DNA, 20 bp, synthetic construct
  source 1..20: mol_type = other DNA
acaaaccccgtgtccgcccc

SEQ ID NO: 21104 - DNA, 20 bp, synthetic construct
  source 1..20: mol_type = other DNA
cctgggtacttatggggagc

SEQ ID NO: 21105 - DNA, 20 bp, synthetic construct
  source 1..20: mol_type = other DNA
catcggtgacacagcttcag

SEQ ID NO: 21106 - DNA, 20 bp, synthetic construct
  source 1..20: mol_type = other DNA
ctgtgtttccgcctgtataa

SEQ ID NO: 21107 - DNA, 20 bp, synthetic construct
  source 1..20: mol_type = other DNA
ggggtgaacaacactaatcg

SEQ ID NO: 21108 - DNA, 20 bp, synthetic construct
  source 1..20: mol_type = other DNA
cgtcggcacttggcttcaga

SEQ ID NO: 21109 - DNA, 20 bp, synthetic construct
  source 1..20: mol_type = other DNA
taccagcggttacgcaccga

SEQ ID NO: 21110 - DNA, 20 bp, synthetic construct
  source 1..20: mol_type = other DNA
atgaccatcagcagtgtcct

SEQ ID NO: 21111 - DNA, 20 bp, synthetic construct
  source 1..20: mol_type = other DNA
ctacgtaacctggcctttgc

SEQ ID NO: 21112 - DNA, 20 bp, synthetic construct
  source 1..20: mol_type = other DNA
catgcagcgtgcggcgcctc

SEQ ID NO: 21113 - DNA, 20 bp, synthetic construct
  source 1..20: mol_type = other DNA
acacagccagacgcgttcgt

SEQ ID NO: 21114 - DNA, 20 bp, synthetic construct
  source 1..20: mol_type = other DNA
cggcgtgtcctcgttgctcg

SEQ ID NO: 21115 - DNA, 20 bp, synthetic construct
  source 1..20: mol_type = other DNA
gtatgcaggtaagcaactga

SEQ ID NO: 21116 - DNA, 20 bp, synthetic construct
  source 1..20: mol_type = other DNA
cggcgcgttataagcaccgt

SEQ ID NO: 21117 - DNA, 20 bp, synthetic construct
  source 1..20: mol_type = other DNA
ccgtcgctccgcgtcgcttc

SEQ ID NO: 21118 - DNA, 20 bp, synthetic construct
  source 1..20: mol_type = other DNA
ccgagcgcgccggggagaag

SEQ ID NO: 21119 - DNA, 20 bp, synthetic construct
  source 1..20: mol_type = other DNA
gacgcggtttatatacaccg

SEQ ID NO: 21120 - DNA, 20 bp, synthetic construct
  source 1..20: mol_type = other DNA
ttaaactaccccccctccct

SEQ ID NO: 21121 - DNA, 20 bp, synthetic construct
  source 1..20: mol_type = other DNA
gcgcagtccggggcgacgac

SEQ ID NO: 21122 - DNA, 20 bp, synthetic construct
  source 1..20: mol_type = other DNA
aagcgtcgtcgccccggact

SEQ ID NO: 21123 - DNA, 20 bp, synthetic construct
  source 1..20: mol_type = other DNA
aaaacgacgtcccccgtcga

SEQ ID NO: 21124 - DNA, 20 bp, synthetic construct
  source 1..20: mol_type = other DNA
ctgctcgcacggacctatac

SEQ ID NO: 21125 - DNA, 20 bp, synthetic construct
  source 1..20: mol_type = other DNA
acgtcaacgctgatagtgtc

SEQ ID NO: 21126 - DNA, 20 bp, synthetic construct
  source 1..20: mol_type = other DNA
tcggctgctgcagcacaacg

SEQ ID NO: 21127 - DNA, 20 bp, synthetic construct
  source 1..20: mol_type = other DNA
ggtttcgctgtagctgtggt

SEQ ID NO: 21128 - DNA, 20 bp, synthetic construct
  source 1..20: mol_type = other DNA
gctacgacctggcctgtggt

SEQ ID NO: 21129 - DNA, 20 bp, synthetic construct
  source 1..20: mol_type = other DNA
gtaccgtctccaccacagtt

SEQ ID NO: 21130 - DNA, 20 bp, synthetic construct
  source 1..20: mol_type = other DNA
cttcaacgacgcgaaagagg

SEQ ID NO: 21131 - DNA, 20 bp, synthetic construct
  source 1..20: mol_type = other DNA
cgctcgctcgcgcccgctcc

SEQ ID NO: 21132 - DNA, 20 bp, synthetic construct
  source 1..20: mol_type = other DNA
gacagcatacggggaggaga

SEQ ID NO: 21133 - DNA, 20 bp, synthetic construct
  source 1..20: mol_type = other DNA
ctttattgaaatctacctga

SEQ ID NO: 21134 - DNA, 20 bp, synthetic construct
  source 1..20: mol_type = other DNA
tggcaacattccattgtggg

SEQ ID NO: 21135 - DNA, 20 bp, synthetic construct
  source 1..20: mol_type = other DNA
gcgcctggtgatcggcgtgg

SEQ ID NO: 21136 - DNA, 20 bp, synthetic construct
  source 1..20: mol_type = other DNA
gacccgcccgccggctcgac

SEQ ID NO: 21137 - DNA, 20 bp, synthetic construct
  source 1..20: mol_type = other DNA
agacggcgccccgctgtgtc

SEQ ID NO: 21138 - DNA, 20 bp, synthetic construct
  source 1..20: mol_type = other DNA
accgtcatcgtggtggcgag

SEQ ID NO: 21139 - DNA, 20 bp, synthetic construct
  source 1..20: mol_type = other DNA
gctggtgctggctcttctgc

SEQ ID NO: 21140 - DNA, 20 bp, synthetic construct
  source 1..20: mol_type = other DNA
gtcacggagagatcctccgt

SEQ ID NO: 21141 - DNA, 20 bp, synthetic construct
  source 1..20: mol_type = other DNA
aagacgagccggcgccgggt

SEQ ID NO: 21142 - DNA, 20 bp, synthetic construct
  source 1..20: mol_type = other DNA
tcggattcatggcgatcggc

SEQ ID NO: 21143 - DNA, 20 bp, synthetic construct
  source 1..20: mol_type = other DNA
gcgtcggcaccggagaatcc

SEQ ID NO: 21144 - DNA, 20 bp, synthetic construct
  source 1..20: mol_type = other DNA
cttcaaggcctttcagatta

SEQ ID NO: 21145 - DNA, 20 bp, synthetic construct
  source 1..20: mol_type = other DNA
gcctgcatgatcatcgtcat

SEQ ID NO: 21146 - DNA, 20 bp, synthetic construct
  source 1..20: mol_type = other DNA
acggtaattttcctttcttc

SEQ ID NO: 21147 - DNA, 20 bp, synthetic construct
  source 1..20: mol_type = other DNA
cagggagcgggaccgacctt

SEQ ID NO: 21148 - DNA, 20 bp, synthetic construct
  source 1..20: mol_type = other DNA
cactgtccatctccctgtct

SEQ ID NO: 21149 - DNA, 20 bp, synthetic construct
  source 1..20: mol_type = other DNA
cgggaaggattgacgtgtgc

SEQ ID NO: 21150 - DNA, 20 bp, synthetic construct
  source 1..20: mol_type = other DNA
gcaaccgcagccagaccgca

SEQ ID NO: 21151 - DNA, 20 bp, synthetic construct
  source 1..20: mol_type = other DNA
aaaattcactcagtggcggc

SEQ ID NO: 21152 - DNA, 20 bp, synthetic construct
  source 1..20: mol_type = other DNA
catctacgaacggattccat

SEQ ID NO: 21153 - DNA, 20 bp, synthetic construct
  source 1..20: mol_type = other DNA
cgaggacgacgacgtctgat

SEQ ID NO: 21154 - DNA, 20 bp, synthetic construct
  source 1..20: mol_type = other DNA
tgatctttgttggtgcactg

SEQ ID NO: 21155 - DNA, 20 bp, synthetic construct
  source 1..20: mol_type = other DNA
ccgacgcgcccatgccgccg

SEQ ID NO: 21156 - DNA, 20 bp, synthetic construct
  source 1..20: mol_type = other DNA
tatgccaagatgctaaggca

SEQ ID NO: 21157 - DNA, 20 bp, synthetic construct
  source 1..20: mol_type = other DNA
cccacttggaaaaagcaata

SEQ ID NO: 21158 - DNA, 20 bp, synthetic construct
  source 1..20: mol_type = other DNA
ggcagtcatgcaagaccccc

SEQ ID NO: 21159 - DNA, 20 bp, synthetic construct
  source 1..20: mol_type = other DNA
tgaaccacctcactggagca

SEQ ID NO: 21160 - DNA, 20 bp, synthetic construct
  source 1..20: mol_type = other DNA
tgataagggtacacttgcca

SEQ ID NO: 21161 - DNA, 20 bp, synthetic construct
  source 1..20: mol_type = other DNA
catttccaagaccacagata

SEQ ID NO: 21162 - DNA, 20 bp, synthetic construct
  source 1..20: mol_type = other DNA
gatgattagaatctcttgtc

SEQ ID NO: 21163 - DNA, 20 bp, synthetic construct
  source 1..20: mol_type = other DNA
tatttcccatagtaataatt

SEQ ID NO: 21164 - DNA, 20 bp, synthetic construct
  source 1..20: mol_type = other DNA
atcagcttctgaatttattg

SEQ ID NO: 21165 - DNA, 20 bp, synthetic construct
  source 1..20: mol_type = other DNA
tagtggttttgctgtttttg

SEQ ID NO: 21166 - DNA, 20 bp, synthetic construct
  source 1..20: mol_type = other DNA
cgaaacaagaggggacgtca

SEQ ID NO: 21167 - DNA, 20 bp, synthetic construct
  source 1..20: mol_type = other DNA
gcaagtggcgcccaacgtgg

SEQ ID NO: 21168 - DNA, 20 bp, synthetic construct
  source 1..20: mol_type = other DNA
aatagtttatcacaacttaa

SEQ ID NO: 21169 - DNA, 20 bp, synthetic construct
  source 1..20: mol_type = other DNA
ttatcacaacttaaaagtga

SEQ ID NO: 21170 - DNA, 20 bp, synthetic construct
  source 1..20: mol_type = other DNA
ataacgattggctctgtttc

SEQ ID NO: 21171 - DNA, 20 bp, synthetic construct
  source 1..20: mol_type = other DNA
tgccataagcaccacattcc

SEQ ID NO: 21172 - DNA, 20 bp, synthetic construct
  source 1..20: mol_type = other DNA
aaactgatggggaacgccag

SEQ ID NO: 21173 - DNA, 20 bp, synthetic construct
  source 1..20: mol_type = other DNA
tactattactttctttaaca

SEQ ID NO: 21174 - DNA, 20 bp, synthetic construct
  source 1..20: mol_type = other DNA
gataactgacgaggaaatgc

SEQ ID NO: 21175 - DNA, 20 bp, synthetic construct
  source 1..20: mol_type = other DNA
ccatggccgagctagcctgt

SEQ ID NO: 21176 - DNA, 20 bp, synthetic construct
  source 1..20: mol_type = other DNA
cttgatgccatttgcgacaa

SEQ ID NO: 21177 - DNA, 20 bp, synthetic construct
  source 1..20: mol_type = other DNA
gggtccctatcctcctgact

SEQ ID NO: 21178 - DNA, 20 bp, synthetic construct
  source 1..20: mol_type = other DNA
ggacctcggtcgaaaatact

SEQ ID NO: 21179 - DNA, 20 bp, synthetic construct
  source 1..20: mol_type = other DNA
ttgcctaattctaacgggag

SEQ ID NO: 21180 - DNA, 20 bp, synthetic construct
  source 1..20: mol_type = other DNA
ctaccccacgtatgatctgg

SEQ ID NO: 21181 - DNA, 20 bp, synthetic construct
  source 1..20: mol_type = other DNA
cccacctgtctgacttggcc

SEQ ID NO: 21182 - DNA, 20 bp, synthetic construct
  source 1..20: mol_type = other DNA
tggaactgacgggcactgcg

SEQ ID NO: 21183 - DNA, 20 bp, synthetic construct
  source 1..20: mol_type = other DNA
gtcgtgttgaccggctcagg

SEQ ID NO: 21184 - DNA, 20 bp, synthetic construct
  source 1..20: mol_type = other DNA
gagactagctataaaagagg

SEQ ID NO: 21185 - DNA, 20 bp, synthetic construct
  source 1..20: mol_type = other DNA
atcacgcatgcgtgtgatga

SEQ ID NO: 21186 - DNA, 20 bp, synthetic construct
  source 1..20: mol_type = other DNA
tcgatgagtttatgtctgtc

SEQ ID NO: 21187 - DNA, 20 bp, synthetic construct
  source 1..20: mol_type = other DNA
tattaaagtttggaaataag

SEQ ID NO: 21188 - DNA, 20 bp, synthetic construct
  source 1..20: mol_type = other DNA
ccaaccatttgattagaagg

SEQ ID NO: 21189 - DNA, 20 bp, synthetic construct
  source 1..20: mol_type = other DNA
aagagaagccctcgagacct

SEQ ID NO: 21190 - DNA, 20 bp, synthetic construct
  source 1..20: mol_type = other DNA
tggcatccttgcccaccagc

SEQ ID NO: 21191 - DNA, 20 bp, synthetic construct
  source 1..20: mol_type = other DNA
ccgtcagataggggaagggt

SEQ ID NO: 21192 - DNA, 20 bp, synthetic construct
  source 1..20: mol_type = other DNA
ctgctgtctcaggaggggcc

SEQ ID NO: 21193 - DNA, 20 bp, synthetic construct
  source 1..20: mol_type = other DNA
ggacgatttacctggatgct

SEQ ID NO: 21194 - DNA, 20 bp, synthetic construct
  source 1..20: mol_type = other DNA
agctcttaagagagagcagc

SEQ ID NO: 21195 - DNA, 20 bp, synthetic construct
  source 1..20: mol_type = other DNA
ttcgccagccgccgggcggg

SEQ ID NO: 21196 - DNA, 20 bp, synthetic construct
  source 1..20: mol_type = other DNA
ggaagtcttggcggcgttgg

SEQ ID NO: 21197 - DNA, 20 bp, synthetic construct
  source 1..20: mol_type = other DNA
ccccacctccaccaccggcc

SEQ ID NO: 21198 - DNA, 20 bp, synthetic construct
  source 1..20: mol_type = other DNA
agggcttcttcagagggagc

SEQ ID NO: 21199 - DNA, 20 bp, synthetic construct
  source 1..20: mol_type = other DNA
aaaacctgagctcgtcctcg

SEQ ID NO: 21200 - DNA, 20 bp, synthetic construct
  source 1..20: mol_type = other DNA
gcgcgtcatccccgcgcacc

SEQ ID NO: 21201 - DNA, 20 bp, synthetic construct
  source 1..20: mol_type = other DNA
acaaggcacttcagagccca

SEQ ID NO: 21202 - DNA, 20 bp, synthetic construct
  source 1..20: mol_type = other DNA
ttaaggtattgcacagagac

SEQ ID NO: 21203 - DNA, 20 bp, synthetic construct
  source 1..20: mol_type = other DNA
ttctggccggccgagcgaag

SEQ ID NO: 21204 - DNA, 20 bp, synthetic construct
  source 1..20: mol_type = other DNA
gtcgcccgccccccgactct

SEQ ID NO: 21205 - DNA, 20 bp, synthetic construct
  source 1..20: mol_type = other DNA
gccagatacttcagaagggt

SEQ ID NO: 21206 - DNA, 20 bp, synthetic construct
  source 1..20: mol_type = other DNA
gccgggacgctagtgctgca

SEQ ID NO: 21207 - DNA, 20 bp, synthetic construct
  source 1..20: mol_type = other DNA
tggacacgcaagggcgaatg

SEQ ID NO: 21208 - DNA, 20 bp, synthetic construct
  source 1..20: mol_type = other DNA
ttcctcttttgctgcagaca

SEQ ID NO: 21209 - DNA, 20 bp, synthetic construct
  source 1..20: mol_type = other DNA
gagaccgccgccgcactgct

SEQ ID NO: 21210 - DNA, 20 bp, synthetic construct
  source 1..20: mol_type = other DNA
cggccaggccctgcccccgg

SEQ ID NO: 21211 - DNA, 20 bp, synthetic construct
  source 1..20: mol_type = other DNA
atttaaggatctatatgccc

SEQ ID NO: 21212 - DNA, 20 bp, synthetic construct
  source 1..20: mol_type = other DNA
gccaccgttctccccggact

SEQ ID NO: 21213 - DNA, 20 bp, synthetic construct
  source 1..20: mol_type = other DNA
agggcctggccggggctgac

SEQ ID NO: 21214 - DNA, 20 bp, synthetic construct
  source 1..20: mol_type = other DNA
gcctcgcgcagcgcccggca

SEQ ID NO: 21215 - DNA, 20 bp, synthetic construct
  source 1..20: mol_type = other DNA
ccgtgacgtgggccctggcc

SEQ ID NO: 21216 - DNA, 20 bp, synthetic construct
  source 1..20: mol_type = other DNA
taacatttaatgtgggactg

SEQ ID NO: 21217 - DNA, 20 bp, synthetic construct
  source 1..20: mol_type = other DNA
ccaacaggaggagctgagcg

SEQ ID NO: 21218 - DNA, 20 bp, synthetic construct
  source 1..20: mol_type = other DNA
caaacacagaatctgtagac

SEQ ID NO: 21219 - DNA, 20 bp, synthetic construct
  source 1..20: mol_type = other DNA
aattggggtgatcctgtagc

SEQ ID NO: 21220 - DNA, 20 bp, synthetic construct
  source 1..20: mol_type = other DNA
gtgtcctgtttggactttta

SEQ ID NO: 21221 - DNA, 20 bp, synthetic construct
  source 1..20: mol_type = other DNA
cttcagaagagaccttctct

SEQ ID NO: 21222 - DNA, 20 bp, synthetic construct
  source 1..20: mol_type = other DNA
tttcccttactcttccttct

SEQ ID NO: 21223 - DNA, 20 bp, synthetic construct
  source 1..20: mol_type = other DNA
ctgccgctactgctgctact

SEQ ID NO: 21224 - DNA, 20 bp, synthetic construct
  source 1..20: mol_type = other DNA
aaccttctaagcacccgcgc

SEQ ID NO: 21225 - DNA, 20 bp, synthetic construct
  source 1..20: mol_type = other DNA
ggggcgcgctgggccgcggc

SEQ ID NO: 21226 - DNA, 20 bp, synthetic construct
  source 1..20: mol_type = other DNA
gttaacctgatagcatagcc

SEQ ID NO: 21227 - DNA, 20 bp, synthetic construct
  source 1..20: mol_type = other DNA
ttctagttccctcttaatta

SEQ ID NO: 21228 - DNA, 20 bp, synthetic construct
  source 1..20: mol_type = other DNA
tacagtcctatcaaacttcc

SEQ ID NO: 21229 - DNA, 20 bp, synthetic construct
  source 1..20: mol_type = other DNA
ccggtattaaaaacccagaa

SEQ ID NO: 21230 - DNA, 20 bp, synthetic construct
  source 1..20: mol_type = other DNA
ttccggtcagggggtttggc

SEQ ID NO: 21231 - DNA, 20 bp, synthetic construct
  source 1..20: mol_type = other DNA
gcgccgtggaagaaggaact

SEQ ID NO: 21232 - DNA, 20 bp, synthetic construct
  source 1..20: mol_type = other DNA
gtggaacacgtgccccccga

SEQ ID NO: 21233 - DNA, 20 bp, synthetic construct
  source 1..20: mol_type = other DNA
cgtttgctccatctgtcagc

SEQ ID NO: 21234 - DNA, 20 bp, synthetic construct
  source 1..20: mol_type = other DNA
gaccagaaggggggcgacaa

SEQ ID NO: 21235 - DNA, 20 bp, synthetic construct
  source 1..20: mol_type = other DNA
cccgttctctttcttagtat

SEQ ID NO: 21236 - DNA, 20 bp, synthetic construct
  source 1..20: mol_type = other DNA
gttcctcaaccagcccacga

SEQ ID NO: 21237 - DNA, 20 bp, synthetic construct
  source 1..20: mol_type = other DNA
gggcagcggggtcgtcccca

SEQ ID NO: 21238 - DNA, 20 bp, synthetic construct
  source 1..20: mol_type = other DNA
cccgtggtggagattgacag

SEQ ID NO: 21239 - DNA, 20 bp, synthetic construct
  source 1..20: mol_type = other DNA
gggggacaagagcacaaaag

SEQ ID NO: 21240 - DNA, 20 bp, synthetic construct
  source 1..20: mol_type = other DNA
gttttactgaacgagcctgt

SEQ ID NO: 21241 - DNA, 20 bp, synthetic construct
  source 1..20: mol_type = other DNA
aagagagttccgattacacc

SEQ ID NO: 21242 - DNA, 20 bp, synthetic construct
  source 1..20: mol_type = other DNA
ccactccagcaacaccgcac

SEQ ID NO: 21243 - DNA, 20 bp, synthetic construct
  source 1..20: mol_type = other DNA
gcaccccaagaaagtgaagc

SEQ ID NO: 21244 - DNA, 20 bp, synthetic construct
  source 1..20: mol_type = other DNA
cgccggtcgctgtggggcca

SEQ ID NO: 21245 - DNA, 20 bp, synthetic construct
  source 1..20: mol_type = other DNA
gccatcgttctgtttagccc

SEQ ID NO: 21246 - DNA, 20 bp, synthetic construct
  source 1..20: mol_type = other DNA
tcgtcaggccgcgagaggat

SEQ ID NO: 21247 - DNA, 20 bp, synthetic construct
  source 1..20: mol_type = other DNA
gacattatttaagaccggga

SEQ ID NO: 21248 - DNA, 20 bp, synthetic construct
  source 1..20: mol_type = other DNA
cagttcaaacccagagacac

SEQ ID NO: 21249 - DNA, 20 bp, synthetic construct
  source 1..20: mol_type = other DNA
acgatgagtgatttcgccca

SEQ ID NO: 21250 - DNA, 20 bp, synthetic construct
  source 1..20: mol_type = other DNA
tgacaattttagatgaggta

SEQ ID NO: 21251 - DNA, 20 bp, synthetic construct
  source 1..20: mol_type = other DNA
acacctaaatttagcacgtc

SEQ ID NO: 21252 - DNA, 20 bp, synthetic construct
  source 1..20: mol_type = other DNA
cactaaacattgcaccttgc

SEQ ID NO: 21253 - DNA, 20 bp, synthetic construct
  source 1..20: mol_type = other DNA
gagtaatctccacactcccg

SEQ ID NO: 21254 - DNA, 20 bp, synthetic construct
  source 1..20: mol_type = other DNA
ttctactttaaaaaggccgg

SEQ ID NO: 21255 - DNA, 20 bp, synthetic construct
  source 1..20: mol_type = other DNA
aacccgaaacagtgtttccc

SEQ ID NO: 21256 - DNA, 20 bp, synthetic construct
  source 1..20: mol_type = other DNA
ttctttatctccatcctgaa

SEQ ID NO: 21257 - DNA, 20 bp, synthetic construct
  source 1..20: mol_type = other DNA
cctggcccagaacagcaccc

SEQ ID NO: 21258 - DNA, 20 bp, synthetic construct
  source 1..20: mol_type = other DNA
cattaagcagtgaagtaaag

SEQ ID NO: 21259 - DNA, 20 bp, synthetic construct
  source 1..20: mol_type = other DNA
aatcaggcgcaccttggcac

SEQ ID NO: 21260 - DNA, 20 bp, synthetic construct
  source 1..20: mol_type = other DNA
tcgcctccaatttggctata

SEQ ID NO: 21261 - DNA, 20 bp, synthetic construct
  source 1..20: mol_type = other DNA
agtaaaatatggacaaaaag

SEQ ID NO: 21262 - DNA, 20 bp, synthetic construct
  source 1..20: mol_type = other DNA
tgcagatgaggcaacacaat

SEQ ID NO: 21263 - DNA, 20 bp, synthetic construct
  source 1..20: mol_type = other DNA
ccccccacggagcgacccga

SEQ ID NO: 21264 - DNA, 20 bp, synthetic construct
  source 1..20: mol_type = other DNA
ggtccctcctttggttcgtg

SEQ ID NO: 21265 - DNA, 20 bp, synthetic construct
  source 1..20: mol_type = other DNA
ttctgtgccttctgtacatc

SEQ ID NO: 21266 - DNA, 20 bp, synthetic construct
  source 1..20: mol_type = other DNA
agtgagcttctgttaagttg

SEQ ID NO: 21267 - DNA, 20 bp, synthetic construct
  source 1..20: mol_type = other DNA
ttgaataatttctactgaaa

SEQ ID NO: 21268 - DNA, 20 bp, synthetic construct
  source 1..20: mol_type = other DNA
gtcgaggtgccctatttagg

SEQ ID NO: 21269 - DNA, 20 bp, synthetic construct
  source 1..20: mol_type = other DNA
agagggcaggcaccggcagt

SEQ ID NO: 21270 - DNA, 20 bp, synthetic construct
  source 1..20: mol_type = other DNA
tggtaagcttttcaagagcg

SEQ ID NO: 21271 - DNA, 20 bp, synthetic construct
  source 1..20: mol_type = other DNA
aatcccgcacccccctggca

SEQ ID NO: 21272 - DNA, 20 bp, synthetic construct
  source 1..20: mol_type = other DNA
ccactgacgctggcaggcct

SEQ ID NO: 21273 - DNA, 20 bp, synthetic construct
  source 1..20: mol_type = other DNA
tttttgtggcggcccttgtg

SEQ ID NO: 21274 - DNA, 20 bp, synthetic construct
  source 1..20: mol_type = other DNA
gcctttcagtggagcttagg

SEQ ID NO: 21275 - DNA, 20 bp, synthetic construct
  source 1..20: mol_type = other DNA
cgggtgtcgcgctttggggg

SEQ ID NO: 21276 - DNA, 20 bp, synthetic construct
  source 1..20: mol_type = other DNA
aaaaccacctcactagacat

SEQ ID NO: 21277 - DNA, 20 bp, synthetic construct
  source 1..20: mol_type = other DNA
ggaacctggtgccctcctcc

SEQ ID NO: 21278 - DNA, 20 bp, synthetic construct
  source 1..20: mol_type = other DNA
gatcctaacatctgtttcgg

SEQ ID NO: 21279 - DNA, 20 bp, synthetic construct
  source 1..20: mol_type = other DNA
tcctttgtttttccacatcg

SEQ ID NO: 21280 - DNA, 20 bp, synthetic construct
  source 1..20: mol_type = other DNA
cagcctgctactgtgtgtaa

SEQ ID NO: 21281 - DNA, 20 bp, synthetic construct
  source 1..20: mol_type = other DNA
taaaaactgaagaaggcgtg

SEQ ID NO: 21282 - DNA, 20 bp, synthetic construct
  source 1..20: mol_type = other DNA
agacgttggtgtgttgaagg

SEQ ID NO: 21283 - DNA, 20 bp, synthetic construct
  source 1..20: mol_type = other DNA
ggcaagcagtggagcaagac

SEQ ID NO: 21284 - DNA, 20 bp, synthetic construct
  source 1..20: mol_type = other DNA
aaagaagagagctggcacgt

SEQ ID NO: 21285 - DNA, 20 bp, synthetic construct
  source 1..20: mol_type = other DNA
gtttgcttgggggtggctat

SEQ ID NO: 21286 - DNA, 20 bp, synthetic construct
  source 1..20: mol_type = other DNA
taagagcacactgtgtggtt

SEQ ID NO: 21287 - DNA, 20 bp, synthetic construct
  source 1..20: mol_type = other DNA
gttgcaggggttaatgccat

SEQ ID NO: 21288 - DNA, 20 bp, synthetic construct
  source 1..20: mol_type = other DNA
atcctggagtttacaggtag

SEQ ID NO: 21289 - DNA, 20 bp, synthetic construct
  source 1..20: mol_type = other DNA
ctggtctttatcgtcgcgtt

SEQ ID NO: 21290 - DNA, 20 bp, synthetic construct
  source 1..20: mol_type = other DNA
gtggcgtccgtgaatacgtt

SEQ ID NO: 21291 - DNA, 20 bp, synthetic construct
  source 1..20: mol_type = other DNA
gctcacctcccctttccctt

SEQ ID NO: 21292 - DNA, 20 bp, synthetic construct
  source 1..20: mol_type = other DNA
ataaaggggcgtggcttcca

SEQ ID NO: 21293 - DNA, 20 bp, synthetic construct
  source 1..20: mol_type = other DNA
cacccttggtgctgtgcgcg

SEQ ID NO: 21294 - DNA, 20 bp, synthetic construct
  source 1..20: mol_type = other DNA
atgccagcttcatacgggac

SEQ ID NO: 21295 - DNA, 20 bp, synthetic construct
  source 1..20: mol_type = other DNA
gccaattcccggtcggcatc

SEQ ID NO: 21296 - DNA, 20 bp, synthetic construct
  source 1..20: mol_type = other DNA
gtgaccacgcactatagtgc

SEQ ID NO: 21297 - DNA, 20 bp, synthetic construct
  source 1..20: mol_type = other DNA
gccattatacacacgggttt

SEQ ID NO: 21298 - DNA, 20 bp, synthetic construct
  source 1..20: mol_type = other DNA
ggcaggacacaacatctaca

SEQ ID NO: 21299 - DNA, 20 bp, synthetic construct
  source 1..20: mol_type = other DNA
cgtccatatccgtgctggtt

SEQ ID NO: 21300 - DNA, 20 bp, synthetic construct
  source 1..20: mol_type = other DNA
tttctccgccgcgccccacc

SEQ ID NO: 21301 - DNA, 20 bp, synthetic construct
  source 1..20: mol_type = other DNA
cgccagccgatccccgcgta

SEQ ID NO: 21302 - DNA, 20 bp, synthetic construct
  source 1..20: mol_type = other DNA
cttctctggcgtccttgccg

SEQ ID NO: 21303 - DNA, 20 bp, synthetic construct
  source 1..20: mol_type = other DNA
cctccgtggcgaggtacggg

SEQ ID NO: 21304 - DNA, 20 bp, synthetic construct
  source 1..20: mol_type = other DNA
cggaaacaaggtggtgtatt

SEQ ID NO: 21305 - DNA, 20 bp, synthetic construct
  source 1..20: mol_type = other DNA
ttctcctatcttcagagtct

SEQ ID NO: 21306 - DNA, 20 bp, synthetic construct
  source 1..20: mol_type = other DNA
tcctgttggtattccccacg

SEQ ID NO: 21307 - DNA, 20 bp, synthetic construct
  source 1..20: mol_type = other DNA
gcgggggtcagggcactcga

SEQ ID NO: 21308 - DNA, 20 bp, synthetic construct
  source 1..20: mol_type = other DNA
tacgccctggtctgtagcat

SEQ ID NO: 21309 - DNA, 20 bp, synthetic construct
  source 1..20: mol_type = other DNA
agtcagcgggagtcttgtgg

SEQ ID NO: 21310 - DNA, 20 bp, synthetic construct
  source 1..20: mol_type = other DNA
aagggtgcgccatccgtgcc

SEQ ID NO: 21311 - DNA, 20 bp, synthetic construct
  source 1..20: mol_type = other DNA
tctcctgcaggttggcggca

SEQ ID NO: 21312 - DNA, 20 bp, synthetic construct
  source 1..20: mol_type = other DNA
gggccagaggtttgaggcgc

SEQ ID NO: 21313 - DNA, 20 bp, synthetic construct
  source 1..20: mol_type = other DNA
ggtcgacgccgtcgcggacc

SEQ ID NO: 21314 - DNA, 20 bp, synthetic construct
  source 1..20: mol_type = other DNA
gacccgcacgtggagattcc

SEQ ID NO: 21315 - DNA, 20 bp, synthetic construct
  source 1..20: mol_type = other DNA
tctcccgccgcagcgccgcc

SEQ ID NO: 21316 - DNA, 20 bp, synthetic construct
  source 1..20: mol_type = other DNA
aaccgacgtgggacagaaat

SEQ ID NO: 21317 - DNA, 20 bp, synthetic construct
  source 1..20: mol_type = other DNA
acggcagaaaggggccttcg

SEQ ID NO: 21318 - DNA, 20 bp, synthetic construct
  source 1..20: mol_type = other DNA
acctgtcaatctgttccact

SEQ ID NO: 21319 - DNA, 20 bp, synthetic construct
  source 1..20: mol_type = other DNA
tacagttggccaatgcattc

SEQ ID NO: 21320 - DNA, 20 bp, synthetic construct
  source 1..20: mol_type = other DNA
gacctctgacataagaatac

SEQ ID NO: 21321 - DNA, 20 bp, synthetic construct
  source 1..20: mol_type = other DNA
ttgccttatccaaggacagt

SEQ ID NO: 21322 - DNA, 20 bp, synthetic construct
  source 1..20: mol_type = other DNA
tgtgctttgtaaatttccgc

SEQ ID NO: 21323 - DNA, 20 bp, synthetic construct
  source 1..20: mol_type = other DNA
atttcagtaattgtcctcat

SEQ ID NO: 21324 - DNA, 20 bp, synthetic construct
  source 1..20: mol_type = other DNA
ttgccacccagctactggtt

SEQ ID NO: 21325 - DNA, 20 bp, synthetic construct
  source 1..20: mol_type = other DNA
tcctatgggggttgggtggg

SEQ ID NO: 21326 - DNA, 20 bp, synthetic construct
  source 1..20: mol_type = other DNA
ctccgttgtcgactataacc

SEQ ID NO: 21327 - DNA, 20 bp, synthetic construct
  source 1..20: mol_type = other DNA
ttctaaatttgcttgtttcg

SEQ ID NO: 21328 - DNA, 20 bp, synthetic construct
  source 1..20: mol_type = other DNA
acgcggaacgttggatagac

SEQ ID NO: 21329 - DNA, 20 bp, synthetic construct
  source 1..20: mol_type = other DNA
gttgccgcgtccaaaaaggt

SEQ ID NO: 21330 - DNA, 20 bp, synthetic construct
  source 1..20: mol_type = other DNA
cactaatatgtcagccacct

SEQ ID NO: 21331 - DNA, 20 bp, synthetic construct
  source 1..20: mol_type = other DNA
tgcttaccactggacattgc

SEQ ID NO: 21332 - DNA, 20 bp, synthetic construct
  source 1..20: mol_type = other DNA
gggactgtgcctcaaagacg

SEQ ID NO: 21333 - DNA, 20 bp, synthetic construct
  source 1..20: mol_type = other DNA
agacctgtacgcccttctgt

SEQ ID NO: 21334 - DNA, 20 bp, synthetic construct
  source 1..20: mol_type = other DNA
tgtctaatacaggcaatgct

SEQ ID NO: 21335 - DNA, 20 bp, synthetic construct
  source 1..20: mol_type = other DNA
gttgaggtggggtaatgctc

SEQ ID NO: 21336 - DNA, 20 bp, synthetic construct
  source 1..20: mol_type = other DNA
gtcgcccacggaaaaggtgt

SEQ ID NO: 21337 - DNA, 20 bp, synthetic construct
  source 1..20: mol_type = other DNA
tcgtgggaaggtgcccaaaa

SEQ ID NO: 21338 - DNA, 20 bp, synthetic construct
  source 1..20: mol_type = other DNA
tacgctgggcacagttccct

SEQ ID NO: 21339 - DNA, 20 bp, synthetic construct
  source 1..20: mol_type = other DNA
gcaaggggggtgcggtgttg

SEQ ID NO: 21340 - DNA, 20 bp, synthetic construct
  source 1..20: mol_type = other DNA
gaatgatgagtgatttcaac

SEQ ID NO: 21341 - DNA, 20 bp, synthetic construct
  source 1..20: mol_type = other DNA
gttccaggtcggggaccaag

SEQ ID NO: 21342 - DNA, 20 bp, synthetic construct
  source 1..20: mol_type = other DNA
tcggcggcggcggaacgagt

SEQ ID NO: 21343 - DNA, 20 bp, synthetic construct
  source 1..20: mol_type = other DNA
cgggaggtaagctggccagc

SEQ ID NO: 21344 - DNA, 20 bp, synthetic construct
  source 1..20: mol_type = other DNA
tagagaggcgcgctctgcca

SEQ ID NO: 21345 - DNA, 20 bp, synthetic construct
  source 1..20: mol_type = other DNA
actgggtgttccagactagt

SEQ ID NO: 21346 - DNA, 20 bp, synthetic construct
  source 1..20: mol_type = other DNA
cggctggtcgagtcccatac

SEQ ID NO: 21347 - DNA, 20 bp, synthetic construct
  source 1..20: mol_type = other DNA
ccactctatgcccggccatt

SEQ ID NO: 21348 - DNA, 20 bp, synthetic construct
  source 1..20: mol_type = other DNA
aaagtgctaaagactctcaa

SEQ ID NO: 21349 - DNA, 20 bp, synthetic construct
  source 1..20: mol_type = other DNA
tgaatactggccgcggctcc

SEQ ID NO: 21350 - DNA, 20 bp, synthetic construct
  source 1..20: mol_type = other DNA
gtaagtgtgctggtgtggac

SEQ ID NO: 21351 - DNA, 20 bp, synthetic construct
  source 1..20: mol_type = other DNA
ggtacggcacgtagcattgc

SEQ ID NO: 21352 - DNA, 20 bp, synthetic construct
  source 1..20: mol_type = other DNA
ctccttttttgccactatgc

SEQ ID NO: 21353 - DNA, 20 bp, synthetic construct
  source 1..20: mol_type = other DNA
ccaaagggtacaacctacgc

SEQ ID NO: 21354 - DNA, 20 bp, synthetic construct
  source 1..20: mol_type = other DNA
cttgtgagaaacacttggag

SEQ ID NO: 21355 - DNA, 20 bp, synthetic construct
  source 1..20: mol_type = other DNA
cgcttatggttacaactaat

SEQ ID NO: 21356 - DNA, 20 bp, synthetic construct
  source 1..20: mol_type = other DNA
ttgtgtttatttgtgtaatt

SEQ ID NO: 21357 - DNA, 20 bp, synthetic construct
  source 1..20: mol_type = other DNA
agacacttgtgtttgtgagt

SEQ ID NO: 21358 - DNA, 20 bp, synthetic construct
  source 1..20: mol_type = other DNA
tacacaatattccacgacaa

SEQ ID NO: 21359 - DNA, 20 bp, synthetic construct
  source 1..20: mol_type = other DNA
acgtactgtaagtgttgaca

SEQ ID NO: 21360 - DNA, 20 bp, synthetic construct
  source 1..20: mol_type = other DNA
ggaataggagttatactgct

SEQ ID NO: 21361 - DNA, 20 bp, synthetic construct
  source 1..20: mol_type = other DNA
ggtcaataccccgaggtgtg

SEQ ID NO: 21362 - DNA, 20 bp, synthetic construct
  source 1..20: mol_type = other DNA
ggcggacctgcattggcagc

SEQ ID NO: 21363 - DNA, 20 bp, synthetic construct
  source 1..20: mol_type = other DNA
ggatgcacccgctgcggggt

SEQ ID NO: 21364 - DNA, 20 bp, synthetic construct
  source 1..20: mol_type = other DNA
accgctgcgcagcagtatcc

SEQ ID NO: 21365 - DNA, 20 bp, synthetic construct
  source 1..20: mol_type = other DNA
cctcctcgtccctgatctaa

SEQ ID NO: 21366 - DNA, 20 bp, synthetic construct
  source 1..20: mol_type = other DNA
atgtgtaaataaagttgtac

SEQ ID NO: 21367 - DNA, 20 bp, synthetic construct
  source 1..20: mol_type = other DNA
caccccagcatcctttaatt

SEQ ID NO: 21368 - DNA, 20 bp, synthetic construct
  source 1..20: mol_type = other DNA
gggagagcttaacttgtatg

SEQ ID NO: 21369 - DNA, 20 bp, synthetic construct
  source 1..20: mol_type = other DNA
atggatgagcccaccctcct

SEQ ID NO: 21370 - DNA, 20 bp, synthetic construct
  source 1..20: mol_type = other DNA
gtctacctgcgcacgccctt

SEQ ID NO: 21371 - DNA, 20 bp, synthetic construct
  source 1..20: mol_type = other DNA
accggcgcacgtcctgactg

SEQ ID NO: 21372 - DNA, 20 bp, synthetic construct
  source 1..20: mol_type = other DNA
catcacccagggcgcgatcc

SEQ ID NO: 21373 - DNA, 20 bp, synthetic construct
  source 1..20: mol_type = other DNA
aacgcgcgcccacccggaaa

SEQ ID NO: 21374 - DNA, 20 bp, synthetic construct
  source 1..20: mol_type = other DNA
gcttttgtgatcatggcctg

SEQ ID NO: 21375 - DNA, 20 bp, synthetic construct
  source 1..20: mol_type = other DNA
gaggagaaggaaaaattgct

SEQ ID NO: 21376 - DNA, 20 bp, synthetic construct
  source 1..20: mol_type = other DNA
gcgggctttgtaactctgat

SEQ ID NO: 21377 - DNA, 20 bp, synthetic construct
  source 1..20: mol_type = other DNA
ctactcagcttctcttactg

SEQ ID NO: 21378 - DNA, 20 bp, synthetic construct
  source 1..20: mol_type = other DNA
gtctgcagcattgtctgcgt

SEQ ID NO: 21379 - DNA, 20 bp, synthetic construct
  source 1..20: mol_type = other DNA
gaatacagggacgagaacgt

SEQ ID NO: 21380 - DNA, 20 bp, synthetic construct
  source 1..20: mol_type = other DNA
tccccggcccccttccactg

SEQ ID NO: 21381 - DNA, 20 bp, synthetic construct
  source 1..20: mol_type = other DNA
aagtcatcttccacccggag

SEQ ID NO: 21382 - DNA, 20 bp, synthetic construct
  source 1..20: mol_type = other DNA
tagttgttcagcagcacctc

SEQ ID NO: 21383 - DNA, 20 bp, synthetic construct
  source 1..20: mol_type = other DNA
gttttgaacacgctgcaggt

SEQ ID NO: 21384 - DNA, 20 bp, synthetic construct
  source 1..20: mol_type = other DNA
cgtaggagccatataccgcg

SEQ ID NO: 21385 - DNA, 20 bp, synthetic construct
  source 1..20: mol_type = other DNA
gtcaaagtccggtgtttatg

SEQ ID NO: 21386 - DNA, 20 bp, synthetic construct
  source 1..20: mol_type = other DNA
ggagccgcggctaacgtggt

SEQ ID NO: 21387 - DNA, 20 bp, synthetic construct
  source 1..20: mol_type = other DNA
gtcgcaccgcgcgtcctttc

SEQ ID NO: 21388 - DNA, 20 bp, synthetic construct
  source 1..20: mol_type = other DNA
tggcccaatcgcgaagaggc

SEQ ID NO: 21389 - DNA, 20 bp, synthetic construct
  source 1..20: mol_type = other DNA
atatttgtgtgacagtgcaa

SEQ ID NO: 21390 - DNA, 20 bp, synthetic construct
  source 1..20: mol_type = other DNA
gtagaagcagacctgtgtgg

SEQ ID NO: 21391 - DNA, 20 bp, synthetic construct
  source 1..20: mol_type = other DNA
aagcaaaccgactcccggcg

SEQ ID NO: 21392 - DNA, 20 bp, synthetic construct
  source 1..20: mol_type = other DNA
gaggaaaaaaggaagaggtc

SEQ ID NO: 21393 - DNA, 20 bp, synthetic construct
  source 1..20: mol_type = other DNA
ggtagaactgctgctgctgt

SEQ ID NO: 21394 - DNA, 20 bp, synthetic construct
  source 1..20: mol_type = other DNA
ggactgggcggtggaatgct

SEQ ID NO: 21395 - DNA, 20 bp, synthetic construct
  source 1..20: mol_type = other DNA
aatggctgagtttccatgtc

SEQ ID NO: 21396 - DNA, 20 bp, synthetic construct
  source 1..20: mol_type = other DNA
tgatcatccacaagacccag

SEQ ID NO: 21397 - DNA, 20 bp, synthetic construct
  source 1..20: mol_type = other DNA
agccagcattcttttgacca

SEQ ID NO: 21398 - DNA, 20 bp, synthetic construct
  source 1..20: mol_type = other DNA
ggtttggcgggattttttac

SEQ ID NO: 21399 - DNA, 20 bp, synthetic construct
  source 1..20: mol_type = other DNA
attgcccgcactggagcaga

SEQ ID NO: 21400 - DNA, 20 bp, synthetic construct
  source 1..20: mol_type = other DNA
gatggacagattgagtaaaa

SEQ ID NO: 21401 - DNA, 20 bp, synthetic construct
  source 1..20: mol_type = other DNA
aacggcgggaatcacgtcac

SEQ ID NO: 21402 - DNA, 20 bp, synthetic construct
  source 1..20: mol_type = other DNA
atctaagatctttttttttt

SEQ ID NO: 21403 - DNA, 20 bp, synthetic construct
  source 1..20: mol_type = other DNA
gtatttttttttcactttac

SEQ ID NO: 21404 - DNA, 20 bp, synthetic construct
  source 1..20: mol_type = other DNA
taggcgatgttgacgagccg

SEQ ID NO: 21405 - DNA, 20 bp, synthetic construct
  source 1..20: mol_type = other DNA
agggcgacggcctagtcgtg

SEQ ID NO: 21406 - DNA, 20 bp, synthetic construct
  source 1..20: mol_type = other DNA
tgacgagtcttccttctatt

SEQ ID NO: 21407 - DNA, 20 bp, synthetic construct
  source 1..20: mol_type = other DNA
tgtcagaatatctatcattt

SEQ ID NO: 21408 - DNA, 20 bp, synthetic construct
  source 1..20: mol_type = other DNA
ggtgtaaacatgaaagtact

SEQ ID NO: 21409 - DNA, 20 bp, synthetic construct
  source 1..20: mol_type = other DNA
gtaaccttaccatcatgctt

SEQ ID NO: 21410 - DNA, 20 bp, synthetic construct
  source 1..20: mol_type = other DNA
cggagacagcgtaaccaccg

SEQ ID NO: 21411 - DNA, 20 bp, synthetic construct
  source 1..20: mol_type = other DNA
aaggataagaccaaagttct

SEQ ID NO: 21412 - DNA, 20 bp, synthetic construct
  source 1..20: mol_type = other DNA
gacaccaagaatgagtggac

SEQ ID NO: 21413 - DNA, 20 bp, synthetic construct
  source 1..20: mol_type = other DNA
agcaggagcagctctccttc

SEQ ID NO: 21414 - DNA, 20 bp, synthetic construct
  source 1..20: mol_type = other DNA
cgacgaccccgaacccgcag

SEQ ID NO: 21415 - DNA, 20 bp, synthetic construct
  source 1..20: mol_type = other DNA
ggctcgtccgggatctgttc

SEQ ID NO: 21416 - DNA, 20 bp, synthetic construct
  source 1..20: mol_type = other DNA
atgtgtcccttccccaaaat

SEQ ID NO: 21417 - DNA, 20 bp, synthetic construct
  source 1..20: mol_type = other DNA
ccgggtggtgacagaatgtg

SEQ ID NO: 21418 - DNA, 20 bp, synthetic construct
  source 1..20: mol_type = other DNA
acgtatgtcagccaatcagc

SEQ ID NO: 21419 - DNA, 20 bp, synthetic construct
  source 1..20: mol_type = other DNA
gagtgaacatctctgggaag

SEQ ID NO: 21420 - DNA, 20 bp, synthetic construct
  source 1..20: mol_type = other DNA
tacttctgccttctttgata

SEQ ID NO: 21421 - DNA, 20 bp, synthetic construct
  source 1..20: mol_type = other DNA
agaagcatcggaagtggatt

SEQ ID NO: 21422 - DNA, 20 bp, synthetic construct
  source 1..20: mol_type = other DNA
tgaataatttctactgaaag

SEQ ID NO: 21423 - DNA, 20 bp, synthetic construct
  source 1..20: mol_type = other DNA
tccggtgctttacaccggag

SEQ ID NO: 21424 - DNA, 20 bp, synthetic construct
  source 1..20: mol_type = other DNA
ctcgctcagcacgagatctg

SEQ ID NO: 21425 - DNA, 20 bp, synthetic construct
  source 1..20: mol_type = other DNA
cggtgtatcttaacccaggc

SEQ ID NO: 21426 - DNA, 20 bp, synthetic construct
  source 1..20: mol_type = other DNA
gttcgcagacggccgcggcg

SEQ ID NO: 21427 - DNA, 20 bp, synthetic construct
  source 1..20: mol_type = other DNA
aataaaactcaccaaggcca

SEQ ID NO: 21428 - DNA, 20 bp, synthetic construct
  source 1..20: mol_type = other DNA
tgggcatagtcgcgccgcgc

SEQ ID NO: 21429 - DNA, 20 bp, synthetic construct
  source 1..20: mol_type = other DNA
caccccagcatcctttaatc

SEQ ID NO: 21430 - DNA, 20 bp, synthetic construct
  source 1..20: mol_type = other DNA
tgctattaagagaggaaaga

SEQ ID NO: 21431 - DNA, 20 bp, synthetic construct
  source 1..20: mol_type = other DNA
cctgtgggggttctagacga

SEQ ID NO: 21432 - DNA, 20 bp, synthetic construct
  source 1..20: mol_type = other DNA
acaaaaacgaagatcagctg

SEQ ID NO: 21433 - DNA, 20 bp, synthetic construct
  source 1..20: mol_type = other DNA
gcgcgcccacccggaaaaaa

SEQ ID NO: 21434 - DNA, 20 bp, synthetic construct
  source 1..20: mol_type = other DNA
taccgaacttcgacgcagtt

SEQ ID NO: 21435 - DNA, 20 bp, synthetic construct
  source 1..20: mol_type = other DNA
ttagcccatacaaggtggtc

SEQ ID NO: 21436 - DNA, 20 bp, synthetic construct
  source 1..20: mol_type = other DNA
ggggtctaaggaatcttctt

SEQ ID NO: 21437 - DNA, 20 bp, synthetic construct
  source 1..20: mol_type = other DNA
acctgcgtctgcagcattgt

SEQ ID NO: 21438 - DNA, 20 bp, synthetic construct
  source 1..20: mol_type = other DNA
atacacactacaaaacagtt

SEQ ID NO: 21439 - DNA, 20 bp, synthetic construct
  source 1..20: mol_type = other DNA
tggcctgtaccgggaccgag

SEQ ID NO: 21440 - DNA, 20 bp, synthetic construct
  source 1..20: mol_type = other DNA
taaaagcgcaccgcggcacg

SEQ ID NO: 21441 - DNA, 20 bp, synthetic construct
  source 1..20: mol_type = other DNA
aaggtcttagaaactctcaa

SEQ ID NO: 21442 - DNA, 20 bp, synthetic construct
  source 1..20: mol_type = other DNA
tttgtgaacttctttaaatc

SEQ ID NO: 21443 - DNA, 20 bp, synthetic construct
  source 1..20: mol_type = other DNA
aggggcacttgttctttgtc

SEQ ID NO: 21444 - DNA, 20 bp, synthetic construct
  source 1..20: mol_type = other DNA
agattaaggcaaccagtggt

SEQ ID NO: 21445 - DNA, 20 bp, synthetic construct
  source 1..20: mol_type = other DNA
caacaaccccctaacctccc

SEQ ID NO: 21446 - DNA, 20 bp, synthetic construct
  source 1..20: mol_type = other DNA
cccgcaccatcgtcgagcgt

SEQ ID NO: 21447 - DNA, 20 bp, synthetic construct
  source 1..20: mol_type = other DNA
tcactgcgaattgtgtggat

SEQ ID NO: 21448 - DNA, 20 bp, synthetic construct
  source 1..20: mol_type = other DNA
ggaaaacggggtcattttgc

SEQ ID NO: 21449 - DNA, 20 bp, synthetic construct
  source 1..20: mol_type = other DNA
aaactcatgatgtgtagtcc

SEQ ID NO: 21450 - DNA, 20 bp, synthetic construct
  source 1..20: mol_type = other DNA
ggggcttggatacgagggaa

SEQ ID NO: 21451 - DNA, 20 bp, synthetic construct
  source 1..20: mol_type = other DNA
tgggacggaaccgactactt

SEQ ID NO: 21452 - DNA, 20 bp, synthetic construct
  source 1..20: mol_type = other DNA
atgaaccattgagatttctc

SEQ ID NO: 21453 - DNA, 20 bp, synthetic construct
  source 1..20: mol_type = other DNA
tcgcggctggccgaccatga

SEQ ID NO: 21454 - DNA, 20 bp, synthetic construct
  source 1..20: mol_type = other DNA
tgaagtattgagatttctct

SEQ ID NO: 21455 - DNA, 20 bp, synthetic construct
  source 1..20: mol_type = other DNA
cgcggctggccgaccataac

SEQ ID NO: 21456 - DNA, 20 bp, synthetic construct
  source 1..20: mol_type = other DNA
gatcatgttttacaacagta

SEQ ID NO: 21457 - DNA, 20 bp, synthetic construct
  source 1..20: mol_type = other DNA
ccgaagtcgggcatcccaaa

SEQ ID NO: 21458 - DNA, 20 bp, synthetic construct
  source 1..20: mol_type = other DNA
cctcgcctagtcccaacaca

SEQ ID NO: 21459 - DNA, 20 bp, synthetic construct
  source 1..20: mol_type = other DNA
acacccgacgggacacaaat

SEQ ID NO: 21460 - DNA, 20 bp, synthetic construct
  source 1..20: mol_type = other DNA
ctccacaggccatccctctc

SEQ ID NO: 21461 - DNA, 20 bp, synthetic construct
  source 1..20: mol_type = other DNA
aaatcaagagaggctgagtt

SEQ ID NO: 21462 - DNA, 20 bp, synthetic construct
  source 1..20: mol_type = other DNA
ttcccagtacttcttatata

SEQ ID NO: 21463 - DNA, 20 bp, synthetic construct
  source 1..20: mol_type = other DNA
gaaacaaggtagcctagctt

SEQ ID NO: 21464 - DNA, 20 bp, synthetic construct
  source 1..20: mol_type = other DNA
cttaggtggtattgagaaac

SEQ ID NO: 21465 - DNA, 20 bp, synthetic construct
  source 1..20: mol_type = other DNA
agcctgccggcggatgcctg

SEQ ID NO: 21466 - DNA, 20 bp, synthetic construct
  source 1..20: mol_type = other DNA
tatcccattgccatcccaac

SEQ ID NO: 21467 - DNA, 20 bp, synthetic construct
  source 1..20: mol_type = other DNA
taagacttgttgtgtggaga

SEQ ID NO: 21468 - DNA, 20 bp, synthetic construct
  source 1..20: mol_type = other DNA
gaatgcgtatccggaacgcc

SEQ ID NO: 21469 - DNA, 20 bp, synthetic construct
  source 1..20: mol_type = other DNA
caagacacaccttaacctgg

SEQ ID NO: 21470 - DNA, 20 bp, synthetic construct
  source 1..20: mol_type = other DNA
agcacccctgggtcacgccc

SEQ ID NO: 21471 - DNA, 20 bp, synthetic construct
  source 1..20: mol_type = other DNA
cctggtactacgagcttggg

SEQ ID NO: 21472 - DNA, 20 bp, synthetic construct
  source 1..20: mol_type = other DNA
gagactggccgaaaggcagc

SEQ ID NO: 21473 - DNA, 20 bp, synthetic construct
  source 1..20: mol_type = other DNA
tagggtgacggtatttacat

SEQ ID NO: 21474 - DNA, 20 bp, synthetic construct
  source 1..20: mol_type = other DNA
tgttacagtaccattaacat

SEQ ID NO: 21475 - DNA, 20 bp, synthetic construct
  source 1..20: mol_type = other DNA
tagtacatctcctaccaatg

SEQ ID NO: 21476 - DNA, 20 bp, synthetic construct
  source 1..20: mol_type = other DNA
ctcacgcgctgtcaataccg

SEQ ID NO: 21477 - DNA, 20 bp, synthetic construct
  source 1..20: mol_type = other DNA
ttctttgagacctcgttggc

SEQ ID NO: 21478 - DNA, 20 bp, synthetic construct
  source 1..20: mol_type = other DNA
gacagtccctgcattgcact

SEQ ID NO: 21479 - DNA, 20 bp, synthetic construct
  source 1..20: mol_type = other DNA
acgttaaagggaggtaacca

SEQ ID NO: 21480 - DNA, 20 bp, synthetic construct
  source 1..20: mol_type = other DNA
aggtaacacgcgacactcgg

SEQ ID NO: 21481 - DNA, 20 bp, synthetic construct
  source 1..20: mol_type = other DNA
aagggtggaaggccagcgtt

SEQ ID NO: 21482 - DNA, 20 bp, synthetic construct
  source 1..20: mol_type = other DNA
tgcacaaggttgttctgccc

SEQ ID NO: 21483 - DNA, 20 bp, synthetic construct
  source 1..20: mol_type = other DNA
cccaacagatcaaagtgtat

SEQ ID NO: 21484 - DNA, 20 bp, synthetic construct
  source 1..20: mol_type = other DNA
tgaactccaagttcacgttt

SEQ ID NO: 21485 - DNA, 20 bp, synthetic construct
  source 1..20: mol_type = other DNA
ttgagctccggctacctgtg

SEQ ID NO: 21486 - DNA, 20 bp, synthetic construct
  source 1..20: mol_type = other DNA
ctgcctaccacaagggcccg

SEQ ID NO: 21487 - DNA, 20 bp, synthetic construct
  source 1..20: mol_type = other DNA
cagttaaagcagaaacaatc

SEQ ID NO: 21488 - DNA, 20 bp, synthetic construct
  source 1..20: mol_type = other DNA
tcgatgaggccaaaccctgg

SEQ ID NO: 21489 - DNA, 20 bp, synthetic construct
  source 1..20: mol_type = other DNA
ccagtctctttcacgtgccg

SEQ ID NO: 21490 - DNA, 20 bp, synthetic construct
  source 1..20: mol_type = other DNA
gcgagtggctggtcaagctg

SEQ ID NO: 21491 - DNA, 20 bp, synthetic construct
  source 1..20: mol_type = other DNA
ccggcaggaccgattctgtt

SEQ ID NO: 21492 - DNA, 20 bp, synthetic construct
  source 1..20: mol_type = other DNA
tcaaagcacttgaagacacc

SEQ ID NO: 21493 - DNA, 20 bp, synthetic construct
  source 1..20: mol_type = other DNA
catttgtgaaacgtgctttt

SEQ ID NO: 21494 - DNA, 20 bp, synthetic construct
  source 1..20: mol_type = other DNA
gtcagagacctctgaaagtg

SEQ ID NO: 21495 - DNA, 20 bp, synthetic construct
  source 1..20: mol_type = other DNA
tgattgtcactgagagtggt

SEQ ID NO: 21496 - DNA, 20 bp, synthetic construct
  source 1..20: mol_type = other DNA
aggacggagctgacaccttc

SEQ ID NO: 21497 - DNA, 20 bp, synthetic construct
  source 1..20: mol_type = other DNA
taatgcgcaaaaccaagctt

SEQ ID NO: 21498 - DNA, 20 bp, synthetic construct
  source 1..20: mol_type = other DNA
tgttccgccgctgcgctgct

SEQ ID NO: 21499 - DNA, 20 bp, synthetic construct
  source 1..20: mol_type = other DNA
tttacctgcgttgggtgaac

SEQ ID NO: 21500 - DNA, 20 bp, synthetic construct
  source 1..20: mol_type = other DNA
tcctggagcaccccccctag

SEQ ID NO: 21501 - DNA, 20 bp, synthetic construct
  source 1..20: mol_type = other DNA
gcaaagcgcaaagtccagcg

SEQ ID NO: 21502 - DNA, 20 bp, synthetic construct
  source 1..20: mol_type = other DNA
attggtgatgttacaactca

SEQ ID NO: 21503 - DNA, 20 bp, synthetic construct
  source 1..20: mol_type = other DNA
ctcccatcccagtcgtatct

SEQ ID NO: 21504 - DNA, 20 bp, synthetic construct
  source 1..20: mol_type = other DNA
gcagctgctgcccaaccaga

SEQ ID NO: 21505 - DNA, 20 bp, synthetic construct
  source 1..20: mol_type = other DNA
gagataattggagggctgac

SEQ ID NO: 21506 - DNA, 20 bp, synthetic construct
  source 1..20: mol_type = other DNA
gttcttaagtttttcctctt

SEQ ID NO: 21507 - DNA, 20 bp, synthetic construct
  source 1..20: mol_type = other DNA
ggggacacggttgatggttt

SEQ ID NO: 21508 - DNA, 20 bp, synthetic construct
  source 1..20: mol_type = other DNA
caaccaccatgtggagctgg

SEQ ID NO: 21509 - DNA, 20 bp, synthetic construct
  source 1..20: mol_type = other DNA
ctgtgctcctccgggcatgt

SEQ ID NO: 21510 - DNA, 20 bp, synthetic construct
  source 1..20: mol_type = other DNA
gtgaccagataccaaatgtg

SEQ ID NO: 21511 - DNA, 20 bp, synthetic construct
  source 1..20: mol_type = other DNA
gttgacgaagaagaaatcgt

SEQ ID NO: 21512 - DNA, 20 bp, synthetic construct
  source 1..20: mol_type = other DNA
attctggaggcatctacccc

SEQ ID NO: 21513 - DNA, 20 bp, synthetic construct
  source 1..20: mol_type = other DNA
aacattcctggttgtccttt

SEQ ID NO: 21514 - DNA, 20 bp, synthetic construct
  source 1..20: mol_type = other DNA
accttgagagctgcagtggc

SEQ ID NO: 21515 - DNA, 20 bp, synthetic construct
  source 1..20: mol_type = other DNA
ttgcgtgatgcacttgagac

SEQ ID NO: 21516 - DNA, 20 bp, synthetic construct
  source 1..20: mol_type = other DNA
ggtttcctcaaacaaagatc

SEQ ID NO: 21517 - DNA, 20 bp, synthetic construct
  source 1..20: mol_type = other DNA
cgtctgttgtcgatgtggtc

SEQ ID NO: 21518 - DNA, 20 bp, synthetic construct
  source 1..20: mol_type = other DNA
ggaggaccgatgatcgctta

SEQ ID NO: 21519 - DNA, 20 bp, synthetic construct
  source 1..20: mol_type = other DNA
accgtaatttggaaaagcgc

SEQ ID NO: 21520 - DNA, 20 bp, synthetic construct
  source 1..20: mol_type = other DNA
aagccttactactttcttac

SEQ ID NO: 21521 - DNA, 20 bp, synthetic construct
  source 1..20: mol_type = other DNA
gacaaacttcccgagactgt

SEQ ID NO: 21522 - DNA, 20 bp, synthetic construct
  source 1..20: mol_type = other DNA
tgggcgctagcactctggta

SEQ ID NO: 21523 - DNA, 20 bp, synthetic construct
  source 1..20: mol_type = other DNA
gtaaaagatatcatgattaa

SEQ ID NO: 21524 - DNA, 20 bp, synthetic construct
  source 1..20: mol_type = other DNA
agatccaatgaaggatctgg

SEQ ID NO: 21525 - DNA, 20 bp, synthetic construct
  source 1..20: mol_type = other DNA
gccgctatagggagagttgc

SEQ ID NO: 21526 - DNA, 20 bp, synthetic construct
  source 1..20: mol_type = other DNA
cagccctcaaccacacagaa

SEQ ID NO: 21527 - DNA, 20 bp, synthetic construct
  source 1..20: mol_type = other DNA
ttgagcattggcaacgccta

SEQ ID NO: 21528 - DNA, 20 bp, synthetic construct
  source 1..20: mol_type = other DNA
aacaatagctggcttaagaa

SEQ ID NO: 21529 - DNA, 20 bp, synthetic construct
  source 1..20: mol_type = other DNA
cagatcgccacaatcgagca

SEQ ID NO: 21530 - DNA, 20 bp, synthetic construct
  source 1..20: mol_type = other DNA
ttcagagacatcagaggctt

SEQ ID NO: 21531 - DNA, 20 bp, synthetic construct
  source 1..20: mol_type = other DNA
cccacaagagcaggccagtg

SEQ ID NO: 21532 - DNA, 20 bp, synthetic construct
  source 1..20: mol_type = other DNA
attaggacactaatgctaaa

SEQ ID NO: 21533 - DNA, 20 bp, synthetic construct
  source 1..20: mol_type = other DNA
gcttggcataacggggagca

SEQ ID NO: 21534 - DNA, 20 bp, synthetic construct
  source 1..20: mol_type = other DNA
caactctacgcaggaagtgg

SEQ ID NO: 21535 - DNA, 20 bp, synthetic construct
  source 1..20: mol_type = other DNA
cctgtcaaagacatcttcac

SEQ ID NO: 21536 - DNA, 20 bp, synthetic construct
  source 1..20: mol_type = other DNA
tctgatgctactgcagtgga

SEQ ID NO: 21537 - DNA, 20 bp, synthetic construct
  source 1..20: mol_type = other DNA
ggaggccccttacccaagga

SEQ ID NO: 21538 - DNA, 20 bp, synthetic construct
  source 1..20: mol_type = other DNA
tggtaccagacgaattatgt

SEQ ID NO: 21539 - DNA, 20 bp, synthetic construct
  source 1..20: mol_type = other DNA
ggggacagcgtgagcagagc

SEQ ID NO: 21540 - DNA, 20 bp, synthetic construct
  source 1..20: mol_type = other DNA
aattcacatagcacagctga

SEQ ID NO: 21541 - DNA, 20 bp, synthetic construct
  source 1..20: mol_type = other DNA
tgcccattggtgatcaggat

SEQ ID NO: 21542 - DNA, 20 bp, synthetic construct
  source 1..20: mol_type = other DNA
cagtccggagctatctacgt

SEQ ID NO: 21543 - DNA, 20 bp, synthetic construct
  source 1..20: mol_type = other DNA
gggatagtttccaccggggg

SEQ ID NO: 21544 - DNA, 20 bp, synthetic construct
  source 1..20: mol_type = other DNA
gcatcaattttgggcatacc

SEQ ID NO: 21545 - DNA, 20 bp, synthetic construct
  source 1..20: mol_type = other DNA
ctaggcatcaagaaaaagga

SEQ ID NO: 21546 - DNA, 20 bp, synthetic construct
  source 1..20: mol_type = other DNA
atgacccctgccgacaagtc

SEQ ID NO: 21547 - DNA, 20 bp, synthetic construct
  source 1..20: mol_type = other DNA
gtggcggctagtacactggt

SEQ ID NO: 21548 - DNA, 20 bp, synthetic construct
  source 1..20: mol_type = other DNA
aagtggccgatccgttatcc

SEQ ID NO: 21549 - DNA, 20 bp, synthetic construct
  source 1..20: mol_type = other DNA
ctaaaggacgtgctcataaa

SEQ ID NO: 21550 - DNA, 20 bp, synthetic construct
  source 1..20: mol_type = other DNA
gaagcaaacccggtggacca

SEQ ID NO: 21551 - DNA, 20 bp, synthetic construct
  source 1..20: mol_type = other DNA
atggacatgtacagagttac

SEQ ID NO: 21552 - DNA, 20 bp, synthetic construct
  source 1..20: mol_type = other DNA
ggtattgaagatttgatttc

SEQ ID NO: 21553 - DNA, 20 bp, synthetic construct
  source 1..20: mol_type = other DNA
accgactcaatagcaaggtg

SEQ ID NO: 21554 - DNA, 20 bp, synthetic construct
  source 1..20: mol_type = other DNA
ttgtacgcacttgaggccaa

SEQ ID NO: 21555 - DNA, 20 bp, synthetic construct
  source 1..20: mol_type = other DNA
aacacctccacctactcgct

SEQ ID NO: 21556 - DNA, 20 bp, synthetic construct
  source 1..20: mol_type = other DNA
gggtttgactatgcagtggc

SEQ ID NO: 21557 - DNA, 20 bp, synthetic construct
  source 1..20: mol_type = other DNA
gccctcgaagatcaggcagg

SEQ ID NO: 21558 - DNA, 20 bp, synthetic construct
  source 1..20: mol_type = other DNA
tcatacttcactcagagcca

SEQ ID NO: 21559 - DNA, 20 bp, synthetic construct
  source 1..20: mol_type = other DNA
acagactttgaagaagcaat

SEQ ID NO: 21560 - DNA, 20 bp, synthetic construct
  source 1..20: mol_type = other DNA
gtggaacagggaaaatccag

SEQ ID NO: 21561 - DNA, 20 bp, synthetic construct
  source 1..20: mol_type = other DNA
gaagaaaagctatttgcctt

SEQ ID NO: 21562 - DNA, 20 bp, synthetic construct
  source 1..20: mol_type = other DNA
ggcggcatgccatctggctg

SEQ ID NO: 21563 - DNA, 20 bp, synthetic construct
  source 1..20: mol_type = other DNA
aaccggacagcggcgtgctg

SEQ ID NO: 21564 - DNA, 20 bp, synthetic construct
  source 1..20: mol_type = other DNA
cgccttttgggatgcaggaa

SEQ ID NO: 21565 - DNA, 20 bp, synthetic construct
  source 1..20: mol_type = other DNA
attgtctaagcagcagcagg

SEQ ID NO: 21566 - DNA, 20 bp, synthetic construct
  source 1..20: mol_type = other DNA
acaagcgagggttggatctg

SEQ ID NO: 21567 - DNA, 20 bp, synthetic construct
  source 1..20: mol_type = other DNA
caccacctggtcaagaacgg

SEQ ID NO: 21568 - DNA, 20 bp, synthetic construct
  source 1..20: mol_type = other DNA
ccccaccagttgctaaattt

SEQ ID NO: 21569 - DNA, 20 bp, synthetic construct
  source 1..20: mol_type = other DNA
gatgtggcaaaacagacata

SEQ ID NO: 21570 - DNA, 20 bp, synthetic construct
  source 1..20: mol_type = other DNA
ccctcccctgctgacttcat

SEQ ID NO: 21571 - DNA, 20 bp, synthetic construct
  source 1..20: mol_type = other DNA
ccggcggacctgcccgacaa

SEQ ID NO: 21572 - DNA, 20 bp, synthetic construct
  source 1..20: mol_type = other DNA
tctcctgccacacatgttct

SEQ ID NO: 21573 - DNA, 20 bp, synthetic construct
  source 1..20: mol_type = other DNA
gttggagcaccaaccaagac

SEQ ID NO: 21574 - DNA, 20 bp, synthetic construct
  source 1..20: mol_type = other DNA
gacactgggtttttcttttc

SEQ ID NO: 21575 - DNA, 20 bp, synthetic construct
  source 1..20: mol_type = other DNA
aaattgaaggaacctgatac

SEQ ID NO: 21576 - DNA, 20 bp, synthetic construct
  source 1..20: mol_type = other DNA
actgactgctctgccttggg

SEQ ID NO: 21577 - DNA, 20 bp, synthetic construct
  source 1..20: mol_type = other DNA
gttagggctggaaagacccg

SEQ ID NO: 21578 - DNA, 20 bp, synthetic construct
  source 1..20: mol_type = other DNA
gaaattgatttccaacaact

SEQ ID NO: 21579 - DNA, 20 bp, synthetic construct
  source 1..20: mol_type = other DNA
gcaatcttaagctttgttcg

SEQ ID NO: 21580 - DNA, 20 bp, synthetic construct
  source 1..20: mol_type = other DNA
aggcttaattccagacctct

SEQ ID NO: 21581 - DNA, 20 bp, synthetic construct
  source 1..20: mol_type = other DNA
gaacatgtctagacaaggta

SEQ ID NO: 21582 - DNA, 20 bp, synthetic construct
  source 1..20: mol_type = other DNA
aggagcaactgatgtagatg

SEQ ID NO: 21583 - DNA, 20 bp, synthetic construct
  source 1..20: mol_type = other DNA
gaactcaaatgccatgttat

SEQ ID NO: 21584 - DNA, 20 bp, synthetic construct
  source 1..20: mol_type = other DNA
taaaaacttcaaggatgcaa

SEQ ID NO: 21585 - DNA, 20 bp, synthetic construct
  source 1..20: mol_type = other DNA
aggggatgtgcctagagctt

SEQ ID NO: 21586 - DNA, 20 bp, synthetic construct
  source 1..20: mol_type = other DNA
aggcgaaggtcttcctggaa

SEQ ID NO: 21587 - DNA, 20 bp, synthetic construct
  source 1..20: mol_type = other DNA
gaaagtggagtttactcagt

SEQ ID NO: 21588 - DNA, 20 bp, synthetic construct
  source 1..20: mol_type = other DNA
tgtagaagaaccagaggatt

SEQ ID NO: 21589 - DNA, 20 bp, synthetic construct
  source 1..20: mol_type = other DNA
attcggagatgttggtcttg

SEQ ID NO: 21590 - DNA, 20 bp, synthetic construct
  source 1..20: mol_type = other DNA
ttaccatgtctgtggttcaa

SEQ ID NO: 21591 - DNA, 20 bp, synthetic construct
  source 1..20: mol_type = other DNA
ggttggagatctaagtcaac

SEQ ID NO: 21592 - DNA, 20 bp, synthetic construct
  source 1..20: mol_type = other DNA
acctcttcttttctactcca

SEQ ID NO: 21593 - DNA, 20 bp, synthetic construct
  source 1..20: mol_type = other DNA
gctgtagcgaccacacaaag

SEQ ID NO: 21594 - DNA, 20 bp, synthetic construct
  source 1..20: mol_type = other DNA
accgctcatacgcgatattg

SEQ ID NO: 21595 - DNA, 20 bp, synthetic construct
  source 1..20: mol_type = other DNA
caacaccaacaacaagcgtt

SEQ ID NO: 21596 - DNA, 20 bp, synthetic construct
  source 1..20: mol_type = other DNA
acaaggagttgacaatgctg

SEQ ID NO: 21597 - DNA, 20 bp, synthetic construct
  source 1..20: mol_type = other DNA
ctaccaagaaaatgattacc

SEQ ID NO: 21598 - DNA, 20 bp, synthetic construct
  source 1..20: mol_type = other DNA
tacctctgcctccgtccgga

SEQ ID NO: 21599 - DNA, 20 bp, synthetic construct
  source 1..20: mol_type = other DNA
cttcactgatgagttcatca

SEQ ID NO: 21600 - DNA, 20 bp, synthetic construct
  source 1..20: mol_type = other DNA
tgctacttgctcttccttta

SEQ ID NO: 21601 - DNA, 20 bp, synthetic construct
  source 1..20: mol_type = other DNA
aacaaatccaggccctgtgc

SEQ ID NO: 21602 - DNA, 20 bp, synthetic construct
  source 1..20: mol_type = other DNA
ttggctcaaacaaaaattgt

SEQ ID NO: 21603 - DNA, 20 bp, synthetic construct
  source 1..20: mol_type = other DNA
ctctagcttcattgttgcta

SEQ ID NO: 21604 - DNA, 20 bp, synthetic construct
  source 1..20: mol_type = other DNA
tgctcagtctccaccagact

SEQ ID NO: 21605 - DNA, 20 bp, synthetic construct
  source 1..20: mol_type = other DNA
caaactcaaggatgtgagac

SEQ ID NO: 21606 - DNA, 20 bp, synthetic construct
  source 1..20: mol_type = other DNA
cactggaatcatgaacaccg

SEQ ID NO: 21607 - DNA, 20 bp, synthetic construct
  source 1..20: mol_type = other DNA
gaggacagtcgcccacgacg

SEQ ID NO: 21608 - DNA, 20 bp, synthetic construct
  source 1..20: mol_type = other DNA
ggactacgctcattccaaat

SEQ ID NO: 21609 - DNA, 20 bp, synthetic construct
  source 1..20: mol_type = other DNA
caatttctttacagagcaaa

SEQ ID NO: 21610 - DNA, 20 bp, synthetic construct
  source 1..20: mol_type = other DNA
gacctgggctcagcccgggt

SEQ ID NO: 21611 - DNA, 20 bp, synthetic construct
  source 1..20: mol_type = other DNA
agcctaccaagtgcgcaatt

SEQ ID NO: 21612 - DNA, 20 bp, synthetic construct
  source 1..20: mol_type = other DNA
cagggacggcaaactcccca

SEQ ID NO: 21613 - DNA, 20 bp, synthetic construct
  source 1..20: mol_type = other DNA
ggtggggaactgggcgaagg

SEQ ID NO: 21614 - DNA, 20 bp, synthetic construct
  source 1..20: mol_type = other DNA
caatagcacggccttgaact

SEQ ID NO: 21615 - DNA, 20 bp, synthetic construct
  source 1..20: mol_type = other DNA
ccttaacaacaccaggccac

SEQ ID NO: 21616 - DNA, 20 bp, synthetic construct
  source 1..20: mol_type = other DNA
ggaagacagggacaggtccg

SEQ ID NO: 21617 - DNA, 20 bp, synthetic construct
  source 1..20: mol_type = other DNA
ggccattaagtgggagtacg

SEQ ID NO: 21618 - DNA, 20 bp, synthetic construct
  source 1..20: mol_type = other DNA
gttcttctgctttgcgtggt

SEQ ID NO: 21619 - DNA, 20 bp, synthetic construct
  source 1..20: mol_type = other DNA
tgacatcaccaaactactcc

SEQ ID NO: 21620 - DNA, 20 bp, synthetic construct
  source 1..20: mol_type = other DNA
tactggcacctgtgtgtata

SEQ ID NO: 21621 - DNA, 20 bp, synthetic construct
  source 1..20: mol_type = other DNA
cggtaagagcaccaaggtcc

SEQ ID NO: 21622 - DNA, 20 bp, synthetic construct
  source 1..20: mol_type = other DNA
gtactccacctacggcaagt

SEQ ID NO: 21623 - DNA, 20 bp, synthetic construct
  source 1..20: mol_type = other DNA
ccctccgggctccgtcactg

SEQ ID NO: 21624 - DNA, 20 bp, synthetic construct
  source 1..20: mol_type = other DNA
cgcattgggcatcaatgccg

SEQ ID NO: 21625 - DNA, 20 bp, synthetic construct
  source 1..20: mol_type = other DNA
tgaccctacctttaccattg

SEQ ID NO: 21626 - DNA, 20 bp, synthetic construct
  source 1..20: mol_type = other DNA
aatcaccaaatacatcatga

SEQ ID NO: 21627 - DNA, 20 bp, synthetic construct
  source 1..20: mol_type = other DNA
ccccacacactacgtgccgg

SEQ ID NO: 21628 - DNA, 20 bp, synthetic construct
  source 1..20: mol_type = other DNA
gagcgactttaagacctggc

SEQ ID NO: 21629 - DNA, 20 bp, synthetic construct
  source 1..20: mol_type = other DNA
cgtcggtcctaggacctgca

SEQ ID NO: 21630 - DNA, 20 bp, synthetic construct
  source 1..20: mol_type = other DNA
catgactactgacaatctca

SEQ ID NO: 21631 - DNA, 20 bp, synthetic construct
  source 1..20: mol_type = other DNA
cgagcccgaaccggacgtag

SEQ ID NO: 21632 - DNA, 20 bp, synthetic construct
  source 1..20: mol_type = other DNA
ctcccctgacgccgagctca

SEQ ID NO: 21633 - DNA, 20 bp, synthetic construct
  source 1..20: mol_type = other DNA
tcggagattcgccccagccc

SEQ ID NO: 21634 - DNA, 20 bp, synthetic construct
  source 1..20: mol_type = other DNA
cctggcgcccccacattcag

SEQ ID NO: 21635 - DNA, 20 bp, synthetic construct
  source 1..20: mol_type = other DNA
gcctgagaaggggggtcgta

SEQ ID NO: 21636 - DNA, 20 bp, synthetic construct
  source 1..20: mol_type = other DNA
ggtctactaccttacccgtg

SEQ ID NO: 21637 - DNA, 20 bp, synthetic construct
  source 1..20: mol_type = other DNA
gcttgaacaggctctcaact

SEQ ID NO: 21638 - DNA, 20 bp, synthetic construct
  source 1..20: mol_type = other DNA
atcacagcgtgtctcatgcc

SEQ ID NO: 21639 - DNA, 20 bp, synthetic construct
  source 1..20: mol_type = other DNA
cagagggccaatacggtttg

SEQ ID NO: 21640 - DNA, 20 bp, synthetic construct
  source 1..20: mol_type = other DNA
gggcaaaaaacaaaagaaaa

SEQ ID NO: 21641 - DNA, 20 bp, synthetic construct
  source 1..20: mol_type = other DNA
caatcaatgctggattcgag

SEQ ID NO: 21642 - DNA, 20 bp, synthetic construct
  source 1..20: mol_type = other DNA
acccacccttgacataagaa

SEQ ID NO: 21643 - DNA, 20 bp, synthetic construct
  source 1..20: mol_type = other DNA
gaccgacagaggctggggta

SEQ ID NO: 21644 - DNA, 20 bp, synthetic construct
  source 1..20: mol_type = other DNA
agtgcatcgtgagtggttca

SEQ ID NO: 21645 - DNA, 20 bp, synthetic construct
  source 1..20: mol_type = other DNA
tacctcggagtgtgacagca

SEQ ID NO: 21646 - DNA, 20 bp, synthetic construct
  source 1..20: mol_type = other DNA
gcccgccacagaggtgttaa

SEQ ID NO: 21647 - DNA, 20 bp, synthetic construct
  source 1..20: mol_type = other DNA
cgcgtttgggtattggctga

SEQ ID NO: 21648 - DNA, 20 bp, synthetic construct
  source 1..20: mol_type = other DNA
tagtgccagtgctgcccaac

SEQ ID NO: 21649 - DNA, 20 bp, synthetic construct
  source 1..20: mol_type = other DNA
gtacggtcccgaaagagata

SEQ ID NO: 21650 - DNA, 20 bp, synthetic construct
  source 1..20: mol_type = other DNA
ctttgattttttcaccctgg

SEQ ID NO: 21651 - DNA, 20 bp, synthetic construct
  source 1..20: mol_type = other DNA
tcaggtgctcattggaagaa

SEQ ID NO: 21652 - DNA, 20 bp, synthetic construct
  source 1..20: mol_type = other DNA
gtgtcagatcgcgaaagcgc

SEQ ID NO: 21653 - DNA, 20 bp, synthetic construct
  source 1..20: mol_type = other DNA
ctcgccgaagctgtaaggcg

SEQ ID NO: 21654 - DNA, 20 bp, synthetic construct
  source 1..20: mol_type = other DNA
ctctcaaaagcatcaaacaa

SEQ ID NO: 21655 - DNA, 20 bp, synthetic construct
  source 1..20: mol_type = other DNA
gtatccaataaatcctcttg

SEQ ID NO: 21656 - DNA, 20 bp, synthetic construct
  source 1..20: mol_type = other DNA
gacccttcgtgcaccctaaa

SEQ ID NO: 21657 - DNA, 20 bp, synthetic construct
  source 1..20: mol_type = other DNA
atctactcacggaggaccct

SEQ ID NO: 21658 - DNA, 20 bp, synthetic construct
  source 1..20: mol_type = other DNA
cgttcccccttcgcctggga

SEQ ID NO: 21659 - DNA, 20 bp, synthetic construct
  source 1..20: mol_type = other DNA
tagtccactatcgccagttg

SEQ ID NO: 21660 - DNA, 20 bp, synthetic construct
  source 1..20: mol_type = other DNA
gagaaacagaggaaaaggaa

SEQ ID NO: 21661 - DNA, 20 bp, synthetic construct
  source 1..20: mol_type = other DNA
aaaacagtcccaccctgttt

SEQ ID NO: 21662 - DNA, 20 bp, synthetic construct
  source 1..20: mol_type = other DNA
tctgtcgcctctggatccct

SEQ ID NO: 21663 - DNA, 20 bp, synthetic construct
  source 1..20: mol_type = other DNA
gagaagtagccactagagaa

SEQ ID NO: 21664 - DNA, 20 bp, synthetic construct
  source 1..20: mol_type = other DNA
ccagcaagtctgccgtcaaa

SEQ ID NO: 21665 - DNA, 20 bp, synthetic construct
  source 1..20: mol_type = other DNA
ccaaagttgtaaccaagaag

SEQ ID NO: 21666 - DNA, 20 bp, synthetic construct
  source 1..20: mol_type = other DNA
gggtccgcagacaccaaact

SEQ ID NO: 21667 - DNA, 20 bp, synthetic construct
  source 1..20: mol_type = other DNA
ttcaacgctctcaaaatccc

SEQ ID NO: 21668 - DNA, 20 bp, synthetic construct
  source 1..20: mol_type = other DNA
aatatcaggcaaccaccctc

SEQ ID NO: 21669 - DNA, 20 bp, synthetic construct
  source 1..20: mol_type = other DNA
tacccttaaggcaggcaaag

SEQ ID NO: 21670 - DNA, 20 bp, synthetic construct
  source 1..20: mol_type = other DNA
tctcaaagaagtcgaaaagt

SEQ ID NO: 21671 - DNA, 20 bp, synthetic construct
  source 1..20: mol_type = other DNA
gtatacagtagtttgaatcc

SEQ ID NO: 21672 - DNA, 20 bp, synthetic construct
  source 1..20: mol_type = other DNA
agcagtcgctactctgttca

SEQ ID NO: 21673 - DNA, 20 bp, synthetic construct
  source 1..20: mol_type = other DNA
ctaaaccagatggaaggtgg

SEQ ID NO: 21674 - DNA, 20 bp, synthetic construct
  source 1..20: mol_type = other DNA
atgttacaccacccaaagat

SEQ ID NO: 21675 - DNA, 20 bp, synthetic construct
  source 1..20: mol_type = other DNA
gcaaagtaaaagtttccaga

SEQ ID NO: 21676 - DNA, 20 bp, synthetic construct
  source 1..20: mol_type = other DNA
gttttacatggttataccca

SEQ ID NO: 21677 - DNA, 20 bp, synthetic construct
  source 1..20: mol_type = other DNA
aactcttatttggtatagat

SEQ ID NO: 21678 - DNA, 20 bp, synthetic construct
  source 1..20: mol_type = other DNA
agagggtggctaggcctgca

SEQ ID NO: 21679 - DNA, 20 bp, synthetic construct
  source 1..20: mol_type = other DNA
attgcacgttctcttagaat

SEQ ID NO: 21680 - DNA, 20 bp, synthetic construct
  source 1..20: mol_type = other DNA
tataaaactccaaagtcctg

SEQ ID NO: 21681 - DNA, 20 bp, synthetic construct
  source 1..20: mol_type = other DNA
aagagagccctgcctaagga

SEQ ID NO: 21682 - DNA, 20 bp, synthetic construct
  source 1..20: mol_type = other DNA
ggtaggcctgtaaatgaaat

SEQ ID NO: 21683 - DNA, 20 bp, synthetic construct
  source 1..20: mol_type = other DNA
attgggttatattatgaatt

SEQ ID NO: 21684 - DNA, 20 bp, synthetic construct
  source 1..20: mol_type = other DNA
gggctaaaaatagaagtcac

SEQ ID NO: 21685 - DNA, 20 bp, synthetic construct
  source 1..20: mol_type = other DNA
gacttcaggacctgcagact

SEQ ID NO: 21686 - DNA, 20 bp, synthetic construct
  source 1..20: mol_type = other DNA
ctcaccacattaagctccaa

SEQ ID NO: 21687 - DNA, 20 bp, synthetic construct
  source 1..20: mol_type = other DNA
gttgcccagaaggtccaaaa

SEQ ID NO: 21688 - DNA, 20 bp, synthetic construct
  source 1..20: mol_type = other DNA
acactttttggactcctgga

SEQ ID NO: 21689 - DNA, 20 bp, synthetic construct
  source 1..20: mol_type = other DNA
attgtaacttgctgccaggc

SEQ ID NO: 21690 - DNA, 20 bp, synthetic construct
  source 1..20: mol_type = other DNA
ttcaaagctctgcagttcca

SEQ ID NO: 21691 - DNA, 20 bp, synthetic construct
  source 1..20: mol_type = other DNA
caatattatctttgtcagaa

SEQ ID NO: 21692 - DNA, 20 bp, synthetic construct
  source 1..20: mol_type = other DNA
tctcagggtgtgtgcggcgt

SEQ ID NO: 21693 - DNA, 20 bp, synthetic construct
  source 1..20: mol_type = other DNA
ggaagccaggaatgtccagg

SEQ ID NO: 21694 - DNA, 20 bp, synthetic construct
  source 1..20: mol_type = other DNA
tttcactggtgctgcaatgg

SEQ ID NO: 21695 - DNA, 20 bp, synthetic construct
  source 1..20: mol_type = other DNA
cgccttcctctgcttttccc

SEQ ID NO: 21696 - DNA, 20 bp, synthetic construct
  source 1..20: mol_type = other DNA
cccccacatgtggatcgttg

SEQ ID NO: 21697 - DNA, 20 bp, synthetic construct
  source 1..20: mol_type = other DNA
cacctttactgatgagctca

SEQ ID NO: 21698 - DNA, 20 bp, synthetic construct
  source 1..20: mol_type = other DNA
cacttccacttgcaattcct

SEQ ID NO: 21699 - DNA, 20 bp, synthetic construct
  source 1..20: mol_type = other DNA
atgggaaaaagcaaaaacca

SEQ ID NO: 21700 - DNA, 20 bp, synthetic construct
  source 1..20: mol_type = other DNA
tgattggcttaagagcaaat

SEQ ID NO: 21701 - DNA, 20 bp, synthetic construct
  source 1..20: mol_type = other DNA
ttctatgccccccgattcgg

SEQ ID NO: 21702 - DNA, 20 bp, synthetic construct
  source 1..20: mol_type = other DNA
gaggagaacagtcgctcatg

SEQ ID NO: 21703 - DNA, 20 bp, synthetic construct
  source 1..20: mol_type = other DNA
tgttttcaccatccttggta

SEQ ID NO: 21704 - DNA, 20 bp, synthetic construct
  source 1..20: mol_type = other DNA
cttatgtaacgatgagttag

SEQ ID NO: 21705 - DNA, 20 bp, synthetic construct
  source 1..20: mol_type = other DNA
gcagagatattgtatttaag

SEQ ID NO: 21706 - DNA, 20 bp, synthetic construct
  source 1..20: mol_type = other DNA
tggtcggccacaggcggcgt

SEQ ID NO: 21707 - DNA, 20 bp, synthetic construct
  source 1..20: mol_type = other DNA
cctcctgcttcccttccacc

SEQ ID NO: 21708 - DNA, 20 bp, synthetic construct
  source 1..20: mol_type = other DNA
aattccgcattgcagagata

SEQ ID NO: 21709 - DNA, 20 bp, synthetic construct
  source 1..20: mol_type = other DNA
gctgcggcttaggagggcag

SEQ ID NO: 21710 - DNA, 20 bp, synthetic construct
  source 1..20: mol_type = other DNA
cggcgaatcgacaagggaga

SEQ ID NO: 21711 - DNA, 20 bp, synthetic construct
  source 1..20: mol_type = other DNA
gttattttaggacccgcccc

SEQ ID NO: 21712 - DNA, 20 bp, synthetic construct
  source 1..20: mol_type = other DNA
tcccaccaggatcacagtgc

SEQ ID NO: 21713 - DNA, 20 bp, synthetic construct
  source 1..20: mol_type = other DNA
ttctctcagctggagaaaca

SEQ ID NO: 21714 - DNA, 20 bp, synthetic construct
  source 1..20: mol_type = other DNA
ctgcggggcgaggagctggc

SEQ ID NO: 21715 - DNA, 20 bp, synthetic construct
  source 1..20: mol_type = other DNA
tgccagcaggcctggtacca

SEQ ID NO: 21716 - DNA, 20 bp, synthetic construct
  source 1..20: mol_type = other DNA
cagcccatttacatcgtcat

SEQ ID NO: 21717 - DNA, 20 bp, synthetic construct
  source 1..20: mol_type = other DNA
aactgcctggtgacagaaaa

SEQ ID NO: 21718 - DNA, 20 bp, synthetic construct
  source 1..20: mol_type = other DNA
tttgggatcctgctgtggga

SEQ ID NO: 21719 - DNA, 20 bp, synthetic construct
  source 1..20: mol_type = other DNA
tgccacttagtcatcattac

SEQ ID NO: 21720 - DNA, 20 bp, synthetic construct
  source 1..20: mol_type = other DNA
gtggtggccatgcctgtagt

SEQ ID NO: 21721 - DNA, 20 bp, synthetic construct
  source 1..20: mol_type = other DNA
gcccctcttacggatcaagg

SEQ ID NO: 21722 - DNA, 20 bp, synthetic construct
  source 1..20: mol_type = other DNA
cggaagtcaggaaacagccg

SEQ ID NO: 21723 - DNA, 20 bp, synthetic construct
  source 1..20: mol_type = other DNA
cataaagatcgccccttggt

SEQ ID NO: 21724 - DNA, 20 bp, synthetic construct
  source 1..20: mol_type = other DNA
cacttagttgttggaacaca

SEQ ID NO: 21725 - DNA, 20 bp, synthetic construct
  source 1..20: mol_type = other DNA
aatatcttgggtacaagtta

SEQ ID NO: 21726 - DNA, 20 bp, synthetic construct
  source 1..20: mol_type = other DNA
ggtcagatcctaacgaggcg

SEQ ID NO: 21727 - DNA, 20 bp, synthetic construct
  source 1..20: mol_type = other DNA
ccacacacccaaggccatgc

SEQ ID NO: 21728 - DNA, 20 bp, synthetic construct
  source 1..20: mol_type = other DNA
cgctcccagaggggatcctg

SEQ ID NO: 21729 - DNA, 20 bp, synthetic construct
  source 1..20: mol_type = other DNA
agtgggaaaaaggatggaac

SEQ ID NO: 21730 - DNA, 20 bp, synthetic construct
  source 1..20: mol_type = other DNA
gagcagccagggaacctttg

SEQ ID NO: 21731 - DNA, 20 bp, synthetic construct
  source 1..20: mol_type = other DNA
ggaactgaccggttagtctt

SEQ ID NO: 21732 - DNA, 20 bp, synthetic construct
  source 1..20: mol_type = other DNA
actcaggtctctggcgtggc

SEQ ID NO: 21733 - DNA, 20 bp, synthetic construct
  source 1..20: mol_type = other DNA
tttatggggagtgagtactg

SEQ ID NO: 21734 - DNA, 20 bp, synthetic construct
  source 1..20: mol_type = other DNA
gcggtcctgcagaaccgagc

SEQ ID NO: 21735 - DNA, 20 bp, synthetic construct
  source 1..20: mol_type = other DNA
atcggaagttggctgcgagg

SEQ ID NO: 21736 - DNA, 20 bp, synthetic construct
  source 1..20: mol_type = other DNA
tgctcttgcatagggggaaa

SEQ ID NO: 21737 - DNA, 20 bp, synthetic construct
  source 1..20: mol_type = other DNA
agcgtgccggggcactggct

SEQ ID NO: 21738 - DNA, 20 bp, synthetic construct
  source 1..20: mol_type = other DNA
tccccagtaactatgtcgcg

SEQ ID NO: 21739 - DNA, 20 bp, synthetic construct
  source 1..20: mol_type = other DNA
tcgatatggctgctcagatt

SEQ ID NO: 21740 - DNA, 20 bp, synthetic construct
  source 1..20: mol_type = other DNA
ccaagttccccatcaagtgg

SEQ ID NO: 21741 - DNA, 20 bp, synthetic construct
  source 1..20: mol_type = other DNA
gcatgccctgcccgcccgag

SEQ ID NO: 21742 - DNA, 20 bp, synthetic construct
  source 1..20: mol_type = other DNA
cgtcttccctgttttgccct

SEQ ID NO: 21743 - DNA, 20 bp, synthetic construct
  source 1..20: mol_type = other DNA
acttgggaaatcgggagagt

SEQ ID NO: 21744 - DNA, 20 bp, synthetic construct
  source 1..20: mol_type = other DNA
cgacaaaggggaggaagtgg

SEQ ID NO: 21745 - DNA, 20 bp, synthetic construct
  source 1..20: mol_type = other DNA
ggcggttgaggggtcagatc

SEQ ID NO: 21746 - DNA, 20 bp, synthetic construct
  source 1..20: mol_type = other DNA
tacggatcaaggcatagccg

SEQ ID NO: 21747 - DNA, 20 bp, synthetic construct
  source 1..20: mol_type = other DNA
tgttggaacacacctgtctt

SEQ ID NO: 21748 - DNA, 20 bp, synthetic construct
  source 1..20: mol_type = other DNA
gggtacaagttaggcagtac

SEQ ID NO: 21749 - DNA, 20 bp, synthetic construct
  source 1..20: mol_type = other DNA
ccaaggccatgtttgtggtt

SEQ ID NO: 21750 - DNA, 20 bp, synthetic construct
  source 1..20: mol_type = other DNA
agagaggctaaagatcttca

SEQ ID NO: 21751 - DNA, 20 bp, synthetic construct
  source 1..20: mol_type = other DNA
agggaacctttggattacat

SEQ ID NO: 21752 - DNA, 20 bp, synthetic construct
  source 1..20: mol_type = other DNA
cggtataaccgggggatgcg

SEQ ID NO: 21753 - DNA, 20 bp, synthetic construct
  source 1..20: mol_type = other DNA
ccgagcggctattgacttct

SEQ ID NO: 21754 - DNA, 20 bp, synthetic construct
  source 1..20: mol_type = other DNA
acagcctgagaggcactggc

SEQ ID NO: 21755 - DNA, 20 bp, synthetic construct
  source 1..20: mol_type = other DNA
aaattaaactcctcttgaat

SEQ ID NO: 21756 - DNA, 20 bp, synthetic construct
  source 1..20: mol_type = other DNA
cagaaaccacaaaagaatac

SEQ ID NO: 21757 - DNA, 20 bp, synthetic construct
  source 1..20: mol_type = other DNA
gataattgatgtcttgttct

SEQ ID NO: 21758 - DNA, 20 bp, synthetic construct
  source 1..20: mol_type = other DNA
aatccagagatatacagttc

SEQ ID NO: 21759 - DNA, 20 bp, synthetic construct
  source 1..20: mol_type = other DNA
ggcagcttatcagggagatt

SEQ ID NO: 21760 - DNA, 20 bp, synthetic construct
  source 1..20: mol_type = other DNA
ctcttttggcttaggtactg

SEQ ID NO: 21761 - DNA, 20 bp, synthetic construct
  source 1..20: mol_type = other DNA
gcatgtctctgttggtaccc

SEQ ID NO: 21762 - DNA, 20 bp, synthetic construct
  source 1..20: mol_type = other DNA
ccacagcccaaagaaagctt

SEQ ID NO: 21763 - DNA, 20 bp, synthetic construct
  source 1..20: mol_type = other DNA
cgcggaacgcggggaaaggg

SEQ ID NO: 21764 - DNA, 20 bp, synthetic construct
  source 1..20: mol_type = other DNA
tgtaaaggtccccagctatg

SEQ ID NO: 21765 - DNA, 20 bp, synthetic construct
  source 1..20: mol_type = other DNA
actagacaacctgattcatt

SEQ ID NO: 21766 - DNA, 20 bp, synthetic construct
  source 1..20: mol_type = other DNA
tcctgagctctcttgctccc

SEQ ID NO: 21767 - DNA, 20 bp, synthetic construct
  source 1..20: mol_type = other DNA
ggcgtctggcttgcacccgc

SEQ ID NO: 21768 - DNA, 20 bp, synthetic construct
  source 1..20: mol_type = other DNA
cgttttgggtctttccttta

SEQ ID NO: 21769 - DNA, 20 bp, synthetic construct
  source 1..20: mol_type = other DNA
aactttgccaatatattgct

SEQ ID NO: 21770 - DNA, 20 bp, synthetic construct
  source 1..20: mol_type = other DNA
cccccaaaaggccccccccg

SEQ ID NO: 21771 - DNA, 20 bp, synthetic construct
  source 1..20: mol_type = other DNA
gggacttagcgccccccaaa

SEQ ID NO: 21772 - DNA, 20 bp, synthetic construct
  source 1..20: mol_type = other DNA
ggctgaaaatacggtcctcc

SEQ ID NO: 21773 - DNA, 20 bp, synthetic construct
  source 1..20: mol_type = other DNA
gcctggcgggtcctacctca

SEQ ID NO: 21774 - DNA, 20 bp, synthetic construct
  source 1..20: mol_type = other DNA
gccctggctgcccgcctccg

SEQ ID NO: 21775 - DNA, 20 bp, synthetic construct
  source 1..20: mol_type = other DNA
gtcttgggagacctccagtg

SEQ ID NO: 21776 - DNA, 20 bp, synthetic construct
  source 1..20: mol_type = other DNA
tctagatataacgagcaaga

SEQ ID NO: 21777 - DNA, 20 bp, synthetic construct
  source 1..20: mol_type = other DNA
ctgcagactcaggccttaag

SEQ ID NO: 21778 - DNA, 20 bp, synthetic construct
  source 1..20: mol_type = other DNA
tccctttctcatcacgttcc

SEQ ID NO: 21779 - DNA, 20 bp, synthetic construct
  source 1..20: mol_type = other DNA
atcaacaatggatgacaaca

SEQ ID NO: 21780 - DNA, 20 bp, synthetic construct
  source 1..20: mol_type = other DNA
taacctgggaaatatgggga

SEQ ID NO: 21781 - DNA, 20 bp, synthetic construct
  source 1..20: mol_type = other DNA
gggaaccttcccctccctgg

SEQ ID NO: 21782 - DNA, 20 bp, synthetic construct
  source 1..20: mol_type = other DNA
aaggcaacgccttattatta

SEQ ID NO: 21783 - DNA, 20 bp, synthetic construct
  source 1..20: mol_type = other DNA
cttgctgtttcctacgcatt

SEQ ID NO: 21784 - DNA, 20 bp, synthetic construct
  source 1..20: mol_type = other DNA
ccgattacatcaaccttcga

SEQ ID NO: 21785 - DNA, 20 bp, synthetic construct
  source 1..20: mol_type = other DNA
agtgtagcgcagagaggttg

SEQ ID NO: 21786 - DNA, 20 bp, synthetic construct
  source 1..20: mol_type = other DNA
ttcttgcagctgtgctaagc

SEQ ID NO: 21787 - DNA, 20 bp, synthetic construct
  source 1..20: mol_type = other DNA
cttcccatgtaacaagcccc

SEQ ID NO: 21788 - DNA, 20 bp, synthetic construct
  source 1..20: mol_type = other DNA
actttcccccttcgagcagt

SEQ ID NO: 21789 - DNA, 20 bp, synthetic construct
  source 1..20: mol_type = other DNA
cccccccttcgataccctcc

SEQ ID NO: 21790 - DNA, 20 bp, synthetic construct
  source 1..20: mol_type = other DNA
cacctggtcagaattggttg

SEQ ID NO: 21791 - DNA, 20 bp, synthetic construct
  source 1..20: mol_type = other DNA
ctcagctctcggtcctgagc

SEQ ID NO: 21792 - DNA, 20 bp, synthetic construct
  source 1..20: mol_type = other DNA
taaggcaaaccacggtttgg

SEQ ID NO: 21793 - DNA, 20 bp, synthetic construct
  source 1..20: mol_type = other DNA
tgaaagcgatgaatccgtta

SEQ ID NO: 21794 - DNA, 20 bp, synthetic construct
  source 1..20: mol_type = other DNA
acgtacaatgcaatgctaca

SEQ ID NO: 21795 - DNA, 20 bp, synthetic construct
  source 1..20: mol_type = other DNA
acacctatgtgccaattacc

SEQ ID NO: 21796 - DNA, 20 bp, synthetic construct
  source 1..20: mol_type = other DNA
acaagaatcactcaacaagt

SEQ ID NO: 21797 - DNA, 20 bp, synthetic construct
  source 1..20: mol_type = other DNA
cctgggcacctagggcgcct

SEQ ID NO: 21798 - DNA, 20 bp, synthetic construct
  source 1..20: mol_type = other DNA
caggcggtgagggaatagtt

SEQ ID NO: 21799 - DNA, 20 bp, synthetic construct
  source 1..20: mol_type = other DNA
gagaggacagtttattggaa

SEQ ID NO: 21800 - DNA, 20 bp, synthetic construct
  source 1..20: mol_type = other DNA
gcatcccatacacaataaga

SEQ ID NO: 21801 - DNA, 20 bp, synthetic construct
  source 1..20: mol_type = other DNA
ataaacaacagacagtggtc

SEQ ID NO: 21802 - DNA, 20 bp, synthetic construct
  source 1..20: mol_type = other DNA
gtccactgatttgtggaaag

SEQ ID NO: 21803 - DNA, 20 bp, synthetic construct
  source 1..20: mol_type = other DNA
attgccggcgttccgcactg

SEQ ID NO: 21804 - DNA, 20 bp, synthetic construct
  source 1..20: mol_type = other DNA
caacctcatgctccactaag

SEQ ID NO: 21805 - DNA, 20 bp, synthetic construct
  source 1..20: mol_type = other DNA
gctggaacgcctctgaggtc

SEQ ID NO: 21806 - DNA, 20 bp, synthetic construct
  source 1..20: mol_type = other DNA
gccgtgattatatccccggc

SEQ ID NO: 21807 - DNA, 20 bp, synthetic construct
  source 1..20: mol_type = other DNA
ccctatacaggtttaatcgc

SEQ ID NO: 21808 - DNA, 20 bp, synthetic construct
  source 1..20: mol_type = other DNA
ccccggccataacccaccag

SEQ ID NO: 21809 - DNA, 20 bp, synthetic construct
  source 1..20: mol_type = other DNA
accccgcatcctttgatgct

SEQ ID NO: 21810 - DNA, 20 bp, synthetic construct
  source 1..20: mol_type = other DNA
acccactcctcgggaccggc

SEQ ID NO: 21811 - DNA, 20 bp, synthetic construct
  source 1..20: mol_type = other DNA
cagcaaatctggctatcgaa

SEQ ID NO: 21812 - DNA, 20 bp, synthetic construct
  source 1..20: mol_type = other DNA
agatcccagccatcgacttt

SEQ ID NO: 21813 - DNA, 20 bp, synthetic construct
  source 1..20: mol_type = other DNA
ccttgacgcgccacactgag

SEQ ID NO: 21814 - DNA, 20 bp, synthetic construct
  source 1..20: mol_type = other DNA
cagatattgtgcactgtcgt

SEQ ID NO: 21815 - DNA, 20 bp, synthetic construct
  source 1..20: mol_type = other DNA
aattgtacgagctagtggag

SEQ ID NO: 21816 - DNA, 20 bp, synthetic construct
  source 1..20: mol_type = other DNA
agtttgattccacccagaat

SEQ ID NO: 21817 - DNA, 20 bp, synthetic construct
  source 1..20: mol_type = other DNA
gcacccttctatggaataca

SEQ ID NO: 21818 - DNA, 20 bp, synthetic construct
  source 1..20: mol_type = other DNA
atgtagctcagatgtgtgtg

SEQ ID NO: 21819 - DNA, 20 bp, synthetic construct
  source 1..20: mol_type = other DNA
gattctcagcccttcgcaat

SEQ ID NO: 21820 - DNA, 20 bp, synthetic construct
  source 1..20: mol_type = other DNA
gctggggccgcgccgctaac

SEQ ID NO: 21821 - DNA, 20 bp, synthetic construct
  source 1..20: mol_type = other DNA
tccgttgacatgaattcaat

SEQ ID NO: 21822 - DNA, 20 bp, synthetic construct
  source 1..20: mol_type = other DNA
gggactgccgagctcaccac

SEQ ID NO: 21823 - DNA, 20 bp, synthetic construct
  source 1..20: mol_type = other DNA
acaccttccccagccccatc

SEQ ID NO: 21824 - DNA, 20 bp, synthetic construct
  source 1..20: mol_type = other DNA
ctgctcgttgagaatgccgc

SEQ ID NO: 21825 - DNA, 20 bp, synthetic construct
  source 1..20: mol_type = other DNA
cagtctactgtcgctgagct

SEQ ID NO: 21826 - DNA, 20 bp, synthetic construct
  source 1..20: mol_type = other DNA
gggcagaaaacaaaacaaaa

SEQ ID NO: 21827 - DNA, 20 bp, synthetic construct
  source 1..20: mol_type = other DNA
tggcagtaacaacggtcaac

SEQ ID NO: 21828 - DNA, 20 bp, synthetic construct
  source 1..20: mol_type = other DNA
aggcttcactgatcgtgggt

SEQ ID NO: 21829 - DNA, 20 bp, synthetic construct
  source 1..20: mol_type = other DNA
agccatcgtggtggagtact

SEQ ID NO: 21830 - DNA, 20 bp, synthetic construct
  source 1..20: mol_type = other DNA
atcctactctgggagtgatg

SEQ ID NO: 21831 - DNA, 20 bp, synthetic construct
  source 1..20: mol_type = other DNA
ggttgggaggggagacaagc

SEQ ID NO: 21832 - DNA, 20 bp, synthetic construct
  source 1..20: mol_type = other DNA
tgacactggatgtgccattg

SEQ ID NO: 21833 - DNA, 20 bp, synthetic construct
  source 1..20: mol_type = other DNA
acaggttgatgctttcaatg

SEQ ID NO: 21834 - DNA, 20 bp, synthetic construct
  source 1..20: mol_type = other DNA
ggcgaggtatgtggtgctag

SEQ ID NO: 21835 - DNA, 20 bp, synthetic construct
  source 1..20: mol_type = other DNA
gtggccagccactgagtttt

SEQ ID NO: 21836 - DNA, 20 bp, synthetic construct
  source 1..20: mol_type = other DNA
tgttttccacacactatggc

SEQ ID NO: 21837 - DNA, 20 bp, synthetic construct
  source 1..20: mol_type = other DNA
tgatttgcaagatgagatac

SEQ ID NO: 21838 - DNA, 20 bp, synthetic construct
  source 1..20: mol_type = other DNA
tgggccgcgcacgaatgcca

SEQ ID NO: 21839 - DNA, 20 bp, synthetic construct
  source 1..20: mol_type = other DNA
accggaaaaacagaggtcac

SEQ ID NO: 21840 - DNA, 20 bp, synthetic construct
  source 1..20: mol_type = other DNA
aagcatggcactggacctgc

SEQ ID NO: 21841 - DNA, 20 bp, synthetic construct
  source 1..20: mol_type = other DNA
ggctacgctcactttgtggg

SEQ ID NO: 21842 - DNA, 20 bp, synthetic construct
  source 1..20: mol_type = other DNA
aaaagttctctgcccttaca

SEQ ID NO: 21843 - DNA, 20 bp, synthetic construct
  source 1..20: mol_type = other DNA
actactggggcgaatggatc

SEQ ID NO: 21844 - DNA, 20 bp, synthetic construct
  source 1..20: mol_type = other DNA
agtgttcgctgaacagaatc

SEQ ID NO: 21845 - DNA, 20 bp, synthetic construct
  source 1..20: mol_type = other DNA
agggaaaatgtacgctgatg

SEQ ID NO: 21846 - DNA, 20 bp, synthetic construct
  source 1..20: mol_type = other DNA
agaaggaaagaccgtaatgg

SEQ ID NO: 21847 - DNA, 20 bp, synthetic construct
  source 1..20: mol_type = other DNA
gatagctgtcaggacctggc

SEQ ID NO: 21848 - DNA, 20 bp, synthetic construct
  source 1..20: mol_type = other DNA
agcatatgcacagatgtggc

SEQ ID NO: 21849 - DNA, 20 bp, synthetic construct
  source 1..20: mol_type = other DNA
ccggatactgggtagacggt

SEQ ID NO: 21850 - DNA, 20 bp, synthetic construct
  source 1..20: mol_type = other DNA
tagaggttagaggagacccc

SEQ ID NO: 21851 - DNA, 20 bp, synthetic construct
  source 1..20: mol_type = other DNA
gaccccgcatttgcatcaaa

SEQ ID NO: 21852 - DNA, 20 bp, synthetic construct
  source 1..20: mol_type = other DNA
cccgaacagggacctgagag

SEQ ID NO: 21853 - DNA, 20 bp, synthetic construct
  source 1..20: mol_type = other DNA
gttagagaaggtgacggtac

SEQ ID NO: 21854 - DNA, 20 bp, synthetic construct
  source 1..20: mol_type = other DNA
tcagaaaaatctaagtgtga

SEQ ID NO: 21855 - DNA, 20 bp, synthetic construct
  source 1..20: mol_type = other DNA
gttgaggatgtaatgaacac

SEQ ID NO: 21856 - DNA, 20 bp, synthetic construct
  source 1..20: mol_type = other DNA
cctatagatattttatatgg

SEQ ID NO: 21857 - DNA, 20 bp, synthetic construct
  source 1..20: mol_type = other DNA
tttgaggtagaaaatagtac

SEQ ID NO: 21858 - DNA, 20 bp, synthetic construct
  source 1..20: mol_type = other DNA
catactggtcatccctggaa

SEQ ID NO: 21859 - DNA, 20 bp, synthetic construct
  source 1..20: mol_type = other DNA
aagagctgggtgaagtcaat

SEQ ID NO: 21860 - DNA, 20 bp, synthetic construct
  source 1..20: mol_type = other DNA
tatgactgttgcattaaagc

SEQ ID NO: 21861 - DNA, 20 bp, synthetic construct
  source 1..20: mol_type = other DNA
ctttgtaataaatataattc

SEQ ID NO: 21862 - DNA, 20 bp, synthetic construct
  source 1..20: mol_type = other DNA
ctccgggcctctcctgcctg

SEQ ID NO: 21863 - DNA, 20 bp, synthetic construct
  source 1..20: mol_type = other DNA
gaccccttaaaagacggagg

SEQ ID NO: 21864 - DNA, 20 bp, synthetic construct
  source 1..20: mol_type = other DNA
ggcaagacagatatgcctgc

SEQ ID NO: 21865 - DNA, 20 bp, synthetic construct
  source 1..20: mol_type = other DNA
gccacgtgtggtgccgtccg

SEQ ID NO: 21866 - DNA, 20 bp, synthetic construct
  source 1..20: mol_type = other DNA
attaagaagaaatcaggaaa

SEQ ID NO: 21867 - DNA, 20 bp, synthetic construct
  source 1..20: mol_type = other DNA
gctgtgtccttgcatttaga

SEQ ID NO: 21868 - DNA, 20 bp, synthetic construct
  source 1..20: mol_type = other DNA
ttgggcatagaacatactac

SEQ ID NO: 21869 - DNA, 20 bp, synthetic construct
  source 1..20: mol_type = other DNA
ttttgaatataaaagcctgt

SEQ ID NO: 21870 - DNA, 20 bp, synthetic construct
  source 1..20: mol_type = other DNA
aattaaaattacctctctct

SEQ ID NO: 21871 - DNA, 20 bp, synthetic construct
  source 1..20: mol_type = other DNA
acccagagagagggatatgt

SEQ ID NO: 21872 - DNA, 20 bp, synthetic construct
  source 1..20: mol_type = other DNA
aggcgcaaggggaaaacaag

SEQ ID NO: 21873 - DNA, 20 bp, synthetic construct
  source 1..20: mol_type = other DNA
acgcaactgctgcccagcag

SEQ ID NO: 21874 - DNA, 20 bp, synthetic construct
  source 1..20: mol_type = other DNA
tgtaaacaagttgcctatat

SEQ ID NO: 21875 - DNA, 20 bp, synthetic construct
  source 1..20: mol_type = other DNA
gagttgatcacaaatgaact

SEQ ID NO: 21876 - DNA, 20 bp, synthetic construct
  source 1..20: mol_type = other DNA
atagggagagtaactggaag

SEQ ID NO: 21877 - DNA, 20 bp, synthetic construct
  source 1..20: mol_type = other DNA
tgcaagaaaggaaagaactt

SEQ ID NO: 21878 - DNA, 20 bp, synthetic construct
  source 1..20: mol_type = other DNA
aagaacacaaaaattgtcgg

SEQ ID NO: 21879 - DNA, 20 bp, synthetic construct
  source 1..20: mol_type = other DNA
ccacaaagtcacgttgatgt

SEQ ID NO: 21880 - DNA, 20 bp, synthetic construct
  source 1..20: mol_type = other DNA
agccaggtggtgaagttagt

SEQ ID NO: 21881 - DNA, 20 bp, synthetic construct
  source 1..20: mol_type = other DNA
gacagtacctcttgcaatag

SEQ ID NO: 21882 - DNA, 20 bp, synthetic construct
  source 1..20: mol_type = other DNA
ttgcaatgtgtgcctatctt

SEQ ID NO: 21883 - DNA, 20 bp, synthetic construct
  source 1..20: mol_type = other DNA
cacaggaaagttatagaaga

SEQ ID NO: 21884 - DNA, 20 bp, synthetic construct
  source 1..20: mol_type = other DNA
ataacgtgtgggatgtcgct

SEQ ID NO: 21885 - DNA, 20 bp, synthetic construct
  source 1..20: mol_type = other DNA
cctgctgaggaaggtgactt

SEQ ID NO: 21886 - DNA, 20 bp, synthetic construct
  source 1..20: mol_type = other DNA
ccaaaagcagttatagagga

SEQ ID NO: 21887 - DNA, 20 bp, synthetic construct
  source 1..20: mol_type = other DNA
gctgttaagaacataatggc

SEQ ID NO: 21888 - DNA, 20 bp, synthetic construct
  source 1..20: mol_type = other DNA
caggctctctcaaagaggca

SEQ ID NO: 21889 - DNA, 20 bp, synthetic construct
  source 1..20: mol_type = other DNA
cacacagcactatacaaaag

SEQ ID NO: 21890 - DNA, 20 bp, synthetic construct
  source 1..20: mol_type = other DNA
tccgagacacagcaagaagg

SEQ ID NO: 21891 - DNA, 20 bp, synthetic construct
  source 1..20: mol_type = other DNA
ggcaaacttaccaaagtgga

SEQ ID NO: 21892 - DNA, 20 bp, synthetic construct
  source 1..20: mol_type = other DNA
gggactataaaaccagtact

SEQ ID NO: 21893 - DNA, 20 bp, synthetic construct
  source 1..20: mol_type = other DNA
gcttaccaattggcacaggg

SEQ ID NO: 21894 - DNA, 20 bp, synthetic construct
  source 1..20: mol_type = other DNA
cgcccaacacgcacagctaa

SEQ ID NO: 21895 - DNA, 20 bp, synthetic construct
  source 1..20: mol_type = other DNA
aggtaccgagacctcaaaat

SEQ ID NO: 21896 - DNA, 20 bp, synthetic construct
  source 1..20: mol_type = other DNA
caagcagcagcacaagctaa

SEQ ID NO: 21897 - DNA, 20 bp, synthetic construct
  source 1..20: mol_type = other DNA
aaaatgcaattgttagcaca

SEQ ID NO: 21898 - DNA, 20 bp, synthetic construct
  source 1..20: mol_type = other DNA
agagacataaggggaaaaca

SEQ ID NO: 21899 - DNA, 20 bp, synthetic construct
  source 1..20: mol_type = other DNA
aggcacccccacattggaca

SEQ ID NO: 21900 - DNA, 20 bp, synthetic construct
  source 1..20: mol_type = other DNA
tgtatcaggagaaagggaaa

SEQ ID NO: 21901 - DNA, 20 bp, synthetic construct
  source 1..20: mol_type = other DNA
gaattatggaaattgcccac

SEQ ID NO: 21902 - DNA, 20 bp, synthetic construct
  source 1..20: mol_type = other DNA
atagcagaaagcattaatgg

SEQ ID NO: 21903 - DNA, 20 bp, synthetic construct
  source 1..20: mol_type = other DNA
atacaagacaacaggagagg

SEQ ID NO: 21904 - DNA, 20 bp, synthetic construct
  source 1..20: mol_type = other DNA
tctctggcaaatggagaatg

SEQ ID NO: 21905 - DNA, 20 bp, synthetic construct
  source 1..20: mol_type = other DNA
caacctaaggtgtcagaaaa

SEQ ID NO: 21906 - DNA, 20 bp, synthetic construct
  source 1..20: mol_type = other DNA
attagggcaagaaacattcc

SEQ ID NO: 21907 - DNA, 20 bp, synthetic construct
  source 1..20: mol_type = other DNA
gaaaaaaagagaactcagcc

SEQ ID NO: 21908 - DNA, 20 bp, synthetic construct
  source 1..20: mol_type = other DNA
gcaggatgtgttagaggcaa

SEQ ID NO: 21909 - DNA, 20 bp, synthetic construct
  source 1..20: mol_type = other DNA
agcaaaatatatcaattgga

SEQ ID NO: 21910 - DNA, 20 bp, synthetic construct
  source 1..20: mol_type = other DNA
agacgtctttgattggtcag

SEQ ID NO: 21911 - DNA, 20 bp, synthetic construct
  source 1..20: mol_type = other DNA
actgtagctctgagctgtat

SEQ ID NO: 21912 - DNA, 20 bp, synthetic construct
  source 1..20: mol_type = other DNA
cccgtaggacgctctaatac

SEQ ID NO: 21913 - DNA, 20 bp, synthetic construct
  source 1..20: mol_type = other DNA
acaaaatgggggctcaagta

SEQ ID NO: 21914 - DNA, 20 bp, synthetic construct
  source 1..20: mol_type = other DNA
cttctgatgatttccaatcg

SEQ ID NO: 21915 - DNA, 20 bp, synthetic construct
  source 1..20: mol_type = other DNA
tcttgtgccgatctgcttgt

SEQ ID NO: 21916 - DNA, 20 bp, synthetic construct
  source 1..20: mol_type = other DNA
tcagtattggaaatgcttat

SEQ ID NO: 21917 - DNA, 20 bp, synthetic construct
  source 1..20: mol_type = other DNA
tacgcgacctgctgtggtta

SEQ ID NO: 21918 - DNA, 20 bp, synthetic construct
  source 1..20: mol_type = other DNA
ccctagtaaaaattgtgtca

SEQ ID NO: 21919 - DNA, 20 bp, synthetic construct
  source 1..20: mol_type = other DNA
ccattgagcaaagtgcacct

SEQ ID NO: 21920 - DNA, 20 bp, synthetic construct
  source 1..20: mol_type = other DNA
ttgaacctgtatgcttgctc

SEQ ID NO: 21921 - DNA, 20 bp, synthetic construct
  source 1..20: mol_type = other DNA
tatgccagaacccagatggt

SEQ ID NO: 21922 - DNA, 20 bp, synthetic construct
  source 1..20: mol_type = other DNA
gggcactggctaggaggttt

SEQ ID NO: 21923 - DNA, 20 bp, synthetic construct
  source 1..20: mol_type = other DNA
atagaaggacacaagtcaga

SEQ ID NO: 21924 - DNA, 20 bp, synthetic construct
  source 1..20: mol_type = other DNA
cagatctactcaaatcagta

SEQ ID NO: 21925 - DNA, 20 bp, synthetic construct
  source 1..20: mol_type = other DNA
caggtcagtgtggcggagtg

SEQ ID NO: 21926 - DNA, 20 bp, synthetic construct
  source 1..20: mol_type = other DNA
cgcctagcaaaactaaattg

SEQ ID NO: 21927 - DNA, 20 bp, synthetic construct
  source 1..20: mol_type = other DNA
tcacctgggctaatgtcaca

SEQ ID NO: 21928 - DNA, 20 bp, synthetic construct
  source 1..20: mol_type = other DNA
gtgaattgtgtgaagacaca

SEQ ID NO: 21929 - DNA, 20 bp, synthetic construct
  source 1..20: mol_type = other DNA
cggacacacaagggtcaaat

SEQ ID NO: 21930 - DNA, 20 bp, synthetic construct
  source 1..20: mol_type = other DNA
atctcaagtgcaggctgaga

SEQ ID NO: 21931 - DNA, 20 bp, synthetic construct
  source 1..20: mol_type = other DNA
ttgatggccccgaaacagca

SEQ ID NO: 21932 - DNA, 20 bp, synthetic construct
  source 1..20: mol_type = other DNA
ccgtccatgccgatatgggt

SEQ ID NO: 21933 - DNA, 20 bp, synthetic construct
  source 1..20: mol_type = other DNA
cttatcttgccctactagca

SEQ ID NO: 21934 - DNA, 20 bp, synthetic construct
  source 1..20: mol_type = other DNA
cagattggataccattagca

SEQ ID NO: 21935 - DNA, 20 bp, synthetic construct
  source 1..20: mol_type = other DNA
caggaccattagtggctgga

SEQ ID NO: 21936 - DNA, 20 bp, synthetic construct
  source 1..20: mol_type = other DNA
aaaatgaagaggaagaacaa

SEQ ID NO: 21937 - DNA, 20 bp, synthetic construct
  source 1..20: mol_type = other DNA
agaaagacctaatatcatat

SEQ ID NO: 21938 - DNA, 20 bp, synthetic construct
  source 1..20: mol_type = other DNA
ctcctggaacgtcaggatct

SEQ ID NO: 21939 - DNA, 20 bp, synthetic construct
  source 1..20: mol_type = other DNA
gggttatagaccccagacgc

SEQ ID NO: 21940 - DNA, 20 bp, synthetic construct
  source 1..20: mol_type = other DNA
tgagaagaggagacctacca

SEQ ID NO: 21941 - DNA, 20 bp, synthetic construct
  source 1..20: mol_type = other DNA
cctcagtgaatgtgtcccta

SEQ ID NO: 21942 - DNA, 20 bp, synthetic construct
  source 1..20: mol_type = other DNA
aaggcctaacaaaaggagga

SEQ ID NO: 21943 - DNA, 20 bp, synthetic construct
  source 1..20: mol_type = other DNA
ccaggatgtgcaccagagaa

SEQ ID NO: 21944 - DNA, 20 bp, synthetic construct
  source 1..20: mol_type = other DNA
tggaaggagaagggctgcac

SEQ ID NO: 21945 - DNA, 20 bp, synthetic construct
  source 1..20: mol_type = other DNA
ccgaggccattttcaaacta

SEQ ID NO: 21946 - DNA, 20 bp, synthetic construct
  source 1..20: mol_type = other DNA
taaatgacatgggaaagatt

SEQ ID NO: 21947 - DNA, 20 bp, synthetic construct
  source 1..20: mol_type = other DNA
aggtcggattaagccatagt

SEQ ID NO: 21948 - DNA, 20 bp, synthetic construct
  source 1..20: mol_type = other DNA
gcatggcgtagtggactagc

SEQ ID NO: 21949 - DNA, 20 bp, synthetic construct
  source 1..20: mol_type = other DNA
cagggaccaatgaaattggt

SEQ ID NO: 21950 - DNA, 20 bp, synthetic construct
  source 1..20: mol_type = other DNA
aaaaagacatcgctctgtct

SEQ ID NO: 21951 - DNA, 20 bp, synthetic construct
  source 1..20: mol_type = other DNA
atgggactggacacacgcac

SEQ ID NO: 21952 - DNA, 20 bp, synthetic construct
  source 1..20: mol_type = other DNA
atgctggtcaccccatccat

SEQ ID NO: 21953 - DNA, 20 bp, synthetic construct
  source 1..20: mol_type = other DNA
ggcaaaggaagcttggtaac

SEQ ID NO: 21954 - DNA, 20 bp, synthetic construct
  source 1..20: mol_type = other DNA
atgttcgaggccactgaaag

SEQ ID NO: 21955 - DNA, 20 bp, synthetic construct
  source 1..20: mol_type = other DNA
ccaaacacaccggagtgtcc

SEQ ID NO: 21956 - DNA, 20 bp, synthetic construct
  source 1..20: mol_type = other DNA
gccgacatgggctactggat

SEQ ID NO: 21957 - DNA, 20 bp, synthetic construct
  source 1..20: mol_type = other DNA
tgttgccgctcgtgcacact

SEQ ID NO: 21958 - DNA, 20 bp, synthetic construct
  source 1..20: mol_type = other DNA
ttagtggccgggggcttgct

SEQ ID NO: 21959 - DNA, 20 bp, synthetic construct
  source 1..20: mol_type = other DNA
ctgatttcatatggaggagg

SEQ ID NO: 21960 - DNA, 20 bp, synthetic construct
  source 1..20: mol_type = other DNA
atggatcttcatcctgggtc

SEQ ID NO: 21961 - DNA, 20 bp, synthetic construct
  source 1..20: mol_type = other DNA
tctgaacacacaggaagaga

SEQ ID NO: 21962 - DNA, 20 bp, synthetic construct
  source 1..20: mol_type = other DNA
ggagaggcagccgcaatctt

SEQ ID NO: 21963 - DNA, 20 bp, synthetic construct
  source 1..20: mol_type = other DNA
attaaagccggaaatgacat

SEQ ID NO: 21964 - DNA, 20 bp, synthetic construct
  source 1..20: mol_type = other DNA
aggggtgaccttccagtttg

SEQ ID NO: 21965 - DNA, 20 bp, synthetic construct
  source 1..20: mol_type = other DNA
gatgcccgcacttattcaga

SEQ ID NO: 21966 - DNA, 20 bp, synthetic construct
  source 1..20: mol_type = other DNA
ggcggtagggcttacaggca

SEQ ID NO: 21967 - DNA, 20 bp, synthetic construct
  source 1..20: mol_type = other DNA
tgcgcagtccaactcttgct

SEQ ID NO: 21968 - DNA, 20 bp, synthetic construct
  source 1..20: mol_type = other DNA
cttgctttttctattatgaa

SEQ ID NO: 21969 - DNA, 20 bp, synthetic construct
  source 1..20: mol_type = other DNA
ttgaaaagaggagagacaac

SEQ ID NO: 21970 - DNA, 20 bp, synthetic construct
  source 1..20: mol_type = other DNA
tacacaaaaggcggtccagg

SEQ ID NO: 21971 - DNA, 20 bp, synthetic construct
  source 1..20: mol_type = other DNA
tggatatctaatggcacagg

SEQ ID NO: 21972 - DNA, 20 bp, synthetic construct
  source 1..20: mol_type = other DNA
atattcaagctcacatacca

SEQ ID NO: 21973 - DNA, 20 bp, synthetic construct
  source 1..20: mol_type = other DNA
gctcaccatcagtggatgac

SEQ ID NO: 21974 - DNA, 20 bp, synthetic construct
  source 1..20: mol_type = other DNA
gcaacctgggcccagaacat

SEQ ID NO: 21975 - DNA, 20 bp, synthetic construct
  source 1..20: mol_type = other DNA
taagccacagtacggaagaa

SEQ ID NO: 21976 - DNA, 20 bp, synthetic construct
  source 1..20: mol_type = other DNA
gttagaggagaccccccgca

SEQ ID NO: 21977 - DNA, 20 bp, synthetic construct
  source 1..20: mol_type = other DNA
atgctggtaactccatccat

SEQ ID NO: 21978 - DNA, 20 bp, synthetic construct
  source 1..20: mol_type = other DNA
caagctcccacgtcggaaat

SEQ ID NO: 21979 - DNA, 20 bp, synthetic construct
  source 1..20: mol_type = other DNA
gaatggtgctgtagatcttg

SEQ ID NO: 21980 - DNA, 20 bp, synthetic construct
  source 1..20: mol_type = other DNA
ggcccactaatagctggagg

SEQ ID NO: 21981 - DNA, 20 bp, synthetic construct
  source 1..20: mol_type = other DNA
cccggcacatctggatctcc

SEQ ID NO: 21982 - DNA, 20 bp, synthetic construct
  source 1..20: mol_type = other DNA
acaataatggacctacatcc

SEQ ID NO: 21983 - DNA, 20 bp, synthetic construct
  source 1..20: mol_type = other DNA
agggtaatagacccgaggcg

SEQ ID NO: 21984 - DNA, 20 bp, synthetic construct
  source 1..20: mol_type = other DNA
aatgagatgggattactgga

SEQ ID NO: 21985 - DNA, 20 bp, synthetic construct
  source 1..20: mol_type = other DNA
gatgtcattcccatggtcac

SEQ ID NO: 21986 - DNA, 20 bp, synthetic construct
  source 1..20: mol_type = other DNA
atccatgcccaccatcaatg

SEQ ID NO: 21987 - DNA, 20 bp, synthetic construct
  source 1..20: mol_type = other DNA
cggccaaaagccacgtgtat

SEQ ID NO: 21988 - DNA, 20 bp, synthetic construct
  source 1..20: mol_type = other DNA
caccttcaaggttaatgatt

SEQ ID NO: 21989 - DNA, 20 bp, synthetic construct
  source 1..20: mol_type = other DNA
ccacgctggaggtttgctgg

SEQ ID NO: 21990 - DNA, 20 bp, synthetic construct
  source 1..20: mol_type = other DNA
cgaatacaaggacttcctgg

SEQ ID NO: 21991 - DNA, 20 bp, synthetic construct
  source 1..20: mol_type = other DNA
gtctagaaactttgctcagt

SEQ ID NO: 21992 - DNA, 20 bp, synthetic construct
  source 1..20: mol_type = other DNA
agggaaggatttctcactca

SEQ ID NO: 21993 - DNA, 20 bp, synthetic construct
  source 1..20: mol_type = other DNA
agaggagaacgttttcggtt

SEQ ID NO: 21994 - DNA, 20 bp, synthetic construct
  source 1..20: mol_type = other DNA
cagatgtgtgcagctgattg

SEQ ID NO: 21995 - DNA, 20 bp, synthetic construct
  source 1..20: mol_type = other DNA
ccccgaacatgcgaagcgca

SEQ ID NO: 21996 - DNA, 20 bp, synthetic construct
  source 1..20: mol_type = other DNA
agctgggctccagttcagag

SEQ ID NO: 21997 - DNA, 20 bp, synthetic construct
  source 1..20: mol_type = other DNA
taaagcaagacagcaagcga

SEQ ID NO: 21998 - DNA, 20 bp, synthetic construct
  source 1..20: mol_type = other DNA
ctaccccactggggtgagca

SEQ ID NO: 21999 - DNA, 20 bp, synthetic construct
  source 1..20: mol_type = other DNA
atctttcatccgcctctctt

SEQ ID NO: 22000 - DNA, 20 bp, synthetic construct
  source 1..20: mol_type = other DNA
cacctccccggggcttccat

SEQ ID NO: 22001 - DNA, 20 bp, synthetic construct
  source 1..20: mol_type = other DNA
aggagtctctttgttgagga

SEQ ID NO: 22002 - DNA, 20 bp, synthetic construct
  source 1..20: mol_type = other DNA
atctagcaagacaatgtaga

SEQ ID NO: 22003 - DNA, 20 bp, synthetic construct
  source 1..20: mol_type = other DNA
aaaaagagcagatccaaata

SEQ ID NO: 22004 - DNA, 20 bp, synthetic construct
  source 1..20: mol_type = other DNA
ttatcaagtatatcagaagg

SEQ ID NO: 22005 - DNA, 20 bp, synthetic construct
  source 1..20: mol_type = other DNA
agaagcctgggaatcaaatt

SEQ ID NO: 22006 - DNA, 20 bp, synthetic construct
  source 1..20: mol_type = other DNA
agcaaaagcagcctattgga

SEQ ID NO: 22007 - DNA, 20 bp, synthetic construct
  source 1..20: mol_type = other DNA
attacaaacagataatggac

SEQ ID NO: 22008 - DNA, 20 bp, synthetic construct
  source 1..20: mol_type = other DNA
gaagaatcagaaataatttt

SEQ ID NO: 22009 - DNA, 20 bp, synthetic construct
  source 1..20: mol_type = other DNA
acaaaaaacctaacctttgc

SEQ ID NO: 22010 - DNA, 20 bp, synthetic construct
  source 1..20: mol_type = other DNA
tggaaagcttgctaatgacg

SEQ ID NO: 22011 - DNA, 20 bp, synthetic construct
  source 1..20: mol_type = other DNA
ctgaaaaacaaggctctgac

SEQ ID NO: 22012 - DNA, 20 bp, synthetic construct
  source 1..20: mol_type = other DNA
cttccgcgttcttgtctcgt

SEQ ID NO: 22013 - DNA, 20 bp, synthetic construct
  source 1..20: mol_type = other DNA
gcattgtcttcccggggaag

SEQ ID NO: 22014 - DNA, 20 bp, synthetic construct
  source 1..20: mol_type = other DNA
ctcttgggcagctatcctac

SEQ ID NO: 22015 - DNA, 20 bp, synthetic construct
  source 1..20: mol_type = other DNA
acacactaacagcccccttg

SEQ ID NO: 22016 - DNA, 20 bp, synthetic construct
  source 1..20: mol_type = other DNA
gacatctcgatactcccact

SEQ ID NO: 22017 - DNA, 20 bp, synthetic construct
  source 1..20: mol_type = other DNA
accctgatcctaggcgccag

SEQ ID NO: 22018 - DNA, 20 bp, synthetic construct
  source 1..20: mol_type = other DNA
cttctatacctcccagacga

SEQ ID NO: 22019 - DNA, 20 bp, synthetic construct
  source 1..20: mol_type = other DNA
ttgaaccatactcaggacca

SEQ ID NO: 22020 - DNA, 20 bp, synthetic construct
  source 1..20: mol_type = other DNA
agaccatagatcttactgac

SEQ ID NO: 22021 - DNA, 20 bp, synthetic construct
  source 1..20: mol_type = other DNA
ccctatattctgcccttcac

SEQ ID NO: 22022 - DNA, 20 bp, synthetic construct
  source 1..20: mol_type = other DNA
catctgtcatctttcaaccc

SEQ ID NO: 22023 - DNA, 20 bp, synthetic construct
  source 1..20: mol_type = other DNA
caaagcaagccctttgcgac

SEQ ID NO: 22024 - DNA, 20 bp, synthetic construct
  source 1..20: mol_type = other DNA
gcagccacaccaacctcccc

SEQ ID NO: 22025 - DNA, 20 bp, synthetic construct
  source 1..20: mol_type = other DNA
tccaccacagtcctccacta

SEQ ID NO: 22026 - DNA, 20 bp, synthetic construct
  source 1..20: mol_type = other DNA
ggtggatcccgtggcgattc

SEQ ID NO: 22027 - DNA, 20 bp, synthetic construct
  source 1..20: mol_type = other DNA
gtgtcccttcgactacactt

SEQ ID NO: 22028 - DNA, 20 bp, synthetic construct
  source 1..20: mol_type = other DNA
cccgctcctccatcccaacc

SEQ ID NO: 22029 - DNA, 20 bp, synthetic construct
  source 1..20: mol_type = other DNA
tccgccctagcggccggaac

SEQ ID NO: 22030 - DNA, 20 bp, synthetic construct
  source 1..20: mol_type = other DNA
cgaggattagacctcctatt

SEQ ID NO: 22031 - DNA, 20 bp, synthetic construct
  source 1..20: mol_type = other DNA
gaaatccacataaccctgaa

SEQ ID NO: 22032 - DNA, 20 bp, synthetic construct
  source 1..20: mol_type = other DNA
ccacctgtccagagcaccaa

SEQ ID NO: 22033 - DNA, 20 bp, synthetic construct
  source 1..20: mol_type = other DNA
tctttcaatcaatgcgaaag

SEQ ID NO: 22034 - DNA, 20 bp, synthetic construct
  source 1..20: mol_type = other DNA
aaaaattcgaaaccaaagcc

SEQ ID NO: 22035 - DNA, 20 bp, synthetic construct
  source 1..20: mol_type = other DNA
ttcccctagcgctgaaaaac

SEQ ID NO: 22036 - DNA, 20 bp, synthetic construct
  source 1..20: mol_type = other DNA
gcggcctcggttgagacgcc

SEQ ID NO: 22037 - DNA, 20 bp, synthetic construct
  source 1..20: mol_type = other DNA
gtacccactgccaaaagcct

SEQ ID NO: 22038 - DNA, 20 bp, synthetic construct
  source 1..20: mol_type = other DNA
cagcttatgctgggacgccc

SEQ ID NO: 22039 - DNA, 20 bp, synthetic construct
  source 1..20: mol_type = other DNA
gttaaatacacattcacgca

SEQ ID NO: 22040 - DNA, 20 bp, synthetic construct
  source 1..20: mol_type = other DNA
agattctcttcgatgtatac

SEQ ID NO: 22041 - DNA, 20 bp, synthetic construct
  source 1..20: mol_type = other DNA
tacacatggcaaagtgcttc

SEQ ID NO: 22042 - DNA, 20 bp, synthetic construct
  source 1..20: mol_type = other DNA
atggcattcagaatagtaaa

SEQ ID NO: 22043 - DNA, 20 bp, synthetic construct
  source 1..20: mol_type = other DNA
ttcaccagtaattttgttct

SEQ ID NO: 22044 - DNA, 20 bp, synthetic construct
  source 1..20: mol_type = other DNA
gattgccatcaaccatctaa

SEQ ID NO: 22045 - DNA, 20 bp, synthetic construct
  source 1..20: mol_type = other DNA
ctatccctgttaaggaaaaa

SEQ ID NO: 22046 - DNA, 20 bp, synthetic construct
  source 1..20: mol_type = other DNA
attaatttgagtagcacccc

SEQ ID NO: 22047 - DNA, 20 bp, synthetic construct
  source 1..20: mol_type = other DNA
ttattctctaagtacaaggg

SEQ ID NO: 22048 - DNA, 20 bp, synthetic construct
  source 1..20: mol_type = other DNA
tttgattactctaattttga

SEQ ID NO: 22049 - DNA, 20 bp, synthetic construct
  source 1..20: mol_type = other DNA
tcttttgtctttctcagttt

SEQ ID NO: 22050 - DNA, 20 bp, synthetic construct
  source 1..20: mol_type = other DNA
tggtttcctagggaaggcac

SEQ ID NO: 22051 - DNA, 20 bp, synthetic construct
  source 1..20: mol_type = other DNA
aatttgttaaaacaggaaga

SEQ ID NO: 22052 - DNA, 20 bp, synthetic construct
  source 1..20: mol_type = other DNA
ctaaaagagttaaagattgc

SEQ ID NO: 22053 - DNA, 20 bp, synthetic construct
  source 1..20: mol_type = other DNA
actaagacagaggacctttc

SEQ ID NO: 22054 - DNA, 20 bp, synthetic construct
  source 1..20: mol_type = other DNA
agaccttatcgaaaaaaggg

SEQ ID NO: 22055 - DNA, 20 bp, synthetic construct
  source 1..20: mol_type = other DNA
tcgggttgctttgtttgtgg

SEQ ID NO: 22056 - DNA, 20 bp, synthetic construct
  source 1..20: mol_type = other DNA
attatttgacatccttaaag

SEQ ID NO: 22057 - DNA, 20 bp, synthetic construct
  source 1..20: mol_type = other DNA
tcaatatggtgtcaaccctc

SEQ ID NO: 22058 - DNA, 20 bp, synthetic construct
  source 1..20: mol_type = other DNA
tgagtgagcccacgagtgag

SEQ ID NO: 22059 - DNA, 20 bp, synthetic construct
  source 1..20: mol_type = other DNA
cgcagcatccccattgtata

SEQ ID NO: 22060 - DNA, 20 bp, synthetic construct
  source 1..20: mol_type = other DNA
ctttatgtcgagcccgggtt

SEQ ID NO: 22061 - DNA, 20 bp, synthetic construct
  source 1..20: mol_type = other DNA
gagctgcgggggacgacccg

SEQ ID NO: 22062 - DNA, 20 bp, synthetic construct
  source 1..20: mol_type = other DNA
agtaccaattcctggagatt

SEQ ID NO: 22063 - DNA, 20 bp, synthetic construct
  source 1..20: mol_type = other DNA
ctcagatattgaagtgcaag

SEQ ID NO: 22064 - DNA, 20 bp, synthetic construct
  source 1..20: mol_type = other DNA
aggatcataccctctgctct

SEQ ID NO: 22065 - DNA, 20 bp, synthetic construct
  source 1..20: mol_type = other DNA
accatccactcccacgactg

SEQ ID NO: 22066 - DNA, 20 bp, synthetic construct
  source 1..20: mol_type = other DNA
gcaaggaagaggaggcaggc

SEQ ID NO: 22067 - DNA, 20 bp, synthetic construct
  source 1..20: mol_type = other DNA
ccgagacacccattaaaaag

SEQ ID NO: 22068 - DNA, 20 bp, synthetic construct
  source 1..20: mol_type = other DNA
ccggccctgcatcacgcagt

SEQ ID NO: 22069 - DNA, 20 bp, synthetic construct
  source 1..20: mol_type = other DNA
acccgaggaactcctcaaag

SEQ ID NO: 22070 - DNA, 20 bp, synthetic construct
  source 1..20: mol_type = other DNA
taatctaataccgctggaca

SEQ ID NO: 22071 - DNA, 20 bp, synthetic construct
  source 1..20: mol_type = other DNA
acagccagcatcgcgaggaa

SEQ ID NO: 22072 - DNA, 20 bp, synthetic construct
  source 1..20: mol_type = other DNA
cagcacccaagagcgatccc

SEQ ID NO: 22073 - DNA, 20 bp, synthetic construct
  source 1..20: mol_type = other DNA
tcaagactcatccagtgtcc

SEQ ID NO: 22074 - DNA, 20 bp, synthetic construct
  source 1..20: mol_type = other DNA
gacacaagagatttgcggga

SEQ ID NO: 22075 - DNA, 20 bp, synthetic construct
  source 1..20: mol_type = other DNA
cagggcaggagatgatattg

SEQ ID NO: 22076 - DNA, 20 bp, synthetic construct
  source 1..20: mol_type = other DNA
tagcctatccgacgctgtcc

SEQ ID NO: 22077 - DNA, 20 bp, synthetic construct
  source 1..20: mol_type = other DNA
ccagagagaatcaaattgga

SEQ ID NO: 22078 - DNA, 20 bp, synthetic construct
  source 1..20: mol_type = other DNA
ccattgatcacacacggttc

SEQ ID NO: 22079 - DNA, 20 bp, synthetic construct
  source 1..20: mol_type = other DNA
ttttcttacttttatccttt

SEQ ID NO: 22080 - DNA, 20 bp, synthetic construct
  source 1..20: mol_type = other DNA
acagtcactcgggaagatgg

SEQ ID NO: 22081 - DNA, 20 bp, synthetic construct
  source 1..20: mol_type = other DNA
ataccctgaagttcacctag

SEQ ID NO: 22082 - DNA, 20 bp, synthetic construct
  source 1..20: mol_type = other DNA
tacttgccataggaggagac

SEQ ID NO: 22083 - DNA, 20 bp, synthetic construct
  source 1..20: mol_type = other DNA
gaccgctatgaccattgatg

SEQ ID NO: 22084 - DNA, 20 bp, synthetic construct
  source 1..20: mol_type = other DNA
tgctgcagacacaatccgga

SEQ ID NO: 22085 - DNA, 20 bp, synthetic construct
  source 1..20: mol_type = other DNA
tgtaagtgaccctcattgcc

SEQ ID NO: 22086 - DNA, 20 bp, synthetic construct
  source 1..20: mol_type = other DNA
aaggattgcttcgttagtgc

SEQ ID NO: 22087 - DNA, 20 bp, synthetic construct
  source 1..20: mol_type = other DNA
gagaggttatgaccgttatc

SEQ ID NO: 22088 - DNA, 20 bp, synthetic construct
  source 1..20: mol_type = other DNA
ggggatgaattatctgaata

SEQ ID NO: 22089 - DNA, 20 bp, synthetic construct
  source 1..20: mol_type = other DNA
cgacccttactcagcaaatc

SEQ ID NO: 22090 - DNA, 20 bp, synthetic construct
  source 1..20: mol_type = other DNA
tatagtacctagggcagctc

SEQ ID NO: 22091 - DNA, 20 bp, synthetic construct
  source 1..20: mol_type = other DNA
agcagggatggtgctattga

SEQ ID NO: 22092 - DNA, 20 bp, synthetic construct
  source 1..20: mol_type = other DNA
aagagccccaagtagatcct

SEQ ID NO: 22093 - DNA, 20 bp, synthetic construct
  source 1..20: mol_type = other DNA
agcgcataggttgagggatc

SEQ ID NO: 22094 - DNA, 20 bp, synthetic construct
  source 1..20: mol_type = other DNA
agaaacattgtttcgactcg

SEQ ID NO: 22095 - DNA, 20 bp, synthetic construct
  source 1..20: mol_type = other DNA
tgacgccctcgctgaggtaa

SEQ ID NO: 22096 - DNA, 20 bp, synthetic construct
  source 1..20: mol_type = other DNA
gcggacttcacctggactta

SEQ ID NO: 22097 - DNA, 20 bp, synthetic construct
  source 1..20: mol_type = other DNA
gatcactcgcaaattttggg

SEQ ID NO: 22098 - DNA, 20 bp, synthetic construct
  source 1..20: mol_type = other DNA
ctctgcagaatggccaacct

SEQ ID NO: 22099 - DNA, 20 bp, synthetic construct
  source 1..20: mol_type = other DNA
caagccctttgtacacccta

SEQ ID NO: 22100 - DNA, 20 bp, synthetic construct
  source 1..20: mol_type = other DNA
ggcattccccctccgcacag

SEQ ID NO: 22101 - DNA, 20 bp, synthetic construct
  source 1..20: mol_type = other DNA
cctcatcaccacactccact

SEQ ID NO: 22102 - DNA, 20 bp, synthetic construct
  source 1..20: mol_type = other DNA
cactgtggccgtgaagacct

SEQ ID NO: 22103 - DNA, 20 bp, synthetic construct
  source 1..20: mol_type = other DNA
ggactacctgagggagtgta

SEQ ID NO: 22104 - DNA, 20 bp, synthetic construct
  source 1..20: mol_type = other DNA
ggaatccagtatctcagatg

SEQ ID NO: 22105 - DNA, 20 bp, synthetic construct
  source 1..20: mol_type = other DNA
ggtcactgcctctccttcct

SEQ ID NO: 22106 - DNA, 20 bp, synthetic construct
  source 1..20: mol_type = other DNA
gtccccagggagagacaagg

SEQ ID NO: 22107 - DNA, 20 bp, synthetic construct
  source 1..20: mol_type = other DNA
tgaccccaccaaggccggcc

SEQ ID NO: 22108 - DNA, 20 bp, synthetic construct
  source 1..20: mol_type = other DNA
cgccttcatccccctcatat

SEQ ID NO: 22109 - DNA, 20 bp, synthetic construct
  source 1..20: mol_type = other DNA
ggctggcaagaacctgtaca

SEQ ID NO: 22110 - DNA, 20 bp, synthetic construct
  source 1..20: mol_type = other DNA
gagggagacctggatggagc

SEQ ID NO: 22111 - DNA, 20 bp, synthetic construct
  source 1..20: mol_type = other DNA
ccccggtgcctcagacccag

SEQ ID NO: 22112 - DNA, 20 bp, synthetic construct
  source 1..20: mol_type = other DNA
ttcattggaaggaagctgtc

SEQ ID NO: 22113 - DNA, 20 bp, synthetic construct
  source 1..20: mol_type = other DNA
cactggctggctaggcacat

SEQ ID NO: 22114 - DNA, 20 bp, synthetic construct
  source 1..20: mol_type = other DNA
agagtacgagccatagataa

SEQ ID NO: 22115 - DNA, 20 bp, synthetic construct
  source 1..20: mol_type = other DNA
cagctgaatatgggccaaac

SEQ ID NO: 22116 - DNA, 20 bp, synthetic construct
  source 1..20: mol_type = other DNA
cagtttctagagaaccatca

SEQ ID NO: 22117 - DNA, 20 bp, synthetic construct
  source 1..20: mol_type = other DNA
gcacgattctgggtgaaaga

SEQ ID NO: 22118 - DNA, 20 bp, synthetic construct
  source 1..20: mol_type = other DNA
tgccccggctcagggccaag

SEQ ID NO: 22119 - DNA, 20 bp, synthetic construct
  source 1..20: mol_type = other DNA
aacgccattttgcaaggcat

SEQ ID NO: 22120 - DNA, 20 bp, synthetic construct
  source 1..20: mol_type = other DNA
cccaccgtcgggaggtaagc

SEQ ID NO: 22121 - DNA, 20 bp, synthetic construct
  source 1..20: mol_type = other DNA
tttcggtttttcgccgaaac

SEQ ID NO: 22122 - DNA, 20 bp, synthetic construct
  source 1..20: mol_type = other DNA
agtccgtagatgtcaagaag

SEQ ID NO: 22123 - DNA, 20 bp, synthetic construct
  source 1..20: mol_type = other DNA
tcacctgggaggctattgcc

SEQ ID NO: 22124 - DNA, 20 bp, synthetic construct
  source 1..20: mol_type = other DNA
cgataatggcggacctctca

SEQ ID NO: 22125 - DNA, 20 bp, synthetic construct
  source 1..20: mol_type = other DNA
agcccacctgggatgattgc

SEQ ID NO: 22126 - DNA, 20 bp, synthetic construct
  source 1..20: mol_type = other DNA
aagaaagagagagaaggaga

SEQ ID NO: 22127 - DNA, 20 bp, synthetic construct
  source 1..20: mol_type = other DNA
cccaaaatcctggaccccta

SEQ ID NO: 22128 - DNA, 20 bp, synthetic construct
  source 1..20: mol_type = other DNA
cttctaaaagagggtcaggg

SEQ ID NO: 22129 - DNA, 20 bp, synthetic construct
  source 1..20: mol_type = other DNA
acggggactctgtttaaatg

SEQ ID NO: 22130 - DNA, 20 bp, synthetic construct
  source 1..20: mol_type = other DNA
tctgtatggggcacccccgc

SEQ ID NO: 22131 - DNA, 20 bp, synthetic construct
  source 1..20: mol_type = other DNA
ccccctccgtgtcggtgacg

SEQ ID NO: 22132 - DNA, 20 bp, synthetic construct
  source 1..20: mol_type = other DNA
aatatagggccccgcatccc

SEQ ID NO: 22133 - DNA, 20 bp, synthetic construct
  source 1..20: mol_type = other DNA
ttactaaatctagtacaggg

SEQ ID NO: 22134 - DNA, 20 bp, synthetic construct
  source 1..20: mol_type = other DNA
gaccatacaggcctagtaag

SEQ ID NO: 22135 - DNA, 20 bp, synthetic construct
  source 1..20: mol_type = other DNA
gccaagaacagatggtcccc

SEQ ID NO: 22136 - DNA, 20 bp, synthetic construct
  source 1..20: mol_type = other DNA
atctggcggacccgtggtgg

SEQ ID NO: 22137 - DNA, 20 bp, synthetic construct
  source 1..20: mol_type = other DNA
agacgagaacctaaaacagt

SEQ ID NO: 22138 - DNA, 20 bp, synthetic construct
  source 1..20: mol_type = other DNA
gaccttaggtcactggaaag

SEQ ID NO: 22139 - DNA, 20 bp, synthetic construct
  source 1..20: mol_type = other DNA
agggcccaatgagtctccct

SEQ ID NO: 22140 - DNA, 20 bp, synthetic construct
  source 1..20: mol_type = other DNA
cctgaccctagatgactagg

SEQ ID NO: 22141 - DNA, 20 bp, synthetic construct
  source 1..20: mol_type = other DNA
gatcatacctctgaaagcaa

SEQ ID NO: 22142 - DNA, 20 bp, synthetic construct
  source 1..20: mol_type = other DNA
cgtggatgacttactgctgg

SEQ ID NO: 22143 - DNA, 20 bp, synthetic construct
  source 1..20: mol_type = other DNA
gactgaggccagaaaagaga

SEQ ID NO: 22144 - DNA, 20 bp, synthetic construct
  source 1..20: mol_type = other DNA
gccgctcccagacgccgacc

SEQ ID NO: 22145 - DNA, 20 bp, synthetic construct
  source 1..20: mol_type = other DNA
agtgactgatataaaggacc

SEQ ID NO: 22146 - DNA, 20 bp, synthetic construct
  source 1..20: mol_type = other DNA
cttagccctgtaccgagccc

SEQ ID NO: 22147 - DNA, 20 bp, synthetic construct
  source 1..20: mol_type = other DNA
agtctggagacctctggcgg

SEQ ID NO: 22148 - DNA, 20 bp, synthetic construct
  source 1..20: mol_type = other DNA
cgcgtcccaatagggccaaa

SEQ ID NO: 22149 - DNA, 20 bp, synthetic construct
  source 1..20: mol_type = other DNA
caagccctcaacctcaccag

SEQ ID NO: 22150 - DNA, 20 bp, synthetic construct
  source 1..20: mol_type = other DNA
accattatgggacccctcat

SEQ ID NO: 22151 - DNA, 20 bp, synthetic construct
  source 1..20: mol_type = other DNA
ccagggtgccccaaggacct

SEQ ID NO: 22152 - DNA, 20 bp, synthetic construct
  source 1..20: mol_type = other DNA
ccaataaaccctcttgcagt

SEQ ID NO: 22153 - DNA, 20 bp, synthetic construct
  source 1..20: mol_type = other DNA
cgggggtctttcatttgggg

SEQ ID NO: 22154 - DNA, 20 bp, synthetic construct
  source 1..20: mol_type = other DNA
gtctcgctgttccttgggag

SEQ ID NO: 22155 - DNA, 20 bp, synthetic construct
  source 1..20: mol_type = other DNA
tgtttgatgttatgcgcctg

SEQ ID NO: 22156 - DNA, 20 bp, synthetic construct
  source 1..20: mol_type = other DNA
cgaccccgtcaggatatgtg

SEQ ID NO: 22157 - DNA, 20 bp, synthetic construct
  source 1..20: mol_type = other DNA
atcacccaggttaagatcaa

SEQ ID NO: 22158 - DNA, 20 bp, synthetic construct
  source 1..20: mol_type = other DNA
gaacctcctctttcgacccc

SEQ ID NO: 22159 - DNA, 20 bp, synthetic construct
  source 1..20: mol_type = other DNA
ggagatagtggagaagcgac

SEQ ID NO: 22160 - DNA, 20 bp, synthetic construct
  source 1..20: mol_type = other DNA
gcggtgcggggcgatgatgg

SEQ ID NO: 22161 - DNA, 20 bp, synthetic construct
  source 1..20: mol_type = other DNA
gatcgtaggagacatagaga

SEQ ID NO: 22162 - DNA, 20 bp, synthetic construct
  source 1..20: mol_type = other DNA
cggggaccaagaccccagac

SEQ ID NO: 22163 - DNA, 20 bp, synthetic construct
  source 1..20: mol_type = other DNA
gcctacggatggtagcagcc

SEQ ID NO: 22164 - DNA, 20 bp, synthetic construct
  source 1..20: mol_type = other DNA
gggaccgggtccagttcaga

SEQ ID NO: 22165 - DNA, 20 bp, synthetic construct
  source 1..20: mol_type = other DNA
gaagcagtcttttacaagag

SEQ ID NO: 22166 - DNA, 20 bp, synthetic construct
  source 1..20: mol_type = other DNA
gcccgcaacacgccgggccc

SEQ ID NO: 22167 - DNA, 20 bp, synthetic construct
  source 1..20: mol_type = other DNA
tgagctgtcgccatcggtag

SEQ ID NO: 22168 - DNA, 20 bp, synthetic construct
  source 1..20: mol_type = other DNA
cacgcccgaagactccaaca

SEQ ID NO: 22169 - DNA, 20 bp, synthetic construct
  source 1..20: mol_type = other DNA
ggagatcctaaaaggagaga

SEQ ID NO: 22170 - DNA, 20 bp, synthetic construct
  source 1..20: mol_type = other DNA
ctccctgactggaaaggcac

SEQ ID NO: 22171 - DNA, 20 bp, synthetic construct
  source 1..20: mol_type = other DNA
ggacctgaaaatgaccctgt

SEQ ID NO: 22172 - DNA, 20 bp, synthetic construct
  source 1..20: mol_type = other DNA
aaagttcagatcaaggtcag

SEQ ID NO: 22173 - DNA, 20 bp, synthetic construct
  source 1..20: mol_type = other DNA
ttatttgaactaaccaatca

SEQ ID NO: 22174 - DNA, 20 bp, synthetic construct
  source 1..20: mol_type = other DNA
ctctcctgcctgactgtgga

SEQ ID NO: 22175 - DNA, 20 bp, synthetic construct
  source 1..20: mol_type = other DNA
gtcatggaaggagttatggg

SEQ ID NO: 22176 - DNA, 20 bp, synthetic construct
  source 1..20: mol_type = other DNA
ttaaaatgcagctgttagca

SEQ ID NO: 22177 - DNA, 20 bp, synthetic construct
  source 1..20: mol_type = other DNA
agaaatattaagggattgga

SEQ ID NO: 22178 - DNA, 20 bp, synthetic construct
  source 1..20: mol_type = other DNA
agggtatccagcaaagtggc

SEQ ID NO: 22179 - DNA, 20 bp, synthetic construct
  source 1..20: mol_type = other DNA
aaagttaatggaaggggata

SEQ ID NO: 22180 - DNA, 20 bp, synthetic construct
  source 1..20: mol_type = other DNA
cgttaaatttagaaaacacg

SEQ ID NO: 22181 - DNA, 20 bp, synthetic construct
  source 1..20: mol_type = other DNA
ggtagtagtatataacagca

SEQ ID NO: 22182 - DNA, 20 bp, synthetic construct
  source 1..20: mol_type = other DNA
tattcccctagcagaggaag

SEQ ID NO: 22183 - DNA, 20 bp, synthetic construct
  source 1..20: mol_type = other DNA
gtggctgggaccaacacagg

SEQ ID NO: 22184 - DNA, 20 bp, synthetic construct
  source 1..20: mol_type = other DNA
gtaacaggtaaggaaaaatc

SEQ ID NO: 22185 - DNA, 20 bp, synthetic construct
  source 1..20: mol_type = other DNA
ggcgttgctaatgccgtgca

SEQ ID NO: 22186 - DNA, 20 bp, synthetic construct
  source 1..20: mol_type = other DNA
ggctgcaccaatggggtagc

SEQ ID NO: 22187 - DNA, 20 bp, synthetic construct
  source 1..20: mol_type = other DNA
tggacaacccattattaagc

SEQ ID NO: 22188 - DNA, 20 bp, synthetic construct
  source 1..20: mol_type = other DNA
agtgcaggactggacctctg

SEQ ID NO: 22189 - DNA, 20 bp, synthetic construct
  source 1..20: mol_type = other DNA
aacccccaacaaagtgctca

SEQ ID NO: 22190 - DNA, 20 bp, synthetic construct
  source 1..20: mol_type = other DNA
aagagccgttaataaggtaa

SEQ ID NO: 22191 - DNA, 20 bp, synthetic construct
  source 1..20: mol_type = other DNA
caacttccaaagtcctatgc

SEQ ID NO: 22192 - DNA, 20 bp, synthetic construct
  source 1..20: mol_type = other DNA
cttactcacctacccctcgc

SEQ ID NO: 22193 - DNA, 20 bp, synthetic construct
  source 1..20: mol_type = other DNA
aaaatccccctacctgtcag

SEQ ID NO: 22194 - DNA, 20 bp, synthetic construct
  source 1..20: mol_type = other DNA
ggggcgaggctcagcctgca

SEQ ID NO: 22195 - DNA, 20 bp, synthetic construct
  source 1..20: mol_type = other DNA
cagcaagcccctattcacgt

SEQ ID NO: 22196 - DNA, 20 bp, synthetic construct
  source 1..20: mol_type = other DNA
attctgtcagccacccacca

SEQ ID NO: 22197 - DNA, 20 bp, synthetic construct
  source 1..20: mol_type = other DNA
ctgcctgcaaactggacagg

SEQ ID NO: 22198 - DNA, 20 bp, synthetic construct
  source 1..20: mol_type = other DNA
gctaccggtacagcaggact

SEQ ID NO: 22199 - DNA, 20 bp, synthetic construct
  source 1..20: mol_type = other DNA
cccttccttggacccttatt

SEQ ID NO: 22200 - DNA, 20 bp, synthetic construct
  source 1..20: mol_type = other DNA
ccaaaaaggtacctgtaagc

SEQ ID NO: 22201 - DNA, 20 bp, synthetic construct
  source 1..20: mol_type = other DNA
ttaaataaagcatacaagtc

SEQ ID NO: 22202 - DNA, 20 bp, synthetic construct
  source 1..20: mol_type = other DNA
tctgttctagggggctatct

SEQ ID NO: 22203 - DNA, 20 bp, synthetic construct
  source 1..20: mol_type = other DNA
actaccggccgagagctcaa

SEQ ID NO: 22204 - DNA, 20 bp, synthetic construct
  source 1..20: mol_type = other DNA
ttctacctactgctccacta

SEQ ID NO: 22205 - DNA, 20 bp, synthetic construct
  source 1..20: mol_type = other DNA
cccttcaaaagggtgtttaa

SEQ ID NO: 22206 - DNA, 20 bp, synthetic construct
  source 1..20: mol_type = other DNA
tttcctgatgacatgctgga

SEQ ID NO: 22207 - DNA, 20 bp, synthetic construct
  source 1..20: mol_type = other DNA
caccttatacatgaacgccc

SEQ ID NO: 22208 - DNA, 20 bp, synthetic construct
  source 1..20: mol_type = other DNA
tgacagaaactacacactta

SEQ ID NO: 22209 - DNA, 20 bp, synthetic construct
  source 1..20: mol_type = other DNA
atcaatggatccatcagaaa

SEQ ID NO: 22210 - DNA, 20 bp, synthetic construct
  source 1..20: mol_type = other DNA
ctggagtctagtcagcttat

SEQ ID NO: 22211 - DNA, 20 bp, synthetic construct
  source 1..20: mol_type = other DNA
ccaaatagtcaacctcgcca

SEQ ID NO: 22212 - DNA, 20 bp, synthetic construct
  source 1..20: mol_type = other DNA
gtcctggattcacgcgttgt

SEQ ID NO: 22213 - DNA, 20 bp, synthetic construct
  source 1..20: mol_type = other DNA
ccgaacgataagaaggcagt

SEQ ID NO: 22214 - DNA, 20 bp, synthetic construct
  source 1..20: mol_type = other DNA
gggctcgtccacctctatgt

SEQ ID NO: 22215 - DNA, 20 bp, synthetic construct
  source 1..20: mol_type = other DNA
tattctcctgaggctagata

SEQ ID NO: 22216 - DNA, 20 bp, synthetic construct
  source 1..20: mol_type = other DNA
aggatgttcagaatgggtct

SEQ ID NO: 22217 - DNA, 20 bp, synthetic construct
  source 1..20: mol_type = other DNA
tattctagatgatctcaatg

SEQ ID NO: 22218 - DNA, 20 bp, synthetic construct
  source 1..20: mol_type = other DNA
acgcagatgcaggtcagtga

SEQ ID NO: 22219 - DNA, 20 bp, synthetic construct
  source 1..20: mol_type = other DNA
cccacgcccggctacacccg

SEQ ID NO: 22220 - DNA, 20 bp, synthetic construct
  source 1..20: mol_type = other DNA
cacttggacaccgtgcaacc

SEQ ID NO: 22221 - DNA, 20 bp, synthetic construct
  source 1..20: mol_type = other DNA
gcccgcgccgccggacccgt

SEQ ID NO: 22222 - DNA, 20 bp, synthetic construct
  source 1..20: mol_type = other DNA
ctcgctgccaggcgcgtcag

SEQ ID NO: 22223 - DNA, 20 bp, synthetic construct
  source 1..20: mol_type = other DNA
gtcaccaatgaccgcgccta

SEQ ID NO: 22224 - DNA, 20 bp, synthetic construct
  source 1..20: mol_type = other DNA
gcgcaggctgcgcgcgcctg

SEQ ID NO: 22225 - DNA, 20 bp, synthetic construct
  source 1..20: mol_type = other DNA
gcggtcggcggcggcccacg

SEQ ID NO: 22226 - DNA, 20 bp, synthetic construct
  source 1..20: mol_type = other DNA
gcatcagtccaacgccctcg

SEQ ID NO: 22227 - DNA, 20 bp, synthetic construct
  source 1..20: mol_type = other DNA
gaccttcacctcgccttctc

SEQ ID NO: 22228 - DNA, 20 bp, synthetic construct
  source 1..20: mol_type = other DNA
gagatgcccggaacggaacg

SEQ ID NO: 22229 - DNA, 20 bp, synthetic construct
  source 1..20: mol_type = other DNA
gagcccgaggtcgatgcgtg

SEQ ID NO: 22230 - DNA, 20 bp, synthetic construct
  source 1..20: mol_type = other DNA
tgccgccgtttcgacccaga

SEQ ID NO: 22231 - DNA, 20 bp, synthetic construct
  source 1..20: mol_type = other DNA
ggcgcggtcttttaccgcgt

SEQ ID NO: 22232 - DNA, 20 bp, synthetic construct
  source 1..20: mol_type = other DNA
gccccccaggccttccttgc

SEQ ID NO: 22233 - DNA, 20 bp, synthetic construct
  source 1..20: mol_type = other DNA
cgaccgccgcccgcgacccc

SEQ ID NO: 22234 - DNA, 20 bp, synthetic construct
  source 1..20: mol_type = other DNA
agccccatgggacgcgcgac

SEQ ID NO: 22235 - DNA, 20 bp, synthetic construct
  source 1..20: mol_type = other DNA
cctggcggcagctactacaa

SEQ ID NO: 22236 - DNA, 20 bp, synthetic construct
  source 1..20: mol_type = other DNA
cctgtcataggctctcaggc

SEQ ID NO: 22237 - DNA, 20 bp, synthetic construct
  source 1..20: mol_type = other DNA
cgcacgttagcgccaccccg

SEQ ID NO: 22238 - DNA, 20 bp, synthetic construct
  source 1..20: mol_type = other DNA
cccccgccctaccaagtcag

SEQ ID NO: 22239 - DNA, 20 bp, synthetic construct
  source 1..20: mol_type = other DNA
ctgggcgccatttgcgccct

SEQ ID NO: 22240 - DNA, 20 bp, synthetic construct
  source 1..20: mol_type = other DNA
gttgctgagcgtcggagagg

SEQ ID NO: 22241 - DNA, 20 bp, synthetic construct
  source 1..20: mol_type = other DNA
ctcagcactgtcagggagaa

SEQ ID NO: 22242 - DNA, 20 bp, synthetic construct
  source 1..20: mol_type = other DNA
caaatgctttaagtgcggca

SEQ ID NO: 22243 - DNA, 20 bp, synthetic construct
  source 1..20: mol_type = other DNA
tccagcaaagaagctcctcc

SEQ ID NO: 22244 - DNA, 20 bp, synthetic construct
  source 1..20: mol_type = other DNA
tctcaatatgtaatgaacat

SEQ ID NO: 22245 - DNA, 20 bp, synthetic construct
  source 1..20: mol_type = other DNA
caccccagaaagaggatggc

SEQ ID NO: 22246 - DNA, 20 bp, synthetic construct
  source 1..20: mol_type = other DNA
gtggtgcacattcaaggaag

SEQ ID NO: 22247 - DNA, 20 bp, synthetic construct
  source 1..20: mol_type = other DNA
ggagaggacctttttcccct

SEQ ID NO: 22248 - DNA, 20 bp, synthetic construct
  source 1..20: mol_type = other DNA
aacaaacgatgaggccttgt

SEQ ID NO: 22249 - DNA, 20 bp, synthetic construct
  source 1..20: mol_type = other DNA
aaacatattgggatacttta

SEQ ID NO: 22250 - DNA, 20 bp, synthetic construct
  source 1..20: mol_type = other DNA
gtagatcagaaaatagaaca

SEQ ID NO: 22251 - DNA, 20 bp, synthetic construct
  source 1..20: mol_type = other DNA
ctgtctctaaaaaggtatat

SEQ ID NO: 22252 - DNA, 20 bp, synthetic construct
  source 1..20: mol_type = other DNA
ggttctggtcatggttctca

SEQ ID NO: 22253 - DNA, 20 bp, synthetic construct
  source 1..20: mol_type = other DNA
ggccagacaacggaggaggg

SEQ ID NO: 22254 - DNA, 20 bp, synthetic construct
  source 1..20: mol_type = other DNA
aagcgctagtgtcagcactt

SEQ ID NO: 22255 - DNA, 20 bp, synthetic construct
  source 1..20: mol_type = other DNA
tgggtgttcgctggttagcc

SEQ ID NO: 22256 - DNA, 20 bp, synthetic construct
  source 1..20: mol_type = other DNA
tggcttcatatagctcaata

SEQ ID NO: 22257 - DNA, 20 bp, synthetic construct
  source 1..20: mol_type = other DNA
cactggccagggcaacatat

SEQ ID NO: 22258 - DNA, 20 bp, synthetic construct
  source 1..20: mol_type = other DNA
cttttggattaatcctaggc

SEQ ID NO: 22259 - DNA, 20 bp, synthetic construct
  source 1..20: mol_type = other DNA
tcgagacagacaataaggta

SEQ ID NO: 22260 - DNA, 20 bp, synthetic construct
  source 1..20: mol_type = other DNA
aggatttgaacttaatggtc

SEQ ID NO: 22261 - DNA, 20 bp, synthetic construct
  source 1..20: mol_type = other DNA
ctctgaccccaattcccata

SEQ ID NO: 22262 - DNA, 20 bp, synthetic construct
  source 1..20: mol_type = other DNA
gatggccgcatatactctta

SEQ ID NO: 22263 - DNA, 20 bp, synthetic construct
  source 1..20: mol_type = other DNA
tgtcgcacaaattaaacaca

SEQ ID NO: 22264 - DNA, 20 bp, synthetic construct
  source 1..20: mol_type = other DNA
aaagataaaaaagggggaat

SEQ ID NO: 22265 - DNA, 20 bp, synthetic construct
  source 1..20: mol_type = other DNA
attagataatacatggcatg

SEQ ID NO: 22266 - DNA, 20 bp, synthetic construct
  source 1..20: mol_type = other DNA
tatcaacaatgtaacattgg

SEQ ID NO: 22267 - DNA, 20 bp, synthetic construct
  source 1..20: mol_type = other DNA
tttcatggattcctccctta

SEQ ID NO: 22268 - DNA, 20 bp, synthetic construct
  source 1..20: mol_type = other DNA
cctaagacaggcgcagcctc

SEQ ID NO: 22269 - DNA, 20 bp, synthetic construct
  source 1..20: mol_type = other DNA
tgtctcttgttcccttcaat

SEQ ID NO: 22270 - DNA, 20 bp, synthetic construct
  source 1..20: mol_type = other DNA
ctccgtcttactttcccgcc

SEQ ID NO: 22271 - DNA, 20 bp, synthetic construct
  source 1..20: mol_type = other DNA
tgtgcatcgtaagggctatg

SEQ ID NO: 22272 - DNA, 20 bp, synthetic construct
  source 1..20: mol_type = other DNA
ccattgatgtcaaaatgatg

SEQ ID NO: 22273 - DNA, 20 bp, synthetic construct
  source 1..20: mol_type = other DNA
gtccctgcaaagtgcccatt

SEQ ID NO: 22274 - DNA, 20 bp, synthetic construct
  source 1..20: mol_type = other DNA
agataaaccatcactggcac

SEQ ID NO: 22275 - DNA, 20 bp, synthetic construct
  source 1..20: mol_type = other DNA
ttagatcactctttggaggg

SEQ ID NO: 22276 - DNA, 20 bp, synthetic construct
  source 1..20: mol_type = other DNA
cgaagatcataggaaccgcc

SEQ ID NO: 22277 - DNA, 20 bp, synthetic construct
  source 1..20: mol_type = other DNA
gtgatctcatcatacccatc

SEQ ID NO: 22278 - DNA, 20 bp, synthetic construct
  source 1..20: mol_type = other DNA
ccgacatgattgatcctttt

SEQ ID NO: 22279 - DNA, 20 bp, synthetic construct
  source 1..20: mol_type = other DNA
tcggcgccgcgtttgctgaa

SEQ ID NO: 22280 - DNA, 20 bp, synthetic construct
  source 1..20: mol_type = other DNA
tgctactcatggttggagtt

SEQ ID NO: 22281 - DNA, 20 bp, synthetic construct
  source 1..20: mol_type = other DNA
gggagagtgatgctgaaatc

SEQ ID NO: 22282 - DNA, 20 bp, synthetic construct
  source 1..20: mol_type = other DNA
gcgccattgtgcaaggagag

SEQ ID NO: 22283 - DNA, 20 bp, synthetic construct
  source 1..20: mol_type = other DNA
tgctggcacccaccagggtc

SEQ ID NO: 22284 - DNA, 20 bp, synthetic construct
  source 1..20: mol_type = other DNA
aaacagagatcccagacaga

SEQ ID NO: 22285 - DNA, 20 bp, synthetic construct
  source 1..20: mol_type = other DNA
ccagcgctgctcagcggaga

SEQ ID NO: 22286 - DNA, 20 bp, synthetic construct
  source 1..20: mol_type = other DNA
tcttacttgatctgcggccg

SEQ ID NO: 22287 - DNA, 20 bp, synthetic construct
  source 1..20: mol_type = other DNA
cagtcaccctatgggagaat

SEQ ID NO: 22288 - DNA, 20 bp, synthetic construct
  source 1..20: mol_type = other DNA
aaaggcgtttcctcgagcca

SEQ ID NO: 22289 - DNA, 20 bp, synthetic construct
  source 1..20: mol_type = other DNA
ccatgaagagtggagtcgac

SEQ ID NO: 22290 - DNA, 20 bp, synthetic construct
  source 1..20: mol_type = other DNA
tgctatgcccttacatgccc

SEQ ID NO: 22291 - DNA, 20 bp, synthetic construct
  source 1..20: mol_type = other DNA
tcaaggaaaaggtggacaca

SEQ ID NO: 22292 - DNA, 20 bp, synthetic construct
  source 1..20: mol_type = other DNA
ttgaagaacagaaccaatgg

SEQ ID NO: 22293 - DNA, 20 bp, synthetic construct
  source 1..20: mol_type = other DNA
ggaaaactgtgatggacgtc

SEQ ID NO: 22294 - DNA, 20 bp, synthetic construct
  source 1..20: mol_type = other DNA
aggtcagaacctggctgttt

SEQ ID NO: 22295 - DNA, 20 bp, synthetic construct
  source 1..20: mol_type = other DNA
ggtatgactggcagcaggtt

SEQ ID NO: 22296 - DNA, 20 bp, synthetic construct
  source 1..20: mol_type = other DNA
acgcgcagatgtggctgctg

SEQ ID NO: 22297 - DNA, 20 bp, synthetic construct
  source 1..20: mol_type = other DNA
cttgtttgcctccatcgacc

SEQ ID NO: 22298 - DNA, 20 bp, synthetic construct
  source 1..20: mol_type = other DNA
tcggagatgcgtcgtgaaga

SEQ ID NO: 22299 - DNA, 20 bp, synthetic construct
  source 1..20: mol_type = other DNA
cggggggcaatggctgcgcg

SEQ ID NO: 22300 - DNA, 20 bp, synthetic construct
  source 1..20: mol_type = other DNA
taggtccaatgagattctag

SEQ ID NO: 22301 - DNA, 20 bp, synthetic construct
  source 1..20: mol_type = other DNA
caacacagcccttctggtca

SEQ ID NO: 22302 - DNA, 20 bp, synthetic construct
  source 1..20: mol_type = other DNA
tgaacgggtgtatgtaaatg

SEQ ID NO: 22303 - DNA, 20 bp, synthetic construct
  source 1..20: mol_type = other DNA
cgcccaggtaattggaccga

SEQ ID NO: 22304 - DNA, 20 bp, synthetic construct
  source 1..20: mol_type = other DNA
aactcgcctatttctgacga

SEQ ID NO: 22305 - DNA, 20 bp, synthetic construct
  source 1..20: mol_type = other DNA
gtcaaccgaaaatgatgacg

SEQ ID NO: 22306 - DNA, 20 bp, synthetic construct
  source 1..20: mol_type = other DNA
gctcatcgcaaccagcacta

SEQ ID NO: 22307 - DNA, 20 bp, synthetic construct
  source 1..20: mol_type = other DNA
ccccaccaccacggaagacc

SEQ ID NO: 22308 - DNA, 20 bp, synthetic construct
  source 1..20: mol_type = other DNA
cgggttctatggttttgggt

SEQ ID NO: 22309 - DNA, 20 bp, synthetic construct
  source 1..20: mol_type = other DNA
gcctccggggagattcaccc

SEQ ID NO: 22310 - DNA, 20 bp, synthetic construct
  source 1..20: mol_type = other DNA
caaacaagagtatcgaccac

SEQ ID NO: 22311 - DNA, 20 bp, synthetic construct
  source 1..20: mol_type = other DNA
gggagctacaatgttggact

SEQ ID NO: 22312 - DNA, 20 bp, synthetic construct
  source 1..20: mol_type = other DNA
ccttccctctggttttgcca

SEQ ID NO: 22313 - DNA, 20 bp, synthetic construct
  source 1..20: mol_type = other DNA
aatcactagtagagtgccac

SEQ ID NO: 22314 - DNA, 20 bp, synthetic construct
  source 1..20: mol_type = other DNA
agtagtcacatatgcgttga

SEQ ID NO: 22315 - DNA, 20 bp, synthetic construct
  source 1..20: mol_type = other DNA
aaccaattggttcccactag

SEQ ID NO: 22316 - DNA, 20 bp, synthetic construct
  source 1..20: mol_type = other DNA
catttagacgtgatcgaata

SEQ ID NO: 22317 - DNA, 20 bp, synthetic construct
  source 1..20: mol_type = other DNA
gtaagagaagcctgtaaaca

SEQ ID NO: 22318 - DNA, 20 bp, synthetic construct
  source 1..20: mol_type = other DNA
ataatagatgcaataaactc

SEQ ID NO: 22319 - DNA, 20 bp, synthetic construct
  source 1..20: mol_type = other DNA
agtatcattagtaattcagt

SEQ ID NO: 22320 - DNA, 20 bp, synthetic construct
  source 1..20: mol_type = other DNA
gcccgacatggggaatacgc

SEQ ID NO: 22321 - DNA, 20 bp, synthetic construct
  source 1..20: mol_type = other DNA
gcggcacatgatgcggaagt

SEQ ID NO: 22322 - DNA, 20 bp, synthetic construct
  source 1..20: mol_type = other DNA
cgtctcgctgcagaaattga

SEQ ID NO: 22323 - DNA, 20 bp, synthetic construct
  source 1..20: mol_type = other DNA
ttgtcgcctgatttcacaaa

SEQ ID NO: 22324 - DNA, 20 bp, synthetic construct
  source 1..20: mol_type = other DNA
ttgttactattgtgtgagac

SEQ ID NO: 22325 - DNA, 20 bp, synthetic construct
  source 1..20: mol_type = other DNA
gtaatttcaactggaagaac

SEQ ID NO: 22326 - DNA, 20 bp, synthetic construct
  source 1..20: mol_type = other DNA
tgccatgctttcactttaga

SEQ ID NO: 22327 - DNA, 20 bp, synthetic construct
  source 1..20: mol_type = other DNA
cttcctgatgatgcctggcg

SEQ ID NO: 22328 - DNA, 20 bp, synthetic construct
  source 1..20: mol_type = other DNA
caagttgtgctagcgtatgc

SEQ ID NO: 22329 - DNA, 20 bp, synthetic construct
  source 1..20: mol_type = other DNA
actgacgataatactccttc

SEQ ID NO: 22330 - DNA, 20 bp, synthetic construct
  source 1..20: mol_type = other DNA
tccttatcagtcttatctta

SEQ ID NO: 22331 - DNA, 20 bp, synthetic construct
  source 1..20: mol_type = other DNA
tccatcatattcaaggtcaa

SEQ ID NO: 22332 - DNA, 20 bp, synthetic construct
  source 1..20: mol_type = other DNA
agcatttcaccagtcctccc

SEQ ID NO: 22333 - DNA, 20 bp, synthetic construct
  source 1..20: mol_type = other DNA
tcaatagacatgctattgac

SEQ ID NO: 22334 - DNA, 20 bp, synthetic construct
  source 1..20: mol_type = other DNA
ctactgaaatcaacttggga

SEQ ID NO: 22335 - DNA, 20 bp, synthetic construct
  source 1..20: mol_type = other DNA
caagaattaatttacttttt

SEQ ID NO: 22336 - DNA, 20 bp, synthetic construct
  source 1..20: mol_type = other DNA
caccgactatatatcatgaa

SEQ ID NO: 22337 - DNA, 20 bp, synthetic construct
  source 1..20: mol_type = other DNA
tatttttaaggttccagtaa

SEQ ID NO: 22338 - DNA, 20 bp, synthetic construct
  source 1..20: mol_type = other DNA
tgtcagctgtatacaaacac

SEQ ID NO: 22339 - DNA, 20 bp, synthetic construct
  source 1..20: mol_type = other DNA
catgatggttgtcactgaga

SEQ ID NO: 22340 - DNA, 20 bp, synthetic construct
  source 1..20: mol_type = other DNA
attgaatgcggcacgagttg

SEQ ID NO: 22341 - DNA, 20 bp, synthetic construct
  source 1..20: mol_type = other DNA
ggaactgcgacttgaaggaa

SEQ ID NO: 22342 - DNA, 20 bp, synthetic construct
  source 1..20: mol_type = other DNA
catagttcatagatataatg

SEQ ID NO: 22343 - DNA, 20 bp, synthetic construct
  source 1..20: mol_type = other DNA
aatcaggaatttatcacata

SEQ ID NO: 22344 - DNA, 20 bp, synthetic construct
  source 1..20: mol_type = other DNA
ctcgaagataatcttaaatt

SEQ ID NO: 22345 - DNA, 20 bp, synthetic construct
  source 1..20: mol_type = other DNA
gaaaccatatagctcaaatg

SEQ ID NO: 22346 - DNA, 20 bp, synthetic construct
  source 1..20: mol_type = other DNA
cagaccctgtgatggatgtc

SEQ ID NO: 22347 - DNA, 20 bp, synthetic construct
  source 1..20: mol_type = other DNA
tgcccgtagtaccactcgac

SEQ ID NO: 22348 - DNA, 20 bp, synthetic construct
  source 1..20: mol_type = other DNA
cgggggaattgtgtgctgtt

SEQ ID NO: 22349 - DNA, 20 bp, synthetic construct
  source 1..20: mol_type = other DNA
ctgtcacttcccgagttggt

SEQ ID NO: 22350 - DNA, 20 bp, synthetic construct
  source 1..20: mol_type = other DNA
catacatgcgctttgatgca

SEQ ID NO: 22351 - DNA, 20 bp, synthetic construct
  source 1..20: mol_type = other DNA
ccattgccactgtggtagca

SEQ ID NO: 22352 - DNA, 20 bp, synthetic construct
  source 1..20: mol_type = other DNA
tgaccctggttactcttgat

SEQ ID NO: 22353 - DNA, 20 bp, synthetic construct
  source 1..20: mol_type = other DNA
gggtcaagcccaataaagag

SEQ ID NO: 22354 - DNA, 20 bp, synthetic construct
  source 1..20: mol_type = other DNA
tagggaacacactgcatgag

SEQ ID NO: 22355 - DNA, 20 bp, synthetic construct
  source 1..20: mol_type = other DNA
atgatgctagtctcagtcca

SEQ ID NO: 22356 - DNA, 20 bp, synthetic construct
  source 1..20: mol_type = other DNA
tgactatgactcctgcagac

SEQ ID NO: 22357 - DNA, 20 bp, synthetic construct
  source 1..20: mol_type = other DNA
aaaccttagagatcgttatc

SEQ ID NO: 22358 - DNA, 20 bp, synthetic construct
  source 1..20: mol_type = other DNA
tgagaagcctaattattgac

SEQ ID NO: 22359 - DNA, 20 bp, synthetic construct
  source 1..20: mol_type = other DNA
tgtttttcttttgattgcat

SEQ ID NO: 22360 - DNA, 20 bp, synthetic construct
  source 1..20: mol_type = other DNA
atcacacccacccaggtgag

SEQ ID NO: 22361 - DNA, 20 bp, synthetic construct
  source 1..20: mol_type = other DNA
ttttaccttatgtcaatgct

SEQ ID NO: 22362 - DNA, 20 bp, synthetic construct
  source 1..20: mol_type = other DNA
tcattcctgttaacaataca

SEQ ID NO: 22363 - DNA, 20 bp, synthetic construct
  source 1..20: mol_type = other DNA
atactaacctacacacacaa

SEQ ID NO: 22364 - DNA, 20 bp, synthetic construct
  source 1..20: mol_type = other DNA
ggaggtttcttaaagagaaa

SEQ ID NO: 22365 - DNA, 20 bp, synthetic construct
  source 1..20: mol_type = other DNA
gaattaagaatttatatatc

SEQ ID NO: 22366 - DNA, 20 bp, synthetic construct
  source 1..20: mol_type = other DNA
ctaagtgctgtccatttatc

SEQ ID NO: 22367 - DNA, 20 bp, synthetic construct
  source 1..20: mol_type = other DNA
cacctccagccatagctgac

SEQ ID NO: 22368 - DNA, 20 bp, synthetic construct
  source 1..20: mol_type = other DNA
gtcttggcatatatgaccaa

SEQ ID NO: 22369 - DNA, 20 bp, synthetic construct
  source 1..20: mol_type = other DNA
atgtttcatctaaaacccga

SEQ ID NO: 22370 - DNA, 20 bp, synthetic construct
  source 1..20: mol_type = other DNA
tactagatgcttataagaac

SEQ ID NO: 22371 - DNA, 20 bp, synthetic construct
  source 1..20: mol_type = other DNA
gtagacatgcataccaggaa

SEQ ID NO: 22372 - DNA, 20 bp, synthetic construct
  source 1..20: mol_type = other DNA
gtcataaaggtgatttcgtc

SEQ ID NO: 22373 - DNA, 20 bp, synthetic construct
  source 1..20: mol_type = other DNA
gccagagatatctataaaaa

SEQ ID NO: 22374 - DNA, 20 bp, synthetic construct
  source 1..20: mol_type = other DNA
ggtctctccaatatagaagt

SEQ ID NO: 22375 - DNA, 20 bp, synthetic construct
  source 1..20: mol_type = other DNA
gtgttgtttcaatctgagtg

SEQ ID NO: 22376 - DNA, 20 bp, synthetic construct
  source 1..20: mol_type = other DNA
accatggtatgtataggcgg

SEQ ID NO: 22377 - DNA, 20 bp, synthetic construct
  source 1..20: mol_type = other DNA
aacccagagtccaaatgcca

SEQ ID NO: 22378 - DNA, 20 bp, synthetic construct
  source 1..20: mol_type = other DNA
tggttggcttgcaaaaacgt

SEQ ID NO: 22379 - DNA, 20 bp, synthetic construct
  source 1..20: mol_type = other DNA
agagtgtggtgaccagggtt

SEQ ID NO: 22380 - DNA, 20 bp, synthetic construct
  source 1..20: mol_type = other DNA
cttggcaggtccatagggac

SEQ ID NO: 22381 - DNA, 20 bp, synthetic construct
  source 1..20: mol_type = other DNA
gggttcctgtggcacacatt

SEQ ID NO: 22382 - DNA, 20 bp, synthetic construct
  source 1..20: mol_type = other DNA
ctttcaacagcatcttcggg

SEQ ID NO: 22383 - DNA, 20 bp, synthetic construct
  source 1..20: mol_type = other DNA
tggactcagagttattcctt

SEQ ID NO: 22384 - DNA, 20 bp, synthetic construct
  source 1..20: mol_type = other DNA
gagcatctgtgaggagtacc

SEQ ID NO: 22385 - DNA, 20 bp, synthetic construct
  source 1..20: mol_type = other DNA
tggtggcagtggggatcaca

SEQ ID NO: 22386 - DNA, 20 bp, synthetic construct
  source 1..20: mol_type = other DNA
tcctaagtgtagcttcggca

SEQ ID NO: 22387 - DNA, 20 bp, synthetic construct
  source 1..20: mol_type = other DNA
gtgtcttgcacacgatgtgg

SEQ ID NO: 22388 - DNA, 20 bp, synthetic construct
  source 1..20: mol_type = other DNA
gcctgagaacgttggtgttg

SEQ ID NO: 22389 - DNA, 20 bp, synthetic construct
  source 1..20: mol_type = other DNA
agggaagacaaaattgggag

SEQ ID NO: 22390 - DNA, 20 bp, synthetic construct
  source 1..20: mol_type = other DNA
ccattactagtgaggaaaga

SEQ ID NO: 22391 - DNA, 20 bp, synthetic construct
  source 1..20: mol_type = other DNA
cctttgaaaaggactactcc

SEQ ID NO: 22392 - DNA, 20 bp, synthetic construct
  source 1..20: mol_type = other DNA
ccctgggtgtcatctggtgc

SEQ ID NO: 22393 - DNA, 20 bp, synthetic construct
  source 1..20: mol_type = other DNA
cgggaaaacagagaagcagt

SEQ ID NO: 22394 - DNA, 20 bp, synthetic construct
  source 1..20: mol_type = other DNA
cgaatgtggacatccagcca

SEQ ID NO: 22395 - DNA, 20 bp, synthetic construct
  source 1..20: mol_type = other DNA
gtgtggcgggacatgtcatg

SEQ ID NO: 22396 - DNA, 20 bp, synthetic construct
  source 1..20: mol_type = other DNA
gatcaggaatggacgtgttc

SEQ ID NO: 22397 - DNA, 20 bp, synthetic construct
  source 1..20: mol_type = other DNA
aaaacagatgggcaagtgca

SEQ ID NO: 22398 - DNA, 20 bp, synthetic construct
  source 1..20: mol_type = other DNA
tcatggatgtcatcacaaga

SEQ ID NO: 22399 - DNA, 20 bp, synthetic construct
  source 1..20: mol_type = other DNA
tacccttttgttcacaccat

SEQ ID NO: 22400 - DNA, 20 bp, synthetic construct
  source 1..20: mol_type = other DNA
agccccagaaaccgacgcct

SEQ ID NO: 22401 - DNA, 20 bp, synthetic construct
  source 1..20: mol_type = other DNA
tacagtcacttgcgtgtggg

SEQ ID NO: 22402 - DNA, 20 bp, synthetic construct
  source 1..20: mol_type = other DNA
cgtgacgtgtgttctggacc

SEQ ID NO: 22403 - DNA, 20 bp, synthetic construct
  source 1..20: mol_type = other DNA
ggggcccctgggcaaccagg

SEQ ID NO: 22404 - DNA, 20 bp, synthetic construct
  source 1..20: mol_type = other DNA
tttcccgctggccctcttga

SEQ ID NO: 22405 - DNA, 20 bp, synthetic construct
  source 1..20: mol_type = other DNA
gtggaggcacaaagccgtga

SEQ ID NO: 22406 - DNA, 20 bp, synthetic construct
  source 1..20: mol_type = other DNA
tgaggttctcatcggcgtct

SEQ ID NO: 22407 - DNA, 20 bp, synthetic construct
  source 1..20: mol_type = other DNA
tacgtcgcgaagcatgggaa

SEQ ID NO: 22408 - DNA, 20 bp, synthetic construct
  source 1..20: mol_type = other DNA
tgggaggtttttggccaacc

SEQ ID NO: 22409 - DNA, 20 bp, synthetic construct
  source 1..20: mol_type = other DNA
ccctatgacgcagcaccctt

SEQ ID NO: 22410 - DNA, 20 bp, synthetic construct
  source 1..20: mol_type = other DNA
tgccattgcctattataggg

SEQ ID NO: 22411 - DNA, 20 bp, synthetic construct
  source 1..20: mol_type = other DNA
gggtgttcagcggaccatgt

SEQ ID NO: 22412 - DNA, 20 bp, synthetic construct
  source 1..20: mol_type = other DNA
ctacacagcaaccgccaagt

SEQ ID NO: 22413 - DNA, 20 bp, synthetic construct
  source 1..20: mol_type = other DNA
taacaactctggcactacca

SEQ ID NO: 22414 - DNA, 20 bp, synthetic construct
  source 1..20: mol_type = other DNA
ggtggatgaggtacaggtgg

SEQ ID NO: 22415 - DNA, 20 bp, synthetic construct
  source 1..20: mol_type = other DNA
tgagaagaccccgtcggtgt

SEQ ID NO: 22416 - DNA, 20 bp, synthetic construct
  source 1..20: mol_type = other DNA
gatgtcgtgctgcgttgaaa

SEQ ID NO: 22417 - DNA, 20 bp, synthetic construct
  source 1..20: mol_type = other DNA
tgaatgtgacaagtgtgagg

SEQ ID NO: 22418 - DNA, 20 bp, synthetic construct
  source 1..20: mol_type = other DNA
acggagggtggacaaggtga

SEQ ID NO: 22419 - DNA, 20 bp, synthetic construct
  source 1..20: mol_type = other DNA
ggtgtcggttaaggacttag

SEQ ID NO: 22420 - DNA, 20 bp, synthetic construct
  source 1..20: mol_type = other DNA
gtgcgagccctcatatcatg

SEQ ID NO: 22421 - DNA, 20 bp, synthetic construct
  source 1..20: mol_type = other DNA
cctcctttatccttggcacc

SEQ ID NO: 22422 - DNA, 20 bp, synthetic construct
  source 1..20: mol_type = other DNA
agcagcgttgagggttaccg

SEQ ID NO: 22423 - DNA, 20 bp, synthetic construct
  source 1..20: mol_type = other DNA
tccaggcctacggcttcctc

SEQ ID NO: 22424 - DNA, 20 bp, synthetic construct
  source 1..20: mol_type = other DNA
catctgttgcggcaaggtct

SEQ ID NO: 22425 - DNA, 20 bp, synthetic construct
  source 1..20: mol_type = other DNA
ctgcggagaggctggcagat

SEQ ID NO: 22426 - DNA, 20 bp, synthetic construct
  source 1..20: mol_type = other DNA
tgtgtgttcccatctctcct

SEQ ID NO: 22427 - DNA, 20 bp, synthetic construct
  source 1..20: mol_type = other DNA
agtgaaggcagtaagggcgg

SEQ ID NO: 22428 - DNA, 20 bp, synthetic construct
  source 1..20: mol_type = other DNA
gaaactggaactgcagagaa

SEQ ID NO: 22429 - DNA, 20 bp, synthetic construct
  source 1..20: mol_type = other DNA
gaagtagtgccaggatttca

SEQ ID NO: 22430 - DNA, 20 bp, synthetic construct
  source 1..20: mol_type = other DNA
cccaccctagaagagatgct

SEQ ID NO: 22431 - DNA, 20 bp, synthetic construct
  source 1..20: mol_type = other DNA
cctccggcagatccagcagc

SEQ ID NO: 22432 - DNA, 20 bp, synthetic construct
  source 1..20: mol_type = other DNA
tagtaggagatcctatacca

SEQ ID NO: 22433 - DNA, 20 bp, synthetic construct
  source 1..20: mol_type = other DNA
gccaacagaaaggagaagcc

SEQ ID NO: 22434 - DNA, 20 bp, synthetic construct
  source 1..20: mol_type = other DNA
tattaaaactggccagtagg

SEQ ID NO: 22435 - DNA, 20 bp, synthetic construct
  source 1..20: mol_type = other DNA
attcaaattttaaaaatttc

SEQ ID NO: 22436 - DNA, 20 bp, synthetic construct
  source 1..20: mol_type = other DNA
aggaactggatagtagtccc

SEQ ID NO: 22437 - DNA, 20 bp, synthetic construct
  source 1..20: mol_type = other DNA
gaagtaagaagagccatcag

SEQ ID NO: 22438 - DNA, 20 bp, synthetic construct
  source 1..20: mol_type = other DNA
ggccttcgagtggctagaga

SEQ ID NO: 22439 - DNA, 20 bp, synthetic construct
  source 1..20: mol_type = other DNA
tatatttacacatttcaaga

SEQ ID NO: 22440 - DNA, 20 bp, synthetic construct
  source 1..20: mol_type = other DNA
tgggtaatagaaactctgag

SEQ ID NO: 22441 - DNA, 20 bp, synthetic construct
  source 1..20: mol_type = other DNA
gactccaaggaaaactaaga

SEQ ID NO: 22442 - DNA, 20 bp, synthetic construct
  source 1..20: mol_type = other DNA
ccatgtgtcaagctaacacc

SEQ ID NO: 22443 - DNA, 20 bp, synthetic construct
  source 1..20: mol_type = other DNA
ttagggtatgaggagatgat

SEQ ID NO: 22444 - DNA, 20 bp, synthetic construct
  source 1..20: mol_type = other DNA
aagcactattgggatgctat

SEQ ID NO: 22445 - DNA, 20 bp, synthetic construct
  source 1..20: mol_type = other DNA
gtgcatatagtagtgggaat

SEQ ID NO: 22446 - DNA, 20 bp, synthetic construct
  source 1..20: mol_type = other DNA
tttccagaaggggctgtaac

SEQ ID NO: 22447 - DNA, 20 bp, synthetic construct
  source 1..20: mol_type = other DNA
cagtaccatattggcggcag

SEQ ID NO: 22448 - DNA, 20 bp, synthetic construct
  source 1..20: mol_type = other DNA
gccctgatttgaaacagatt

SEQ ID NO: 22449 - DNA, 20 bp, synthetic construct
  source 1..20: mol_type = other DNA
aaccatcccaaccctctcag

SEQ ID NO: 22450 - DNA, 20 bp, synthetic construct
  source 1..20: mol_type = other DNA
ctaagttaagacaaggaccc

SEQ ID NO: 22451 - DNA, 20 bp, synthetic construct
  source 1..20: mol_type = other DNA
tgtcattaacatcccttcaa

SEQ ID NO: 22452 - DNA, 20 bp, synthetic construct
  source 1..20: mol_type = other DNA
gactggcctcctgtaaaaca

SEQ ID NO: 22453 - DNA, 20 bp, synthetic construct
  source 1..20: mol_type = other DNA
agcaccagtgccgacctcat

SEQ ID NO: 22454 - DNA, 20 bp, synthetic construct
  source 1..20: mol_type = other DNA
tcagcaaccagaatatccta

SEQ ID NO: 22455 - DNA, 20 bp, synthetic construct
  source 1..20: mol_type = other DNA
acatgtcagtcatagcacct

SEQ ID NO: 22456 - DNA, 20 bp, synthetic construct
  source 1..20: mol_type = other DNA
tgaaaacatggataatgaat

SEQ ID NO: 22457 - DNA, 20 bp, synthetic construct
  source 1..20: mol_type = other DNA
tcacaaccatggttgatgtg

SEQ ID NO: 22458 - DNA, 20 bp, synthetic construct
  source 1..20: mol_type = other DNA
aagcagaagcccactcacac

SEQ ID NO: 22459 - DNA, 20 bp, synthetic construct
  source 1..20: mol_type = other DNA
tggcatctccatatgtgtgg

SEQ ID NO: 22460 - DNA, 20 bp, synthetic construct
  source 1..20: mol_type = other DNA
ggaacctatgtagccagtag

SEQ ID NO: 22461 - DNA, 20 bp, synthetic construct
  source 1..20: mol_type = other DNA
gaatggaaaatagcaactag

SEQ ID NO: 22462 - DNA, 20 bp, synthetic construct
  source 1..20: mol_type = other DNA
caacgaaggggacttaaccc

SEQ ID NO: 22463 - DNA, 20 bp, synthetic construct
  source 1..20: mol_type = other DNA
cttttacgggaatatcagaa

SEQ ID NO: 22464 - DNA, 20 bp, synthetic construct
  source 1..20: mol_type = other DNA
aacagatggaaggatttaca

SEQ ID NO: 22465 - DNA, 20 bp, synthetic construct
  source 1..20: mol_type = other DNA
aaaggcactaatactaccct

SEQ ID NO: 22466 - DNA, 20 bp, synthetic construct
  source 1..20: mol_type = other DNA
tatgtaagtggacgaaattg

SEQ ID NO: 22467 - DNA, 20 bp, synthetic construct
  source 1..20: mol_type = other DNA
atttgcttgggggggaacac

SEQ ID NO: 22468 - DNA, 20 bp, synthetic construct
  source 1..20: mol_type = other DNA
ccaagtaacaactgtattta

SEQ ID NO: 22469 - DNA, 20 bp, synthetic construct
  source 1..20: mol_type = other DNA
cttttccattgtatgaacta

SEQ ID NO: 22470 - DNA, 20 bp, synthetic construct
  source 1..20: mol_type = other DNA
tagttaatataaaaactcat

SEQ ID NO: 22471 - DNA, 20 bp, synthetic construct
  source 1..20: mol_type = other DNA
tttatcaatcatggcgggtt

SEQ ID NO: 22472 - DNA, 20 bp, synthetic construct
  source 1..20: mol_type = other DNA
acttcagctcgcgatggaat

SEQ ID NO: 22473 - DNA, 20 bp, synthetic construct
  source 1..20: mol_type = other DNA
ccaacttccaaaaaattgag

SEQ ID NO: 22474 - DNA, 20 bp, synthetic construct
  source 1..20: mol_type = other DNA
tggggtaaatagacattagt

SEQ ID NO: 22475 - DNA, 20 bp, synthetic construct
  source 1..20: mol_type = other DNA
gggatactctcaatcatcta

SEQ ID NO: 22476 - DNA, 20 bp, synthetic construct
  source 1..20: mol_type = other DNA
cagttcaaacaataaaaaac

SEQ ID NO: 22477 - DNA, 20 bp, synthetic construct
  source 1..20: mol_type = other DNA
ccactgtgctcgacacaacc

SEQ ID NO: 22478 - DNA, 20 bp, synthetic construct
  source 1..20: mol_type = other DNA
tagcagaaaaccgtgaccta

SEQ ID NO: 22479 - DNA, 20 bp, synthetic construct
  source 1..20: mol_type = other DNA
atatcatccatattgatttc

SEQ ID NO: 22480 - DNA, 20 bp, synthetic construct
  source 1..20: mol_type = other DNA
tcagaatctttggacatcca

SEQ ID NO: 22481 - DNA, 20 bp, synthetic construct
  source 1..20: mol_type = other DNA
gcagtgatgtattagatgaa

SEQ ID NO: 22482 - DNA, 20 bp, synthetic construct
  source 1..20: mol_type = other DNA
tgggtggtattgagggctgg

SEQ ID NO: 22483 - DNA, 20 bp, synthetic construct
  source 1..20: mol_type = other DNA
cagattatttgttagcatta

SEQ ID NO: 22484 - DNA, 20 bp, synthetic construct
  source 1..20: mol_type = other DNA
actgggtatatgcatccata

SEQ ID NO: 22485 - DNA, 20 bp, synthetic construct
  source 1..20: mol_type = other DNA
aacgaatcaggacgaaatag

SEQ ID NO: 22486 - DNA, 20 bp, synthetic construct
  source 1..20: mol_type = other DNA
ttgatggaaagcgatgctaa

SEQ ID NO: 22487 - DNA, 20 bp, synthetic construct
  source 1..20: mol_type = other DNA
caagaagatgacaaaagaat

SEQ ID NO: 22488 - DNA, 20 bp, synthetic construct
  source 1..20: mol_type = other DNA
aaacattgcaaaaatgatga

SEQ ID NO: 22489 - DNA, 20 bp, synthetic construct
  source 1..20: mol_type = other DNA
taaatacactgggaatgacc

SEQ ID NO: 22490 - DNA, 20 bp, synthetic construct
  source 1..20: mol_type = other DNA
ggttcagactgattccaaag

SEQ ID NO: 22491 - DNA, 20 bp, synthetic construct
  source 1..20: mol_type = other DNA
gtagattccatatcatataa

SEQ ID NO: 22492 - DNA, 20 bp, synthetic construct
  source 1..20: mol_type = other DNA
ctactaggtaacaagatcta

SEQ ID NO: 22493 - DNA, 20 bp, synthetic construct
  source 1..20: mol_type = other DNA
gtatatgataagtaatcagc

SEQ ID NO: 22494 - DNA, 20 bp, synthetic construct
  source 1..20: mol_type = other DNA
ccagaagaatttcttattga

SEQ ID NO: 22495 - DNA, 20 bp, synthetic construct
  source 1..20: mol_type = other DNA
gatatttgaatctggagaat

SEQ ID NO: 22496 - DNA, 20 bp, synthetic construct
  source 1..20: mol_type = other DNA
tggaatgttagatacgacaa

SEQ ID NO: 22497 - DNA, 20 bp, synthetic construct
  source 1..20: mol_type = other DNA
agtcagcagattcataacaa

SEQ ID NO: 22498 - DNA, 20 bp, synthetic construct
  source 1..20: mol_type = other DNA
atttaagaggttctgggatt

SEQ ID NO: 22499 - DNA, 20 bp, synthetic construct
  source 1..20: mol_type = other DNA
cactccgaattggtctagaa

SEQ ID NO: 22500 - DNA, 20 bp, synthetic construct
  source 1..20: mol_type = other DNA
agaatttttatcaactccag

SEQ ID NO: 22501 - DNA, 20 bp, synthetic construct
  source 1..20: mol_type = other DNA
tagagagtgtataggatcaa

SEQ ID NO: 22502 - DNA, 20 bp, synthetic construct
  source 1..20: mol_type = other DNA
gggacatcaagcagccatgc

SEQ ID NO: 22503 - DNA, 20 bp, synthetic construct
  source 1..20: mol_type = other DNA
aatgagccaagtaacaaatt

SEQ ID NO: 22504 - DNA, 20 bp, synthetic construct
  source 1..20: mol_type = other DNA
agattgtactgagagacagg

SEQ ID NO: 22505 - DNA, 20 bp, synthetic construct
  source 1..20: mol_type = other DNA
ttaaagccaggaatggatgg

SEQ ID NO: 22506 - DNA, 20 bp, synthetic construct
  source 1..20: mol_type = other DNA
gcatgggtaccagcacacaa

SEQ ID NO: 22507 - DNA, 20 bp, synthetic construct
  source 1..20: mol_type = other DNA
aagttcagaagtacacatcc

SEQ ID NO: 22508 - DNA, 20 bp, synthetic construct
  source 1..20: mol_type = other DNA
gaaactgacagaggatagat

SEQ ID NO: 22509 - DNA, 20 bp, synthetic construct
  source 1..20: mol_type = other DNA
ctgcttgtaccaattgctat

SEQ ID NO: 22510 - DNA, 20 bp, synthetic construct
  source 1..20: mol_type = other DNA
cttgatataataccaataga

SEQ ID NO: 22511 - DNA, 20 bp, synthetic construct
  source 1..20: mol_type = other DNA
tttggaaataataaaacaat

SEQ ID NO: 22512 - DNA, 20 bp, synthetic construct
  source 1..20: mol_type = other DNA
agtgacacaatcaccctccc

SEQ ID NO: 22513 - DNA, 20 bp, synthetic construct
  source 1..20: mol_type = other DNA
ggaagcactatgggcgcagc

SEQ ID NO: 22514 - DNA, 20 bp, synthetic construct
  source 1..20: mol_type = other DNA
gtactttctatagtgaatag

SEQ ID NO: 22515 - DNA, 20 bp, synthetic construct
  source 1..20: mol_type = other DNA
gatctgcggagcctgtgcct

SEQ ID NO: 22516 - DNA, 20 bp, synthetic construct
  source 1..20: mol_type = other DNA
tcatcacgtggcccgagagc

SEQ ID NO: 22517 - DNA, 20 bp, synthetic construct
  source 1..20: mol_type = other DNA
acagatttatatacttgata

SEQ ID NO: 22518 - DNA, 20 bp, synthetic construct
  source 1..20: mol_type = other DNA
cctaggcataatgggagaat

SEQ ID NO: 22519 - DNA, 20 bp, synthetic construct
  source 1..20: mol_type = other DNA
ttccaatcatccatgccagc

SEQ ID NO: 22520 - DNA, 20 bp, synthetic construct
  source 1..20: mol_type = other DNA
atactgaacaaactctgtga

SEQ ID NO: 22521 - DNA, 20 bp, synthetic construct
  source 1..20: mol_type = other DNA
cagcaagcccaccacaaaac

SEQ ID NO: 22522 - DNA, 20 bp, synthetic construct
  source 1..20: mol_type = other DNA
gagaactaccaaggtttatg

SEQ ID NO: 22523 - DNA, 20 bp, synthetic construct
  source 1..20: mol_type = other DNA
attatgtaaataagcaagaa

SEQ ID NO: 22524 - DNA, 20 bp, synthetic construct
  source 1..20: mol_type = other DNA
tttaatttatacacaaaatt

SEQ ID NO: 22525 - DNA, 20 bp, synthetic construct
  source 1..20: mol_type = other DNA
tataatcaattcttgacatg

SEQ ID NO: 22526 - DNA, 20 bp, synthetic construct
  source 1..20: mol_type = other DNA
aaactaaacacttatccttc

SEQ ID NO: 22527 - DNA, 20 bp, synthetic construct
  source 1..20: mol_type = other DNA
gaagctatatcactattgga

SEQ ID NO: 22528 - DNA, 20 bp, synthetic construct
  source 1..20: mol_type = other DNA
ctcttgtgttttcataaagg

SEQ ID NO: 22529 - DNA, 20 bp, synthetic construct
  source 1..20: mol_type = other DNA
gttgtgattgataaaattat

SEQ ID NO: 22530 - DNA, 20 bp, synthetic construct
  source 1..20: mol_type = other DNA
tttttaaggctgtacaatgg

SEQ ID NO: 22531 - DNA, 20 bp, synthetic construct
  source 1..20: mol_type = other DNA
tacttagtccttacaatagg

SEQ ID NO: 22532 - DNA, 20 bp, synthetic construct
  source 1..20: mol_type = other DNA
aaaaaaggaattaatactgc

SEQ ID NO: 22533 - DNA, 20 bp, synthetic construct
  source 1..20: mol_type = other DNA
ttggcttgcaaaggcgcgga

SEQ ID NO: 22534 - DNA, 20 bp, synthetic construct
  source 1..20: mol_type = other DNA
tcaacagcatctttggagga

SEQ ID NO: 22535 - DNA, 20 bp, synthetic construct
  source 1..20: mol_type = other DNA
tgatctggagtatccctgag

SEQ ID NO: 22536 - DNA, 20 bp, synthetic construct
  source 1..20: mol_type = other DNA
caggagtgatgggggccgcc

SEQ ID NO: 22537 - DNA, 20 bp, synthetic construct
  source 1..20: mol_type = other DNA
tggcggtggggattgcgttc

SEQ ID NO: 22538 - DNA, 20 bp, synthetic construct
  source 1..20: mol_type = other DNA
cactcacagaaataatgagg

SEQ ID NO: 22539 - DNA, 20 bp, synthetic construct
  source 1..20: mol_type = other DNA
gggcgcacgaggtgcaccag

SEQ ID NO: 22540 - DNA, 20 bp, synthetic construct
  source 1..20: mol_type = other DNA
tcagcagcatcgctcaggga

SEQ ID NO: 22541 - DNA, 20 bp, synthetic construct
  source 1..20: mol_type = other DNA
tgagtacgttggtgctggct

SEQ ID NO: 22542 - DNA, 20 bp, synthetic construct
  source 1..20: mol_type = other DNA
gccctgagcaggacaagatg

SEQ ID NO: 22543 - DNA, 20 bp, synthetic construct
  source 1..20: mol_type = other DNA
tgggtgtcgtctggtgtttc

SEQ ID NO: 22544 - DNA, 20 bp, synthetic construct
  source 1..20: mol_type = other DNA
tggcaggacatgttatgact

SEQ ID NO: 22545 - DNA, 20 bp, synthetic construct
  source 1..20: mol_type = other DNA
ggaagcgcaggctgaacaac

SEQ ID NO: 22546 - DNA, 20 bp, synthetic construct
  source 1..20: mol_type = other DNA
atcgcaccctcaagggagag

SEQ ID NO: 22547 - DNA, 20 bp, synthetic construct
  source 1..20: mol_type = other DNA
ctccataccgcccagaggta

SEQ ID NO: 22548 - DNA, 20 bp, synthetic construct
  source 1..20: mol_type = other DNA
ttgacacaaaagcacaggag

SEQ ID NO: 22549 - DNA, 20 bp, synthetic construct
  source 1..20: mol_type = other DNA
tcgaaagcacagtgcccctc

SEQ ID NO: 22550 - DNA, 20 bp, synthetic construct
  source 1..20: mol_type = other DNA
acccctgccctctcgcatta

SEQ ID NO: 22551 - DNA, 20 bp, synthetic construct
  source 1..20: mol_type = other DNA
cctccaacagccctcggctc

SEQ ID NO: 22552 - DNA, 20 bp, synthetic construct
  source 1..20: mol_type = other DNA
gagtccccagttcatgcaaa

SEQ ID NO: 22553 - DNA, 20 bp, synthetic construct
  source 1..20: mol_type = other DNA
caaggacaaagcccgggtcc

SEQ ID NO: 22554 - DNA, 20 bp, synthetic construct
  source 1..20: mol_type = other DNA
gtctccattgcaggcgcccc

SEQ ID NO: 22555 - DNA, 20 bp, synthetic construct
  source 1..20: mol_type = other DNA
tgcgtctacctacccttccg

SEQ ID NO: 22556 - DNA, 20 bp, synthetic construct
  source 1..20: mol_type = other DNA
cctccccgattattacccgt

SEQ ID NO: 22557 - DNA, 20 bp, synthetic construct
  source 1..20: mol_type = other DNA
accccgtctttccagtcaaa

SEQ ID NO: 22558 - DNA, 20 bp, synthetic construct
  source 1..20: mol_type = other DNA
tccaaatcccccttccaaaa

SEQ ID NO: 22559 - DNA, 20 bp, synthetic construct
  source 1..20: mol_type = other DNA
ccttccctatgtctactatc

SEQ ID NO: 22560 - DNA, 20 bp, synthetic construct
  source 1..20: mol_type = other DNA
aagttatatctcccaaccat

SEQ ID NO: 22561 - DNA, 20 bp, synthetic construct
  source 1..20: mol_type = other DNA
gatggcccctggtttggctg

SEQ ID NO: 22562 - DNA, 20 bp, synthetic construct
  source 1..20: mol_type = other DNA
tctccactcttaacgaatac

SEQ ID NO: 22563 - DNA, 20 bp, synthetic construct
  source 1..20: mol_type = other DNA
ctgaaactgtcagcgccctc

SEQ ID NO: 22564 - DNA, 20 bp, synthetic construct
  source 1..20: mol_type = other DNA
aaaggaccaatggcattgtt

SEQ ID NO: 22565 - DNA, 20 bp, synthetic construct
  source 1..20: mol_type = other DNA
tgcagtcttgcccaacctat

SEQ ID NO: 22566 - DNA, 20 bp, synthetic construct
  source 1..20: mol_type = other DNA
tgtggctcttctatgaccct

SEQ ID NO: 22567 - DNA, 20 bp, synthetic construct
  source 1..20: mol_type = other DNA
caactaactctacaaagtac

SEQ ID NO: 22568 - DNA, 20 bp, synthetic construct
  source 1..20: mol_type = other DNA
tggtctcactgttaccagcc

SEQ ID NO: 22569 - DNA, 20 bp, synthetic construct
  source 1..20: mol_type = other DNA
gcagggggaataaccggatc

SEQ ID NO: 22570 - DNA, 20 bp, synthetic construct
  source 1..20: mol_type = other DNA
acaatacccttcaaacccca

SEQ ID NO: 22571 - DNA, 20 bp, synthetic construct
  source 1..20: mol_type = other DNA
gcgaccatcccgtacatcct

SEQ ID NO: 22572 - DNA, 20 bp, synthetic construct
  source 1..20: mol_type = other DNA
tccaggtttcggacagagcc

SEQ ID NO: 22573 - DNA, 20 bp, synthetic construct
  source 1..20: mol_type = other DNA
cgttgtcggctctcctctcc

SEQ ID NO: 22574 - DNA, 20 bp, synthetic construct
  source 1..20: mol_type = other DNA
atacccaactctcggagacc

SEQ ID NO: 22575 - DNA, 20 bp, synthetic construct
  source 1..20: mol_type = other DNA
ctaccactctctcataacta

SEQ ID NO: 22576 - DNA, 20 bp, synthetic construct
  source 1..20: mol_type = other DNA
taggtagaatattgttttca

SEQ ID NO: 22577 - DNA, 20 bp, synthetic construct
  source 1..20: mol_type = other DNA
tgtcgtctccccctaagcaa

SEQ ID NO: 22578 - DNA, 20 bp, synthetic construct
  source 1..20: mol_type = other DNA
aagtaaagtatgattttgat

SEQ ID NO: 22579 - DNA, 20 bp, synthetic construct
  source 1..20: mol_type = other DNA
ctggacccgttcaatcgcgc

SEQ ID NO: 22580 - DNA, 20 bp, synthetic construct
  source 1..20: mol_type = other DNA
ccgcaaatcgtgttgaacaa

SEQ ID NO: 22581 - DNA, 20 bp, synthetic construct
  source 1..20: mol_type = other DNA
gtttatggttggtaggtgaa

SEQ ID NO: 22582 - DNA, 20 bp, synthetic construct
  source 1..20: mol_type = other DNA
aggttggaatttgggccgaa

SEQ ID NO: 22583 - DNA, 20 bp, synthetic construct
  source 1..20: mol_type = other DNA
ggaagttgtctgttcctaca

SEQ ID NO: 22584 - DNA, 20 bp, synthetic construct
  source 1..20: mol_type = other DNA
ttggtgaagaatttgatttt

SEQ ID NO: 22585 - DNA, 20 bp, synthetic construct
  source 1..20: mol_type = other DNA
gggactttggaaatttcgat

SEQ ID NO: 22586 - DNA, 20 bp, synthetic construct
  source 1..20: mol_type = other DNA
aatttcgttttagcccagaa

SEQ ID NO: 22587 - DNA, 20 bp, synthetic construct
  source 1..20: mol_type = other DNA
tgatggcgctgatacatcac

SEQ ID NO: 22588 - DNA, 20 bp, synthetic construct
  source 1..20: mol_type = other DNA
tagttttattccattttatt

SEQ ID NO: 22589 - DNA, 20 bp, synthetic construct
  source 1..20: mol_type = other DNA
tggtgttcatccaatgacta

SEQ ID NO: 22590 - DNA, 20 bp, synthetic construct
  source 1..20: mol_type = other DNA
gccctgcttacacgggtatt

SEQ ID NO: 22591 - DNA, 20 bp, synthetic construct
  source 1..20: mol_type = other DNA
ggtggtaagggtacgtctat

SEQ ID NO: 22592 - DNA, 20 bp, synthetic construct
  source 1..20: mol_type = other DNA
gagttgctacgcggcctggc

SEQ ID NO: 22593 - DNA, 20 bp, synthetic construct
  source 1..20: mol_type = other DNA
gtgctctttgcaccttctat

SEQ ID NO: 22594 - DNA, 20 bp, synthetic construct
  source 1..20: mol_type = other DNA
gttattggcacgcccttcag

SEQ ID NO: 22595 - DNA, 20 bp, synthetic construct
  source 1..20: mol_type = other DNA
gtgattcagtcagtaacgcc

SEQ ID NO: 22596 - DNA, 20 bp, synthetic construct
  source 1..20: mol_type = other DNA
cttacctaccgaccgtggag

SEQ ID NO: 22597 - DNA, 20 bp, synthetic construct
  source 1..20: mol_type = other DNA
caagaggtgcgctgccccta

SEQ ID NO: 22598 - DNA, 20 bp, synthetic construct
  source 1..20: mol_type = other DNA
tgacccacggtggcaaggag

SEQ ID NO: 22599 - DNA, 20 bp, synthetic construct
  source 1..20: mol_type = other DNA
tattcctgtttgagcacgct

SEQ ID NO: 22600 - DNA, 20 bp, synthetic construct
  source 1..20: mol_type = other DNA
gtaggggagacgaagtgctc

SEQ ID NO: 22601 - DNA, 20 bp, synthetic construct
  source 1..20: mol_type = other DNA
tggaaccttgcaaatgctca

SEQ ID NO: 22602 - DNA, 20 bp, synthetic construct
  source 1..20: mol_type = other DNA
gtacttatggaagattcatg

SEQ ID NO: 22603 - DNA, 20 bp, synthetic construct
  source 1..20: mol_type = other DNA
cgggggccccaatggccgca

SEQ ID NO: 22604 - DNA, 20 bp, synthetic construct
  source 1..20: mol_type = other DNA
taacaatttcactgcggaca

SEQ ID NO: 22605 - DNA, 20 bp, synthetic construct
  source 1..20: mol_type = other DNA
ccggggggtcgataaccagc

SEQ ID NO: 22606 - DNA, 20 bp, synthetic construct
  source 1..20: mol_type = other DNA
tctcttgggaggccccaatc

SEQ ID NO: 22607 - DNA, 20 bp, synthetic construct
  source 1..20: mol_type = other DNA
agcttcagtgtgcgaaggct

SEQ ID NO: 22608 - DNA, 20 bp, synthetic construct
  source 1..20: mol_type = other DNA
gcttcgacagcatgccaagc

SEQ ID NO: 22609 - DNA, 20 bp, synthetic construct
  source 1..20: mol_type = other DNA
ttgattcgtcaatcgacgaa

SEQ ID NO: 22610 - DNA, 20 bp, synthetic construct
  source 1..20: mol_type = other DNA
acttagaagtactagcaaaa

SEQ ID NO: 22611 - DNA, 20 bp, synthetic construct
  source 1..20: mol_type = other DNA
gatggactcggccattaggc

SEQ ID NO: 22612 - DNA, 20 bp, synthetic construct
  source 1..20: mol_type = other DNA
gggtgttgagcggtatgtca

SEQ ID NO: 22613 - DNA, 20 bp, synthetic construct
  source 1..20: mol_type = other DNA
tggcaccttcatgacaacag

SEQ ID NO: 22614 - DNA, 20 bp, synthetic construct
  source 1..20: mol_type = other DNA
cagtaatgacgatgtgctga

SEQ ID NO: 22615 - DNA, 20 bp, synthetic construct
  source 1..20: mol_type = other DNA
gagcatgattgagacccgca

SEQ ID NO: 22616 - DNA, 20 bp, synthetic construct
  source 1..20: mol_type = other DNA
ggtattcgcggacacggacg

SEQ ID NO: 22617 - DNA, 20 bp, synthetic construct
  source 1..20: mol_type = other DNA
tatctattactgcaaatcca

SEQ ID NO: 22618 - DNA, 20 bp, synthetic construct
  source 1..20: mol_type = other DNA
aaaggtttgccaaattcttg

SEQ ID NO: 22619 - DNA, 20 bp, synthetic construct
  source 1..20: mol_type = other DNA
ccatctagagaagcgcgtcc

SEQ ID NO: 22620 - DNA, 20 bp, synthetic construct
  source 1..20: mol_type = other DNA
ggcagtcattcagagtgtgt

SEQ ID NO: 22621 - DNA, 20 bp, synthetic construct
  source 1..20: mol_type = other DNA
cctgaaccttgctggcaggc

SEQ ID NO: 22622 - DNA, 20 bp, synthetic construct
  source 1..20: mol_type = other DNA
acaaggacaaattgaatata

SEQ ID NO: 22623 - DNA, 20 bp, synthetic construct
  source 1..20: mol_type = other DNA
ccgtttgatagaggcatcta

SEQ ID NO: 22624 - DNA, 20 bp, synthetic construct
  source 1..20: mol_type = other DNA
ttggtgaccccgacgtgatc

SEQ ID NO: 22625 - DNA, 20 bp, synthetic construct
  source 1..20: mol_type = other DNA
aacctaccgagaactcagag

SEQ ID NO: 22626 - DNA, 20 bp, synthetic construct
  source 1..20: mol_type = other DNA
caactccagacggttatagc

SEQ ID NO: 22627 - DNA, 20 bp, synthetic construct
  source 1..20: mol_type = other DNA
tgctttaggcagaagtcaca

SEQ ID NO: 22628 - DNA, 20 bp, synthetic construct
  source 1..20: mol_type = other DNA
gagaacttctacctggcggc

SEQ ID NO: 22629 - DNA, 20 bp, synthetic construct
  source 1..20: mol_type = other DNA
gaggagcactgtaagcccca

SEQ ID NO: 22630 - DNA, 20 bp, synthetic construct
  source 1..20: mol_type = other DNA
gagtacgttctgtctctcca

SEQ ID NO: 22631 - DNA, 20 bp, synthetic construct
  source 1..20: mol_type = other DNA
tgggacattcttcatgcttg

SEQ ID NO: 22632 - DNA, 20 bp, synthetic construct
  source 1..20: mol_type = other DNA
acagcacaaccctcacctat

SEQ ID NO: 22633 - DNA, 20 bp, synthetic construct
  source 1..20: mol_type = other DNA
cttctgcagaagatattaat

SEQ ID NO: 22634 - DNA, 20 bp, synthetic construct
  source 1..20: mol_type = other DNA
caggatgcaaaaattaaaca

SEQ ID NO: 22635 - DNA, 20 bp, synthetic construct
  source 1..20: mol_type = other DNA
acctgcttcttttgcaaaca

SEQ ID NO: 22636 - DNA, 20 bp, synthetic construct
  source 1..20: mol_type = other DNA
aatggccgcatggaccggtc

SEQ ID NO: 22637 - DNA, 20 bp, synthetic construct
  source 1..20: mol_type = other DNA
attcctatgttggtagatac

SEQ ID NO: 22638 - DNA, 20 bp, synthetic construct
  source 1..20: mol_type = other DNA
ctagaaaatcaaggaatatt

SEQ ID NO: 22639 - DNA, 20 bp, synthetic construct
  source 1..20: mol_type = other DNA
ccgcctcatgactgcgtttt

SEQ ID NO: 22640 - DNA, 20 bp, synthetic construct
  source 1..20: mol_type = other DNA
gttgaaggacgaccaacatg

SEQ ID NO: 22641 - DNA, 20 bp, synthetic construct
  source 1..20: mol_type = other DNA
agatcacggtacctaacagc

SEQ ID NO: 22642 - DNA, 20 bp, synthetic construct
  source 1..20: mol_type = other DNA
ctattactaccattcttgga

SEQ ID NO: 22643 - DNA, 20 bp, synthetic construct
  source 1..20: mol_type = other DNA
ttaaccaacatgctgaatac

SEQ ID NO: 22644 - DNA, 20 bp, synthetic construct
  source 1..20: mol_type = other DNA
agacaaaagaaatgggcaaa

SEQ ID NO: 22645 - DNA, 20 bp, synthetic construct
  source 1..20: mol_type = other DNA
tacattaaactatcttatcg

SEQ ID NO: 22646 - DNA, 20 bp, synthetic construct
  source 1..20: mol_type = other DNA
atcacgataaccacagccac

SEQ ID NO: 22647 - DNA, 20 bp, synthetic construct
  source 1..20: mol_type = other DNA
aaatgcacactgggtttagg

SEQ ID NO: 22648 - DNA, 20 bp, synthetic construct
  source 1..20: mol_type = other DNA
aggcctaaagtagaaataac

SEQ ID NO: 22649 - DNA, 20 bp, synthetic construct
  source 1..20: mol_type = other DNA
aaagtagaaataacaactga

SEQ ID NO: 22650 - DNA, 20 bp, synthetic construct
  source 1..20: mol_type = other DNA
tcctctccaattacagcaac

SEQ ID NO: 22651 - DNA, 20 bp, synthetic construct
  source 1..20: mol_type = other DNA
ggccgggagctggaatgctg

SEQ ID NO: 22652 - DNA, 20 bp, synthetic construct
  source 1..20: mol_type = other DNA
tggaggaggatataatttta

SEQ ID NO: 22653 - DNA, 20 bp, synthetic construct
  source 1..20: mol_type = other DNA
aggattattggattactgca

SEQ ID NO: 22654 - DNA, 20 bp, synthetic construct
  source 1..20: mol_type = other DNA
tccaggagagggtgtacagg

SEQ ID NO: 22655 - DNA, 20 bp, synthetic construct
  source 1..20: mol_type = other DNA
tacgtgcctgtggttataac

SEQ ID NO: 22656 - DNA, 20 bp, synthetic construct
  source 1..20: mol_type = other DNA
accaatgtcataaaggaatt

SEQ ID NO: 22657 - DNA, 20 bp, synthetic construct
  source 1..20: mol_type = other DNA
cggatcctactcgtcctgca

SEQ ID NO: 22658 - DNA, 20 bp, synthetic construct
  source 1..20: mol_type = other DNA
cgcgctatatgctgctcatt

SEQ ID NO: 22659 - DNA, 20 bp, synthetic construct
  source 1..20: mol_type = other DNA
tttatagaggttcccgaact

SEQ ID NO: 22660 - DNA, 20 bp, synthetic construct
  source 1..20: mol_type = other DNA
tgtcacgtcgtatagatttt

SEQ ID NO: 22661 - DNA, 20 bp, synthetic construct
  source 1..20: mol_type = other DNA
cggaaactgaaaagtcccgt

SEQ ID NO: 22662 - DNA, 20 bp, synthetic construct
  source 1..20: mol_type = other DNA
tcaattctttggatcgtaat

SEQ ID NO: 22663 - DNA, 20 bp, synthetic construct
  source 1..20: mol_type = other DNA
cgatatgtgtgggtgtcaac

SEQ ID NO: 22664 - DNA, 20 bp, synthetic construct
  source 1..20: mol_type = other DNA
tagctatttagctttactaa

SEQ ID NO: 22665 - DNA, 20 bp, synthetic construct
  source 1..20: mol_type = other DNA
tgaatccccgtcgtcatcca

SEQ ID NO: 22666 - DNA, 20 bp, synthetic construct
  source 1..20: mol_type = other DNA
ttacccttctaatgttgtta

SEQ ID NO: 22667 - DNA, 20 bp, synthetic construct
  source 1..20: mol_type = other DNA
ttattctccgttagtcgatt

SEQ ID NO: 22668 - DNA, 20 bp, synthetic construct
  source 1..20: mol_type = other DNA
gcagatccatgcgtgtaggt

SEQ ID NO: 22669 - DNA, 20 bp, synthetic construct
  source 1..20: mol_type = other DNA
tcgtcgtactgcttacgatt

SEQ ID NO: 22670 - DNA, 20 bp, synthetic construct
  source 1..20: mol_type = other DNA
aagtctacccccggcccgtc

SEQ ID NO: 22671 - DNA, 20 bp, synthetic construct
  source 1..20: mol_type = other DNA
agacgtgttcggggctcacc

SEQ ID NO: 22672 - DNA, 20 bp, synthetic construct
  source 1..20: mol_type = other DNA
ctcaggcgatgggaccgccg

SEQ ID NO: 22673 - DNA, 20 bp, synthetic construct
  source 1..20: mol_type = other DNA
tccctctacaatattggcct

SEQ ID NO: 22674 - DNA, 20 bp, synthetic construct
  source 1..20: mol_type = other DNA
aggaacgggaaagaattctc

SEQ ID NO: 22675 - DNA, 20 bp, synthetic construct
  source 1..20: mol_type = other DNA
caggtctcaaaggggcagct

SEQ ID NO: 22676 - DNA, 20 bp, synthetic construct
  source 1..20: mol_type = other DNA
gggcaagagaatgtccccga

SEQ ID NO: 22677 - DNA, 20 bp, synthetic construct
  source 1..20: mol_type = other DNA
aacccatgggaaaagtaggg

SEQ ID NO: 22678 - DNA, 20 bp, synthetic construct
  source 1..20: mol_type = other DNA
aactaaaggcccagatccag

SEQ ID NO: 22679 - DNA, 20 bp, synthetic construct
  source 1..20: mol_type = other DNA
gagccggcatgggactagcc

SEQ ID NO: 22680 - DNA, 20 bp, synthetic construct
  source 1..20: mol_type = other DNA
aggatgcctttttctgcctc

SEQ ID NO: 22681 - DNA, 20 bp, synthetic construct
  source 1..20: mol_type = other DNA
atctggggtacctactcaag

SEQ ID NO: 22682 - DNA, 20 bp, synthetic construct
  source 1..20: mol_type = other DNA
ccctaacaaaagagagcatc

SEQ ID NO: 22683 - DNA, 20 bp, synthetic construct
  source 1..20: mol_type = other DNA
atgaaattctctatggagga

SEQ ID NO: 22684 - DNA, 20 bp, synthetic construct
  source 1..20: mol_type = other DNA
acccgttccaggtcggggat

SEQ ID NO: 22685 - DNA, 20 bp, synthetic construct
  source 1..20: mol_type = other DNA
cagatgagtcctgggagctg

SEQ ID NO: 22686 - DNA, 20 bp, synthetic construct
  source 1..20: mol_type = other DNA
caaactcccacggtgagaaa

SEQ ID NO: 22687 - DNA, 20 bp, synthetic construct
  source 1..20: mol_type = other DNA
atagcctcatcaggagaggt

SEQ ID NO: 22688 - DNA, 20 bp, synthetic construct
  source 1..20: mol_type = other DNA
caattcatcaatgataggat

SEQ ID NO: 22689 - DNA, 20 bp, synthetic construct
  source 1..20: mol_type = other DNA
acaccccgacttgctgagtt

SEQ ID NO: 22690 - DNA, 20 bp, synthetic construct
  source 1..20: mol_type = other DNA
ttgaaaacagttattcatac

SEQ ID NO: 22691 - DNA, 20 bp, synthetic construct
  source 1..20: mol_type = other DNA
ttcttaactttaagtctatg

SEQ ID NO: 22692 - DNA, 20 bp, synthetic construct
  source 1..20: mol_type = other DNA
cctactttactggtgaatta

SEQ ID NO: 22693 - DNA, 20 bp, synthetic construct
  source 1..20: mol_type = other DNA
acaagccattacggacagtt

SEQ ID NO: 22694 - DNA, 20 bp, synthetic construct
  source 1..20: mol_type = other DNA
agacaaaaatgaaaacacaa

SEQ ID NO: 22695 - DNA, 20 bp, synthetic construct
  source 1..20: mol_type = other DNA
tgattgatgatttgggccaa

SEQ ID NO: 22696 - DNA, 20 bp, synthetic construct
  source 1..20: mol_type = other DNA
tattagattcaggtgctctg

SEQ ID NO: 22697 - DNA, 20 bp, synthetic construct
  source 1..20: mol_type = other DNA
acactagactagaagaacca

SEQ ID NO: 22698 - DNA, 20 bp, synthetic construct
  source 1..20: mol_type = other DNA
caaccatttttaatacatgt

SEQ ID NO: 22699 - DNA, 20 bp, synthetic construct
  source 1..20: mol_type = other DNA
ataagaatttttgtaccagc

SEQ ID NO: 22700 - DNA, 20 bp, synthetic construct
  source 1..20: mol_type = other DNA
aacgacccagacatagaagc

SEQ ID NO: 22701 - DNA, 20 bp, synthetic construct
  source 1..20: mol_type = other DNA
tatggactgaggatcaccga

SEQ ID NO: 22702 - DNA, 20 bp, synthetic construct
  source 1..20: mol_type = other DNA
ttctttgcgactatcagatt

SEQ ID NO: 22703 - DNA, 20 bp, synthetic construct
  source 1..20: mol_type = other DNA
ggtggttatccactcctgtg

SEQ ID NO: 22704 - DNA, 20 bp, synthetic construct
  source 1..20: mol_type = other DNA
aggcagtcagtgactttcaa

SEQ ID NO: 22705 - DNA, 20 bp, synthetic construct
  source 1..20: mol_type = other DNA
taggatcctttacaatctca

SEQ ID NO: 22706 - DNA, 20 bp, synthetic construct
  source 1..20: mol_type = other DNA
atcaagcatccaacaaccaa

SEQ ID NO: 22707 - DNA, 20 bp, synthetic construct
  source 1..20: mol_type = other DNA
tggacaaagagtgtcaaaca

SEQ ID NO: 22708 - DNA, 20 bp, synthetic construct
  source 1..20: mol_type = other DNA
gcctccagtcatcccggagt

SEQ ID NO: 22709 - DNA, 20 bp, synthetic construct
  source 1..20: mol_type = other DNA
cattgacactactcctgagg

SEQ ID NO: 22710 - DNA, 20 bp, synthetic construct
  source 1..20: mol_type = other DNA
aaattatcatgcagaccatc

SEQ ID NO: 22711 - DNA, 20 bp, synthetic construct
  source 1..20: mol_type = other DNA
tacacatcataatggccagt

SEQ ID NO: 22712 - DNA, 20 bp, synthetic construct
  source 1..20: mol_type = other DNA
agaagaacagctggggctac

SEQ ID NO: 22713 - DNA, 20 bp, synthetic construct
  source 1..20: mol_type = other DNA
ctaaaggggtgaaataaaac

SEQ ID NO: 22714 - DNA, 20 bp, synthetic construct
  source 1..20: mol_type = other DNA
ctgtgggatcatagttctgg

SEQ ID NO: 22715 - DNA, 20 bp, synthetic construct
  source 1..20: mol_type = other DNA
gtgcaccgggactgttatgg

SEQ ID NO: 22716 - DNA, 20 bp, synthetic construct
  source 1..20: mol_type = other DNA
cacagcaggtgttgccttat

SEQ ID NO: 22717 - DNA, 20 bp, synthetic construct
  source 1..20: mol_type = other DNA
aatagatcaaattagctgca

SEQ ID NO: 22718 - DNA, 20 bp, synthetic construct
  source 1..20: mol_type = other DNA
taacgataattcagaatgga

SEQ ID NO: 22719 - DNA, 20 bp, synthetic construct
  source 1..20: mol_type = other DNA
catcacaattcctgctaaca

SEQ ID NO: 22720 - DNA, 20 bp, synthetic construct
  source 1..20: mol_type = other DNA
gccttacggtccatcaggta

SEQ ID NO: 22721 - DNA, 20 bp, synthetic construct
  source 1..20: mol_type = other DNA
attaggcgatgttgataccg

SEQ ID NO: 22722 - DNA, 20 bp, synthetic construct
  source 1..20: mol_type = other DNA
atactaaatgtaatcaaact

SEQ ID NO: 22723 - DNA, 20 bp, synthetic construct
  source 1..20: mol_type = other DNA
gaaatacatgagtcaatcgc

SEQ ID NO: 22724 - DNA, 20 bp, synthetic construct
  source 1..20: mol_type = other DNA
gccaatcatgaaagcacacg

SEQ ID NO: 22725 - DNA, 20 bp, synthetic construct
  source 1..20: mol_type = other DNA
ctatcatatggaattcagtc

SEQ ID NO: 22726 - DNA, 20 bp, synthetic construct
  source 1..20: mol_type = other DNA
tgcagaaagacttgacgaaa

SEQ ID NO: 22727 - DNA, 20 bp, synthetic construct
  source 1..20: mol_type = other DNA
ttgtgcaaggcaagctcaat

SEQ ID NO: 22728 - DNA, 20 bp, synthetic construct
  source 1..20: mol_type = other DNA
aataagatcaggattgaaaa

SEQ ID NO: 22729 - DNA, 20 bp, synthetic construct
  source 1..20: mol_type = other DNA
gaataaagagcactcatcca

SEQ ID NO: 22730 - DNA, 20 bp, synthetic construct
  source 1..20: mol_type = other DNA
ttcagtcaagtgggcatttg

SEQ ID NO: 22731 - DNA, 20 bp, synthetic construct
  source 1..20: mol_type = other DNA
aatcttatcaatgaatacta

SEQ ID NO: 22732 - DNA, 20 bp, synthetic construct
  source 1..20: mol_type = other DNA
gagaaaagttttgattctag

SEQ ID NO: 22733 - DNA, 20 bp, synthetic construct
  source 1..20: mol_type = other DNA
ctccattcagcttcttcgga

SEQ ID NO: 22734 - DNA, 20 bp, synthetic construct
  source 1..20: mol_type = other DNA
ccgccctcccacatcctccc

SEQ ID NO: 22735 - DNA, 20 bp, synthetic construct
  source 1..20: mol_type = other DNA
cgctcccaatctcggccgcg

SEQ ID NO: 22736 - DNA, 20 bp, synthetic construct
  source 1..20: mol_type = other DNA
tggtgtaaggttcatgtgcc

SEQ ID NO: 22737 - DNA, 20 bp, synthetic construct
  source 1..20: mol_type = other DNA
tctgtgctcgctgctgtggc

SEQ ID NO: 22738 - DNA, 20 bp, synthetic construct
  source 1..20: mol_type = other DNA
ttggctctcctctctcttcc

SEQ ID NO: 22739 - DNA, 20 bp, synthetic construct
  source 1..20: mol_type = other DNA
ttcacccgcggctggaacat

SEQ ID NO: 22740 - DNA, 20 bp, synthetic construct
  source 1..20: mol_type = other DNA
tacaacacccactccatgtg

SEQ ID NO: 22741 - DNA, 20 bp, synthetic construct
  source 1..20: mol_type = other DNA
tatgaaagcaacaccgctac

SEQ ID NO: 22742 - DNA, 20 bp, synthetic construct
  source 1..20: mol_type = other DNA
tctttccacggtctccgcta

SEQ ID NO: 22743 - DNA, 20 bp, synthetic construct
  source 1..20: mol_type = other DNA
gcccaccggcctggtctcat

SEQ ID NO: 22744 - DNA, 20 bp, synthetic construct
  source 1..20: mol_type = other DNA
ttcactggctccgctcagca

SEQ ID NO: 22745 - DNA, 20 bp, synthetic construct
  source 1..20: mol_type = other DNA
tcccaaaccctcaccgaaga

SEQ ID NO: 22746 - DNA, 20 bp, synthetic construct
  source 1..20: mol_type = other DNA
aaccctgccaccatgcttgt

SEQ ID NO: 22747 - DNA, 20 bp, synthetic construct
  source 1..20: mol_type = other DNA
tcatacttcggatgggagga

SEQ ID NO: 22748 - DNA, 20 bp, synthetic construct
  source 1..20: mol_type = other DNA
gacggcagtgccaaacagat

SEQ ID NO: 22749 - DNA, 20 bp, synthetic construct
  source 1..20: mol_type = other DNA
gtcagctccatcactggcga

SEQ ID NO: 22750 - DNA, 20 bp, synthetic construct
  source 1..20: mol_type = other DNA
ttggtctccatcgcccagga

SEQ ID NO: 22751 - DNA, 20 bp, synthetic construct
  source 1..20: mol_type = other DNA
gcttcactcctcgctcaaac

SEQ ID NO: 22752 - DNA, 20 bp, synthetic construct
  source 1..20: mol_type = other DNA
ctcgtctcctctgccccctt

SEQ ID NO: 22753 - DNA, 20 bp, synthetic construct
  source 1..20: mol_type = other DNA
caagccatcgcaaacaacac

SEQ ID NO: 22754 - DNA, 20 bp, synthetic construct
  source 1..20: mol_type = other DNA
ggcgcccatccccaccccac

SEQ ID NO: 22755 - DNA, 20 bp, synthetic construct
  source 1..20: mol_type = other DNA
aaccggatgtcccgcttgca

SEQ ID NO: 22756 - DNA, 20 bp, synthetic construct
  source 1..20: mol_type = other DNA
atgctcctcggtggtctcat

SEQ ID NO: 22757 - DNA, 20 bp, synthetic construct
  source 1..20: mol_type = other DNA
ttcacccttgttgctgacca

SEQ ID NO: 22758 - DNA, 20 bp, synthetic construct
  source 1..20: mol_type = other DNA
atctgtgtcctctctgccct

SEQ ID NO: 22759 - DNA, 20 bp, synthetic construct
  source 1..20: mol_type = other DNA
caggatttcccacccacgtc

SEQ ID NO: 22760 - DNA, 20 bp, synthetic construct
  source 1..20: mol_type = other DNA
tagttagttagaaccctttg

SEQ ID NO: 22761 - DNA, 20 bp, synthetic construct
  source 1..20: mol_type = other DNA
aagccatggttgtactgcac

SEQ ID NO: 22762 - DNA, 20 bp, synthetic construct
  source 1..20: mol_type = other DNA
ataaacctcttgctgattgc

SEQ ID NO: 22763 - DNA, 20 bp, synthetic construct
  source 1..20: mol_type = other DNA
catacctgttgtccttgtat

SEQ ID NO: 22764 - DNA, 20 bp, synthetic construct
  source 1..20: mol_type = other DNA
taggggggcaaccggtgact

SEQ ID NO: 22765 - DNA, 20 bp, synthetic construct
  source 1..20: mol_type = other DNA
ttcctcaagggttcaagaat

SEQ ID NO: 22766 - DNA, 20 bp, synthetic construct
  source 1..20: mol_type = other DNA
ctttgggcaataaggggtac

SEQ ID NO: 22767 - DNA, 20 bp, synthetic construct
  source 1..20: mol_type = other DNA
tcaaggatgcagggaagcta

SEQ ID NO: 22768 - DNA, 20 bp, synthetic construct
  source 1..20: mol_type = other DNA
ttaaccctgctaccttgctc

SEQ ID NO: 22769 - DNA, 20 bp, synthetic construct
  source 1..20: mol_type = other DNA
gaggaaaaactatcatgcct

SEQ ID NO: 22770 - DNA, 20 bp, synthetic construct
  source 1..20: mol_type = other DNA
gtgctcaaatcaacgccgga

SEQ ID NO: 22771 - DNA, 20 bp, synthetic construct
  source 1..20: mol_type = other DNA
tggatgtaaaactacagata

SEQ ID NO: 22772 - DNA, 20 bp, synthetic construct
  source 1..20: mol_type = other DNA
tcccaaacggattgggaccg

SEQ ID NO: 22773 - DNA, 20 bp, synthetic construct
  source 1..20: mol_type = other DNA
ccccccatcctgcctatcta

SEQ ID NO: 22774 - DNA, 20 bp, synthetic construct
  source 1..20: mol_type = other DNA
taacactggactcaccccat

SEQ ID NO: 22775 - DNA, 20 bp, synthetic construct
  source 1..20: mol_type = other DNA
agtcttacaaaacagacggg

SEQ ID NO: 22776 - DNA, 20 bp, synthetic construct
  source 1..20: mol_type = other DNA
gggatggtttgaaggatggt

SEQ ID NO: 22777 - DNA, 20 bp, synthetic construct
  source 1..20: mol_type = other DNA
gttcccatgagatacaagga

SEQ ID NO: 22778 - DNA, 20 bp, synthetic construct
  source 1..20: mol_type = other DNA
ctttgctgagacttgaccgc

SEQ ID NO: 22779 - DNA, 20 bp, synthetic construct
  source 1..20: mol_type = other DNA
ccaagtacactacccactag

SEQ ID NO: 22780 - DNA, 20 bp, synthetic construct
  source 1..20: mol_type = other DNA
acccaagattggtcccgaga

SEQ ID NO: 22781 - DNA, 20 bp, synthetic construct
  source 1..20: mol_type = other DNA
atggctagggctgcattggc

SEQ ID NO: 22782 - DNA, 20 bp, synthetic construct
  source 1..20: mol_type = other DNA
gaggcagtggatcattggga

SEQ ID NO: 22783 - DNA, 20 bp, synthetic construct
  source 1..20: mol_type = other DNA
gctatagtcatcaccaccaa

SEQ ID NO: 22784 - DNA, 20 bp, synthetic construct
  source 1..20: mol_type = other DNA
ttctcacatctaaaaatgga

SEQ ID NO: 22785 - DNA, 20 bp, synthetic construct
  source 1..20: mol_type = other DNA
atggcgggatctgcgctcgt

SEQ ID NO: 22786 - DNA, 20 bp, synthetic construct
  source 1..20: mol_type = other DNA
caacggcgacaacttggtct

SEQ ID NO: 22787 - DNA, 20 bp, synthetic construct
  source 1..20: mol_type = other DNA
ggatggggcttttgggtcag

SEQ ID NO: 22788 - DNA, 20 bp, synthetic construct
  source 1..20: mol_type = other DNA
cttgaagaaggttgccctga

SEQ ID NO: 22789 - DNA, 20 bp, synthetic construct
  source 1..20: mol_type = other DNA
gccggccacgagattgtgag

SEQ ID NO: 22790 - DNA, 20 bp, synthetic construct
  source 1..20: mol_type = other DNA
aaaaggaagaatgatgattg

SEQ ID NO: 22791 - DNA, 20 bp, synthetic construct
  source 1..20: mol_type = other DNA
ctactatggggcgccgatct

SEQ ID NO: 22792 - DNA, 20 bp, synthetic construct
  source 1..20: mol_type = other DNA
gcagattatacagcatggga

SEQ ID NO: 22793 - DNA, 20 bp, synthetic construct
  source 1..20: mol_type = other DNA
ccatctggattcccatgtac

SEQ ID NO: 22794 - DNA, 20 bp, synthetic construct
  source 1..20: mol_type = other DNA
atcttctggacccgcgggcc

SEQ ID NO: 22795 - DNA, 20 bp, synthetic construct
  source 1..20: mol_type = other DNA
caatgtccagagtgtgcagt

SEQ ID NO: 22796 - DNA, 20 bp, synthetic construct
  source 1..20: mol_type = other DNA
ccccattgggtttccagacc

SEQ ID NO: 22797 - DNA, 20 bp, synthetic construct
  source 1..20: mol_type = other DNA
ctggatttcccccccatcac

SEQ ID NO: 22798 - DNA, 20 bp, synthetic construct
  source 1..20: mol_type = other DNA
ctgggagcgggcatacaggt

SEQ ID NO: 22799 - DNA, 20 bp, synthetic construct
  source 1..20: mol_type = other DNA
cgtgctgggggtttgaccag

SEQ ID NO: 22800 - DNA, 20 bp, synthetic construct
  source 1..20: mol_type = other DNA
gttttagccagcactacagc

SEQ ID NO: 22801 - DNA, 20 bp, synthetic construct
  source 1..20: mol_type = other DNA
caggcctatcagaaacgaat

SEQ ID NO: 22802 - DNA, 20 bp, synthetic construct
  source 1..20: mol_type = other DNA
ggagcaattgagctcagtgt

SEQ ID NO: 22803 - DNA, 20 bp, synthetic construct
  source 1..20: mol_type = other DNA
caaagtaagagatcaagctg

SEQ ID NO: 22804 - DNA, 20 bp, synthetic construct
  source 1..20: mol_type = other DNA
ccagttcactggtgcttttg

SEQ ID NO: 22805 - DNA, 20 bp, synthetic construct
  source 1..20: mol_type = other DNA
cttactgaatgacaggcatt

SEQ ID NO: 22806 - DNA, 20 bp, synthetic construct
  source 1..20: mol_type = other DNA
aggtccagataatggagcag

SEQ ID NO: 22807 - DNA, 20 bp, synthetic construct
  source 1..20: mol_type = other DNA
gggacgacctaaagaaaaaa

SEQ ID NO: 22808 - DNA, 20 bp, synthetic construct
  source 1..20: mol_type = other DNA
ctaggaggtctggagccgca

SEQ ID NO: 22809 - DNA, 20 bp, synthetic construct
  source 1..20: mol_type = other DNA
tcaaagggacgaaggtggtc

SEQ ID NO: 22810 - DNA, 20 bp, synthetic construct
  source 1..20: mol_type = other DNA
ccgaactttctttgaccatc

SEQ ID NO: 22811 - DNA, 20 bp, synthetic construct
  source 1..20: mol_type = other DNA
aagctggactgctggtctcc

SEQ ID NO: 22812 - DNA, 20 bp, synthetic construct
  source 1..20: mol_type = other DNA
gtcatgaaggagagggaata

SEQ ID NO: 22813 - DNA, 20 bp, synthetic construct
  source 1..20: mol_type = other DNA
tccagtcacttcaacaaatt

SEQ ID NO: 22814 - DNA, 20 bp, synthetic construct
  source 1..20: mol_type = other DNA
cggtatttaacagcttgtat

SEQ ID NO: 22815 - DNA, 20 bp, synthetic construct
  source 1..20: mol_type = other DNA
gaacatgctgggaacagatg

SEQ ID NO: 22816 - DNA, 20 bp, synthetic construct
  source 1..20: mol_type = other DNA
tagacatccttaagcagaac

SEQ ID NO: 22817 - DNA, 20 bp, synthetic construct
  source 1..20: mol_type = other DNA
agataagagtgcatgaggga

SEQ ID NO: 22818 - DNA, 20 bp, synthetic construct
  source 1..20: mol_type = other DNA
tgacaataacttactcatcg

SEQ ID NO: 22819 - DNA, 20 bp, synthetic construct
  source 1..20: mol_type = other DNA
acaggagatatgggccagca

SEQ ID NO: 22820 - DNA, 20 bp, synthetic construct
  source 1..20: mol_type = other DNA
ttgatgagaggattgtcctc

SEQ ID NO: 22821 - DNA, 20 bp, synthetic construct
  source 1..20: mol_type = other DNA
agcaacatgacgcaacgagt

SEQ ID NO: 22822 - DNA, 20 bp, synthetic construct
  source 1..20: mol_type = other DNA
aagccttcattggacatctc

SEQ ID NO: 22823 - DNA, 20 bp, synthetic construct
  source 1..20: mol_type = other DNA
tattctgatagaggctgggg

SEQ ID NO: 22824 - DNA, 20 bp, synthetic construct
  source 1..20: mol_type = other DNA
gccccctgcaggattccagt

SEQ ID NO: 22825 - DNA, 20 bp, synthetic construct
  source 1..20: mol_type = other DNA
ggcaagagagagctcaagtg

SEQ ID NO: 22826 - DNA, 20 bp, synthetic construct
  source 1..20: mol_type = other DNA
tccccagggaggaagaatgg

SEQ ID NO: 22827 - DNA, 20 bp, synthetic construct
  source 1..20: mol_type = other DNA
agatccaccacggatagcgg

SEQ ID NO: 22828 - DNA, 20 bp, synthetic construct
  source 1..20: mol_type = other DNA
catgagatgaacaatggagg

SEQ ID NO: 22829 - DNA, 20 bp, synthetic construct
  source 1..20: mol_type = other DNA
gatgaagcccattttttgga

SEQ ID NO: 22830 - DNA, 20 bp, synthetic construct
  source 1..20: mol_type = other DNA
gggcgcattgggagaaatcc

SEQ ID NO: 22831 - DNA, 20 bp, synthetic construct
  source 1..20: mol_type = other DNA
ccagtttcccctggtgaaat

SEQ ID NO: 22832 - DNA, 20 bp, synthetic construct
  source 1..20: mol_type = other DNA
gacagcggtgaaacagtgaa

SEQ ID NO: 22833 - DNA, 20 bp, synthetic construct
  source 1..20: mol_type = other DNA
gatttcctggctaaaaaagg

SEQ ID NO: 22834 - DNA, 20 bp, synthetic construct
  source 1..20: mol_type = other DNA
gacaaccaagtggcatacct

SEQ ID NO: 22835 - DNA, 20 bp, synthetic construct
  source 1..20: mol_type = other DNA
gcctggacagtgtacgttgg

SEQ ID NO: 22836 - DNA, 20 bp, synthetic construct
  source 1..20: mol_type = other DNA
ctggtcagtggctggaattc

SEQ ID NO: 22837 - DNA, 20 bp, synthetic construct
  source 1..20: mol_type = other DNA
gttgacattgaggaagctcc

SEQ ID NO: 22838 - DNA, 20 bp, synthetic construct
  source 1..20: mol_type = other DNA
aagcgacagtttgagttgta

SEQ ID NO: 22839 - DNA, 20 bp, synthetic construct
  source 1..20: mol_type = other DNA
ccagtgaaatgtgacaccct

SEQ ID NO: 22840 - DNA, 20 bp, synthetic construct
  source 1..20: mol_type = other DNA
cttgagtttgaggccctggg

SEQ ID NO: 22841 - DNA, 20 bp, synthetic construct
  source 1..20: mol_type = other DNA
atcacagaggcagaccttga

SEQ ID NO: 22842 - DNA, 20 bp, synthetic construct
  source 1..20: mol_type = other DNA
ctgaagaggatggcggtgag

SEQ ID NO: 22843 - DNA, 20 bp, synthetic construct
  source 1..20: mol_type = other DNA
ttccatgaactacagctgaa

SEQ ID NO: 22844 - DNA, 20 bp, synthetic construct
  source 1..20: mol_type = other DNA
atggtgaaaaaatggagaga

SEQ ID NO: 22845 - DNA, 20 bp, synthetic construct
  source 1..20: mol_type = other DNA
gacaggtattctgtggatgc

SEQ ID NO: 22846 - DNA, 20 bp, synthetic construct
  source 1..20: mol_type = other DNA
cgggataaaaactacggatg

SEQ ID NO: 22847 - DNA, 20 bp, synthetic construct
  source 1..20: mol_type = other DNA
acatataaacaaaaaccagc

SEQ ID NO: 22848 - DNA, 20 bp, synthetic construct
  source 1..20: mol_type = other DNA
cggagaggtaatgtgaatgg

SEQ ID NO: 22849 - DNA, 20 bp, synthetic construct
  source 1..20: mol_type = other DNA
tggatatggctgatgaacaa

SEQ ID NO: 22850 - DNA, 20 bp, synthetic construct
  source 1..20: mol_type = other DNA
ggtgttgtactggacaggcc

SEQ ID NO: 22851 - DNA, 20 bp, synthetic construct
  source 1..20: mol_type = other DNA
aagcaattagggatccttgg

SEQ ID NO: 22852 - DNA, 20 bp, synthetic construct
  source 1..20: mol_type = other DNA
accagtgctgagtttatgca

SEQ ID NO: 22853 - DNA, 20 bp, synthetic construct
  source 1..20: mol_type = other DNA
tttccatcaaggcataagag

SEQ ID NO: 22854 - DNA, 20 bp, synthetic construct
  source 1..20: mol_type = other DNA
cagataacattggccactgg

SEQ ID NO: 22855 - DNA, 20 bp, synthetic construct
  source 1..20: mol_type = other DNA
ggagatatgaaggaaggtga

SEQ ID NO: 22856 - DNA, 20 bp, synthetic construct
  source 1..20: mol_type = other DNA
aggtttgctgaaaatcttag

SEQ ID NO: 22857 - DNA, 20 bp, synthetic construct
  source 1..20: mol_type = other DNA
gagtcaggtgtgacattgcc

SEQ ID NO: 22858 - DNA, 20 bp, synthetic construct
  source 1..20: mol_type = other DNA
gaggtcctcaacaacctcct

SEQ ID NO: 22859 - DNA, 20 bp, synthetic construct
  source 1..20: mol_type = other DNA
tacacatacctcaatgcaag

SEQ ID NO: 22860 - DNA, 20 bp, synthetic construct
  source 1..20: mol_type = other DNA
aaggaattagctgtgggaga

SEQ ID NO: 22861 - DNA, 20 bp, synthetic construct
  source 1..20: mol_type = other DNA
tatgctacaagttccttgaa

SEQ ID NO: 22862 - DNA, 20 bp, synthetic construct
  source 1..20: mol_type = other DNA
tatcaagatcttgtcgatag

SEQ ID NO: 22863 - DNA, 20 bp, synthetic construct
  source 1..20: mol_type = other DNA
aacaaaggttctacctcaaa

SEQ ID NO: 22864 - DNA, 20 bp, synthetic construct
  source 1..20: mol_type = other DNA
aagtgccctccatgtagtaa

SEQ ID NO: 22865 - DNA, 20 bp, synthetic construct
  source 1..20: mol_type = other DNA
ggctcaacaatggcctctgc

SEQ ID NO: 22866 - DNA, 20 bp, synthetic construct
  source 1..20: mol_type = other DNA
cccggctatgaaggtaaaac

SEQ ID NO: 22867 - DNA, 20 bp, synthetic construct
  source 1..20: mol_type = other DNA
gcatatagatttgaggacat

SEQ ID NO: 22868 - DNA, 20 bp, synthetic construct
  source 1..20: mol_type = other DNA
gcgacggatccgttatccgc

SEQ ID NO: 22869 - DNA, 20 bp, synthetic construct
  source 1..20: mol_type = other DNA
catgggacgctagttgtgaa

SEQ ID NO: 22870 - DNA, 20 bp, synthetic construct
  source 1..20: mol_type = other DNA
tccgggtacaccgtgcatgt

SEQ ID NO: 22871 - DNA, 20 bp, synthetic construct
  source 1..20: mol_type = other DNA
atagatgatagtttcaccga

SEQ ID NO: 22872 - DNA, 20 bp, synthetic construct
  source 1..20: mol_type = other DNA
caggggttaggtcagatgct

SEQ ID NO: 22873 - DNA, 20 bp, synthetic construct
  source 1..20: mol_type = other DNA
tctgatacagtgcaaaccag

SEQ ID NO: 22874 - DNA, 20 bp, synthetic construct
  source 1..20: mol_type = other DNA
gtccagttacggaggaaatt

SEQ ID NO: 22875 - DNA, 20 bp, synthetic construct
  source 1..20: mol_type = other DNA
gcatctctaaatgacttcgg

SEQ ID NO: 22876 - DNA, 20 bp, synthetic construct
  source 1..20: mol_type = other DNA
acgcttacacccctctccac

SEQ ID NO: 22877 - DNA, 20 bp, synthetic construct
  source 1..20: mol_type = other DNA
gcccagggcaccgattcaat

SEQ ID NO: 22878 - DNA, 20 bp, synthetic construct
  source 1..20: mol_type = other DNA
cttgggtgtgatgcttcacc

SEQ ID NO: 22879 - DNA, 20 bp, synthetic construct
  source 1..20: mol_type = other DNA
ctggaggagaaaggaatcct

SEQ ID NO: 22880 - DNA, 20 bp, synthetic construct
  source 1..20: mol_type = other DNA
caaggaccagggttcgatta

SEQ ID NO: 22881 - DNA, 20 bp, synthetic construct
  source 1..20: mol_type = other DNA
aaaacaaaggttgagcaggg

SEQ ID NO: 22882 - DNA, 20 bp, synthetic construct
  source 1..20: mol_type = other DNA
gcaggcatgcaaaatcatat

SEQ ID NO: 22883 - DNA, 20 bp, synthetic construct
  source 1..20: mol_type = other DNA
accataaataatggaactcc

SEQ ID NO: 22884 - DNA, 20 bp, synthetic construct
  source 1..20: mol_type = other DNA
caacaaggcactgttgacaa

SEQ ID NO: 22885 - DNA, 20 bp, synthetic construct
  source 1..20: mol_type = other DNA
tttagcaggacggaaagtga

SEQ ID NO: 22886 - DNA, 20 bp, synthetic construct
  source 1..20: mol_type = other DNA
gacggcgtgcatgctgtcct

SEQ ID NO: 22887 - DNA, 20 bp, synthetic construct
  source 1..20: mol_type = other DNA
aatttaagagtgtaactcaa

SEQ ID NO: 22888 - DNA, 20 bp, synthetic construct
  source 1..20: mol_type = other DNA
ccgctgtctcattagttcaa

SEQ ID NO: 22889 - DNA, 20 bp, synthetic construct
  source 1..20: mol_type = other DNA
tgtccctagacggattggat

SEQ ID NO: 22890 - DNA, 20 bp, synthetic construct
  source 1..20: mol_type = other DNA
acctttgcacctgggcctgt

SEQ ID NO: 22891 - DNA, 20 bp, synthetic construct
  source 1..20: mol_type = other DNA
gcagacaagataagagagtc

SEQ ID NO: 22892 - DNA, 20 bp, synthetic construct
  source 1..20: mol_type = other DNA
gccccagaattagttgcttt

SEQ ID NO: 22893 - DNA, 20 bp, synthetic construct
  source 1..20: mol_type = other DNA
ttagttgatgaccttgctct

SEQ ID NO: 22894 - DNA, 20 bp, synthetic construct
  source 1..20: mol_type = other DNA
ttagatttccaaacaataat

SEQ ID NO: 22895 - DNA, 20 bp, synthetic construct
  source 1..20: mol_type = other DNA
ctaccacaaccattcaaccg

SEQ ID NO: 22896 - DNA, 20 bp, synthetic construct
  source 1..20: mol_type = other DNA
atcatcccctttgcgcgtac

SEQ ID NO: 22897 - DNA, 20 bp, synthetic construct
  source 1..20: mol_type = other DNA
tctcctcgtggaggaatcga

SEQ ID NO: 22898 - DNA, 20 bp, synthetic construct
  source 1..20: mol_type = other DNA
gtgagcaagatgtgcttaac

SEQ ID NO: 22899 - DNA, 20 bp, synthetic construct
  source 1..20: mol_type = other DNA
tttgttcatatatctaatga

SEQ ID NO: 22900 - DNA, 20 bp, synthetic construct
  source 1..20: mol_type = other DNA
tgcatcaatctggatgtcat

SEQ ID NO: 22901 - DNA, 20 bp, synthetic construct
  source 1..20: mol_type = other DNA
gatagagttctaaatctagt

SEQ ID NO: 22902 - DNA, 20 bp, synthetic construct
  source 1..20: mol_type = other DNA
ttcaatctaagttcatccga

SEQ ID NO: 22903 - DNA, 20 bp, synthetic construct
  source 1..20: mol_type = other DNA
gagtacattattcacaaggt

SEQ ID NO: 22904 - DNA, 20 bp, synthetic construct
  source 1..20: mol_type = other DNA
gacaatgatatacctgatta

SEQ ID NO: 22905 - DNA, 20 bp, synthetic construct
  source 1..20: mol_type = other DNA
aagtcaccaaaaggttccac

SEQ ID NO: 22906 - DNA, 20 bp, synthetic construct
  source 1..20: mol_type = other DNA
gtgagagttcaatactcacc

SEQ ID NO: 22907 - DNA, 20 bp, synthetic construct
  source 1..20: mol_type = other DNA
agtactggggcttgatcctc

SEQ ID NO: 22908 - DNA, 20 bp, synthetic construct
  source 1..20: mol_type = other DNA
tgaccagaatacagaaaaca

SEQ ID NO: 22909 - DNA, 20 bp, synthetic construct
  source 1..20: mol_type = other DNA
caatagctgactgtaaaaaa

SEQ ID NO: 22910 - DNA, 20 bp, synthetic construct
  source 1..20: mol_type = other DNA
tgctgcattctgatcaagga

SEQ ID NO: 22911 - DNA, 20 bp, synthetic construct
  source 1..20: mol_type = other DNA
ctacaaagtggtacccactt

SEQ ID NO: 22912 - DNA, 20 bp, synthetic construct
  source 1..20: mol_type = other DNA
atgactaagccattgcctct

SEQ ID NO: 22913 - DNA, 20 bp, synthetic construct
  source 1..20: mol_type = other DNA
gacaaggagagggttttggg

SEQ ID NO: 22914 - DNA, 20 bp, synthetic construct
  source 1..20: mol_type = other DNA
tcaactcaagaccaatatat

SEQ ID NO: 22915 - DNA, 20 bp, synthetic construct
  source 1..20: mol_type = other DNA
aaggaagaaacatataggaa

SEQ ID NO: 22916 - DNA, 20 bp, synthetic construct
  source 1..20: mol_type = other DNA
gggacctcatatgatttgga

SEQ ID NO: 22917 - DNA, 20 bp, synthetic construct
  source 1..20: mol_type = other DNA
gaaatagttaaccaagactg

SEQ ID NO: 22918 - DNA, 20 bp, synthetic construct
  source 1..20: mol_type = other DNA
agatttcagattcagctctt

SEQ ID NO: 22919 - DNA, 20 bp, synthetic construct
  source 1..20: mol_type = other DNA
cctcatcataggccactaca

SEQ ID NO: 22920 - DNA, 20 bp, synthetic construct
  source 1..20: mol_type = other DNA
tcgtgaggacccttatgtta

SEQ ID NO: 22921 - DNA, 20 bp, synthetic construct
  source 1..20: mol_type = other DNA
ggttttaagatgcttccgca

SEQ ID NO: 22922 - DNA, 20 bp, synthetic construct
  source 1..20: mol_type = other DNA
tcaggggagacagacctttg

SEQ ID NO: 22923 - DNA, 20 bp, synthetic construct
  source 1..20: mol_type = other DNA
taatatgctatctacagtat

SEQ ID NO: 22924 - DNA, 20 bp, synthetic construct
  source 1..20: mol_type = other DNA
ccacttggggccgaataacc

SEQ ID NO: 22925 - DNA, 20 bp, synthetic construct
  source 1..20: mol_type = other DNA
gtggatttgcaagagcagtg

SEQ ID NO: 22926 - DNA, 20 bp, synthetic construct
  source 1..20: mol_type = other DNA
atttcaaaaccattgaggaa

SEQ ID NO: 22927 - DNA, 20 bp, synthetic construct
  source 1..20: mol_type = other DNA
ccttagctaaggaatgtcta

SEQ ID NO: 22928 - DNA, 20 bp, synthetic construct
  source 1..20: mol_type = other DNA
taataccaatcaccaacaga

SEQ ID NO: 22929 - DNA, 20 bp, synthetic construct
  source 1..20: mol_type = other DNA
ccacacattatgtttctcag

SEQ ID NO: 22930 - DNA, 20 bp, synthetic construct
  source 1..20: mol_type = other DNA
cttttgccggaagcacacta

SEQ ID NO: 22931 - DNA, 20 bp, synthetic construct
  source 1..20: mol_type = other DNA
cacaaacgcatcaaatgccc

SEQ ID NO: 22932 - DNA, 20 bp, synthetic construct
  source 1..20: mol_type = other DNA
cttgataataagagaacctt

SEQ ID NO: 22933 - DNA, 20 bp, synthetic construct
  source 1..20: mol_type = other DNA
catagaatgtgcctgtagag

SEQ ID NO: 22934 - DNA, 20 bp, synthetic construct
  source 1..20: mol_type = other DNA
gcttggaggcatcaaaggag

SEQ ID NO: 22935 - DNA, 20 bp, synthetic construct
  source 1..20: mol_type = other DNA
tatgctttttaaaacccaaa

SEQ ID NO: 22936 - DNA, 20 bp, synthetic construct
  source 1..20: mol_type = other DNA
ggcaataaacagagaggtgt

SEQ ID NO: 22937 - DNA, 20 bp, synthetic construct
  source 1..20: mol_type = other DNA
gaataaagactcacaacaag

SEQ ID NO: 22938 - DNA, 20 bp, synthetic construct
  source 1..20: mol_type = other DNA
aaaccattttagtgtaacat

SEQ ID NO: 22939 - DNA, 20 bp, synthetic construct
  source 1..20: mol_type = other DNA
cttggagatttgggaagagc

SEQ ID NO: 22940 - DNA, 20 bp, synthetic construct
  source 1..20: mol_type = other DNA
aacatagctccatacccctt

SEQ ID NO: 22941 - DNA, 20 bp, synthetic construct
  source 1..20: mol_type = other DNA
cttactgttgtagggttttg

SEQ ID NO: 22942 - DNA, 20 bp, synthetic construct
  source 1..20: mol_type = other DNA
gatggaaaaattgttaatat

SEQ ID NO: 22943 - DNA, 20 bp, synthetic construct
  source 1..20: mol_type = other DNA
ataaccaatgaagtatccat

SEQ ID NO: 22944 - DNA, 20 bp, synthetic construct
  source 1..20: mol_type = other DNA
ttcctaaattactacttgta

SEQ ID NO: 22945 - DNA, 20 bp, synthetic construct
  source 1..20: mol_type = other DNA
atattgggtagttgtagcag

SEQ ID NO: 22946 - DNA, 20 bp, synthetic construct
  source 1..20: mol_type = other DNA
aatccacaaccatttgttaa

SEQ ID NO: 22947 - DNA, 20 bp, synthetic construct
  source 1..20: mol_type = other DNA
ctatatctatttacaataac

SEQ ID NO: 22948 - DNA, 20 bp, synthetic construct
  source 1..20: mol_type = other DNA
atgactacacgagacagtga

SEQ ID NO: 22949 - DNA, 20 bp, synthetic construct
  source 1..20: mol_type = other DNA
ggtcagtttctctcctttgc

SEQ ID NO: 22950 - DNA, 20 bp, synthetic construct
  source 1..20: mol_type = other DNA
ctccatcctcttgcaaggac

SEQ ID NO: 22951 - DNA, 20 bp, synthetic construct
  source 1..20: mol_type = other DNA
catcagaaaaagaacgaaat

SEQ ID NO: 22952 - DNA, 20 bp, synthetic construct
  source 1..20: mol_type = other DNA
aatcctggccatcaagatga

SEQ ID NO: 22953 - DNA, 20 bp, synthetic construct
  source 1..20: mol_type = other DNA
agagatcactctgaaaagaa

SEQ ID NO: 22954 - DNA, 20 bp, synthetic construct
  source 1..20: mol_type = other DNA
tcaaaacgacagaatgccag

SEQ ID NO: 22955 - DNA, 20 bp, synthetic construct
  source 1..20: mol_type = other DNA
agcttgccagaaaagcttgc

SEQ ID NO: 22956 - DNA, 20 bp, synthetic construct
  source 1..20: mol_type = other DNA
tacgttacattaatgataca

SEQ ID NO: 22957 - DNA, 20 bp, synthetic construct
  source 1..20: mol_type = other DNA
gctaatgaagcaaattccaa

SEQ ID NO: 22958 - DNA, 20 bp, synthetic construct
  source 1..20: mol_type = other DNA
tcccctcaggctcctgcgaa

SEQ ID NO: 22959 - DNA, 20 bp, synthetic construct
  source 1..20: mol_type = other DNA
cgaagtgccagaaactctgg

SEQ ID NO: 22960 - DNA, 20 bp, synthetic construct
  source 1..20: mol_type = other DNA
accaaaccaggtccggacaa

SEQ ID NO: 22961 - DNA, 20 bp, synthetic construct
  source 1..20: mol_type = other DNA
ttaatctgtgggttgagaca

SEQ ID NO: 22962 - DNA, 20 bp, synthetic construct
  source 1..20: mol_type = other DNA
aaagttctgctgtcgttgtt

SEQ ID NO: 22963 - DNA, 20 bp, synthetic construct
  source 1..20: mol_type = other DNA
ctccttttagcaaagtacta

SEQ ID NO: 22964 - DNA, 20 bp, synthetic construct
  source 1..20: mol_type = other DNA
aactacgcaactgtaaactc

SEQ ID NO: 22965 - DNA, 20 bp, synthetic construct
  source 1..20: mol_type = other DNA
aacatgccacagttagaggg

SEQ ID NO: 22966 - DNA, 20 bp, synthetic construct
  source 1..20: mol_type = other DNA
gctcagctgtgatgggtgac

SEQ ID NO: 22967 - DNA, 20 bp, synthetic construct
  source 1..20: mol_type = other DNA
gacatatctttccttgcagg

SEQ ID NO: 22968 - DNA, 20 bp, synthetic construct
  source 1..20: mol_type = other DNA
tttggctgaaaccctacgaa

SEQ ID NO: 22969 - DNA, 20 bp, synthetic construct
  source 1..20: mol_type = other DNA
tgaccccttcacattactca

SEQ ID NO: 22970 - DNA, 20 bp, synthetic construct
  source 1..20: mol_type = other DNA
ttatttcagatagcaacaat

SEQ ID NO: 22971 - DNA, 20 bp, synthetic construct
  source 1..20: mol_type = other DNA
gcacaaacaacagtgatggt

SEQ ID NO: 22972 - DNA, 20 bp, synthetic construct
  source 1..20: mol_type = other DNA
gtgctggtgccttactattg

SEQ ID NO: 22973 - DNA, 20 bp, synthetic construct
  source 1..20: mol_type = other DNA
actcagcaagccaaataaca

SEQ ID NO: 22974 - DNA, 20 bp, synthetic construct
  source 1..20: mol_type = other DNA
gagaaaaaggtcaacgataa

SEQ ID NO: 22975 - DNA, 20 bp, synthetic construct
  source 1..20: mol_type = other DNA
agccaaggaagtggctctgt

SEQ ID NO: 22976 - DNA, 20 bp, synthetic construct
  source 1..20: mol_type = other DNA
gtttggaaaaggaggagttg

SEQ ID NO: 22977 - DNA, 20 bp, synthetic construct
  source 1..20: mol_type = other DNA
acatcttaagtgcaaagtcc

SEQ ID NO: 22978 - DNA, 20 bp, synthetic construct
  source 1..20: mol_type = other DNA
aagagatgtaaacaaggaaa

SEQ ID NO: 22979 - DNA, 20 bp, synthetic construct
  source 1..20: mol_type = other DNA
cattggcaagatgtttgagt

SEQ ID NO: 22980 - DNA, 20 bp, synthetic construct
  source 1..20: mol_type = other DNA
tagaatcctaattgggttct

SEQ ID NO: 22981 - DNA, 20 bp, synthetic construct
  source 1..20: mol_type = other DNA
aatagacggaccagacacct

SEQ ID NO: 22982 - DNA, 20 bp, synthetic construct
  source 1..20: mol_type = other DNA
agctgtgcatgctgacatgg

SEQ ID NO: 22983 - DNA, 20 bp, synthetic construct
  source 1..20: mol_type = other DNA
cctgaccttgtttgtggaag

SEQ ID NO: 22984 - DNA, 20 bp, synthetic construct
  source 1..20: mol_type = other DNA
ccacctagccatcatggcag

SEQ ID NO: 22985 - DNA, 20 bp, synthetic construct
  source 1..20: mol_type = other DNA
aaaagccgcactgtctgaag

SEQ ID NO: 22986 - DNA, 20 bp, synthetic construct
  source 1..20: mol_type = other DNA
tgtgaaatcagaacacacag

SEQ ID NO: 22987 - DNA, 20 bp, synthetic construct
  source 1..20: mol_type = other DNA
ggaaatgggagaggcagcag

SEQ ID NO: 22988 - DNA, 20 bp, synthetic construct
  source 1..20: mol_type = other DNA
caacctatctctagcagcca

SEQ ID NO: 22989 - DNA, 20 bp, synthetic construct
  source 1..20: mol_type = other DNA
aataataggcccaggattgc

SEQ ID NO: 22990 - DNA, 20 bp, synthetic construct
  source 1..20: mol_type = other DNA
tccaatggtgactcagttag

SEQ ID NO: 22991 - DNA, 20 bp, synthetic construct
  source 1..20: mol_type = other DNA
gtgcacaagggaagagttca

SEQ ID NO: 22992 - DNA, 20 bp, synthetic construct
  source 1..20: mol_type = other DNA
cgctcatcaccagtggatga

SEQ ID NO: 22993 - DNA, 20 bp, synthetic construct
  source 1..20: mol_type = other DNA
ttgtgccacggtttgagcaa

SEQ ID NO: 22994 - DNA, 20 bp, synthetic construct
  source 1..20: mol_type = other DNA
ttttccaattcaaattacct

SEQ ID NO: 22995 - DNA, 20 bp, synthetic construct
  source 1..20: mol_type = other DNA
aatggtcatacttacgtttg

SEQ ID NO: 22996 - DNA, 20 bp, synthetic construct
  source 1..20: mol_type = other DNA
agtgtggattgctttgttgc

SEQ ID NO: 22997 - DNA, 20 bp, synthetic construct
  source 1..20: mol_type = other DNA
attagtaccggttggtttga

SEQ ID NO: 22998 - DNA, 20 bp, synthetic construct
  source 1..20: mol_type = other DNA
tcagctgttgctgtcgtggg

SEQ ID NO: 22999 - DNA, 20 bp, synthetic construct
  source 1..20: mol_type = other DNA
tatagtaacgagtcttggtt

SEQ ID NO: 23000 - DNA, 20 bp, synthetic construct
  source 1..20: mol_type = other DNA
tttaaaacatatgcttttga

SEQ ID NO: 23001 - DNA, 20 bp, synthetic construct
  source 1..20: mol_type = other DNA
attgaagaagttgaactttt

SEQ ID NO: 23002 - DNA, 20 bp, synthetic construct
  source 1..20: mol_type = other DNA
atttttgacattgagacagt

SEQ ID NO: 23003 - DNA, 20 bp, synthetic construct
  source 1..20: mol_type = other DNA
attgttttgtttactgactc

SEQ ID NO: 23004 - DNA, 20 bp, synthetic construct
  source 1..20: mol_type = other DNA
gttgtgccatccgaaaagga

SEQ ID NO: 23005 - DNA, 20 bp, synthetic construct
  source 1..20: mol_type = other DNA
ccccattttatttcacaagg

SEQ ID NO: 23006 - DNA, 20 bp, synthetic construct
  source 1..20: mol_type = other DNA
attatagtcagtgtcgaaca

SEQ ID NO: 23007 - DNA, 20 bp, synthetic construct
  source 1..20: mol_type = other DNA
ttgtactcagtagttttgct

SEQ ID NO: 23008 - DNA, 20 bp, synthetic construct
  source 1..20: mol_type = other DNA
gttgtgtggaagcatataac

SEQ ID NO: 23009 - DNA, 20 bp, synthetic construct
  source 1..20: mol_type = other DNA
gtgcaacgttcattttatgt

SEQ ID NO: 23010 - DNA, 20 bp, synthetic construct
  source 1..20: mol_type = other DNA
tgttataacacagcgcttat

SEQ ID NO: 23011 - DNA, 20 bp, synthetic construct
  source 1..20: mol_type = other DNA
tgttatgcctatttagcaaa

SEQ ID NO: 23012 - DNA, 20 bp, synthetic construct
  source 1..20: mol_type = other DNA
ggtgcgtgtggttcccctgg

SEQ ID NO: 23013 - DNA, 20 bp, synthetic construct
  source 1..20: mol_type = other DNA
attattgtggctgctattca

SEQ ID NO: 23014 - DNA, 20 bp, synthetic construct
  source 1..20: mol_type = other DNA
tgtacacattggtgcactta

SEQ ID NO: 23015 - DNA, 20 bp, synthetic construct
  source 1..20: mol_type = other DNA
aattcaaaggagtgggcata

SEQ ID NO: 23016 - DNA, 20 bp, synthetic construct
  source 1..20: mol_type = other DNA
gcattcatgtatgcatatgt

SEQ ID NO: 23017 - DNA, 20 bp, synthetic construct
  source 1..20: mol_type = other DNA
agaggtgctgttttgggtta

SEQ ID NO: 23018 - DNA, 20 bp, synthetic construct
  source 1..20: mol_type = other DNA
atgttgactaatggttctgg

SEQ ID NO: 23019 - DNA, 20 bp, synthetic construct
  source 1..20: mol_type = other DNA
gtcaagacttcaaaactttt

SEQ ID NO: 23020 - DNA, 20 bp, synthetic construct
  source 1..20: mol_type = other DNA
atgatcctaaattgatggga

SEQ ID NO: 23021 - DNA, 20 bp, synthetic construct
  source 1..20: mol_type = other DNA
tttttgtggatgacatcact

SEQ ID NO: 23022 - DNA, 20 bp, synthetic construct
  source 1..20: mol_type = other DNA
tggagtctttttctgttaca

SEQ ID NO: 23023 - DNA, 20 bp, synthetic construct
  source 1..20: mol_type = other DNA
gcactaagtgcgcctatgat

SEQ ID NO: 23024 - DNA, 20 bp, synthetic construct
  source 1..20: mol_type = other DNA
atgttagtgatgcttatgca

SEQ ID NO: 23025 - DNA, 20 bp, synthetic construct
  source 1..20: mol_type = other DNA
ctataggacccgatgtcttt

SEQ ID NO: 23026 - DNA, 20 bp, synthetic construct
  source 1..20: mol_type = other DNA
ataggcgtcaacttgatgtt

SEQ ID NO: 23027 - DNA, 20 bp, synthetic construct
  source 1..20: mol_type = other DNA
ctggtagtcatagtttgttc

SEQ ID NO: 23028 - DNA, 20 bp, synthetic construct
  source 1..20: mol_type = other DNA
ctaatgaaaatgccataaac

SEQ ID NO: 23029 - DNA, 20 bp, synthetic construct
  source 1..20: mol_type = other DNA
gttcatttgttggtgctgat

SEQ ID NO: 23030 - DNA, 20 bp, synthetic construct
  source 1..20: mol_type = other DNA
attttgtttctgtattgaag

SEQ ID NO: 23031 - DNA, 20 bp, synthetic construct
  source 1..20: mol_type = other DNA
ctttttggactatgttttgc

SEQ ID NO: 23032 - DNA, 20 bp, synthetic construct
  source 1..20: mol_type = other DNA
tttgttttgcttgttgcata

SEQ ID NO: 23033 - DNA, 20 bp, synthetic construct
  source 1..20: mol_type = other DNA
tcgctacctgtttatcataa

SEQ ID NO: 23034 - DNA, 20 bp, synthetic construct
  source 1..20: mol_type = other DNA
tacgttgctgtttatgccaa

SEQ ID NO: 23035 - DNA, 20 bp, synthetic construct
  source 1..20: mol_type = other DNA
agcgccaggctggagtctgc

SEQ ID NO: 23036 - DNA, 20 bp, synthetic construct
  source 1..20: mol_type = other DNA
agcaaacttgttacttctgg

SEQ ID NO: 23037 - DNA, 20 bp, synthetic construct
  source 1..20: mol_type = other DNA
gatgctattacacaaacttc

SEQ ID NO: 23038 - DNA, 20 bp, synthetic construct
  source 1..20: mol_type = other DNA
aattattatagaatcacatc

SEQ ID NO: 23039 - DNA, 20 bp, synthetic construct
  source 1..20: mol_type = other DNA
ccacatttaccaatcatata

SEQ ID NO: 23040 - DNA, 20 bp, synthetic construct
  source 1..20: mol_type = other DNA
ggacactataaatactccag

SEQ ID NO: 23041 - DNA, 20 bp, synthetic construct
  source 1..20: mol_type = other DNA
atgtacttcgcaaacagttt

SEQ ID NO: 23042 - DNA, 20 bp, synthetic construct
  source 1..20: mol_type = other DNA
tgtgcccaaagaccatccac

SEQ ID NO: 23043 - DNA, 20 bp, synthetic construct
  source 1..20: mol_type = other DNA
acaggtagtgacggaaagct

SEQ ID NO: 23044 - DNA, 20 bp, synthetic construct
  source 1..20: mol_type = other DNA
aagccagataggatcaacaa

SEQ ID NO: 23045 - DNA, 20 bp, synthetic construct
  source 1..20: mol_type = other DNA
aataaaccaccagaatctag

SEQ ID NO: 23046 - DNA, 20 bp, synthetic construct
  source 1..20: mol_type = other DNA
ttgcatgggatctggccgga

SEQ ID NO: 23047 - DNA, 20 bp, synthetic construct
  source 1..20: mol_type = other DNA
ttacgagcgctgagggattt

SEQ ID NO: 23048 - DNA, 20 bp, synthetic construct
  source 1..20: mol_type = other DNA
acatgtgtgaaaggtgaacc

SEQ ID NO: 23049 - DNA, 20 bp, synthetic construct
  source 1..20: mol_type = other DNA
ggcgttgtaatcagcacaga

SEQ ID NO: 23050 - DNA, 20 bp, synthetic construct
  source 1..20: mol_type = other DNA
gtgacctacatagttctaac

SEQ ID NO: 23051 - DNA, 20 bp, synthetic construct
  source 1..20: mol_type = other DNA
caatctggtgaaggggttta

SEQ ID NO: 23052 - DNA, 20 bp, synthetic construct
  source 1..20: mol_type = other DNA
tctgagtatggagttaaaac

SEQ ID NO: 23053 - DNA, 20 bp, synthetic construct
  source 1..20: mol_type = other DNA
gacagtctgatgattacaca

SEQ ID NO: 23054 - DNA, 20 bp, synthetic construct
  source 1..20: mol_type = other DNA
gaggtgactgatagttacga

SEQ ID NO: 23055 - DNA, 20 bp, synthetic construct
  source 1..20: mol_type = other DNA
acggaggggaaggagacaga

SEQ ID NO: 23056 - DNA, 20 bp, synthetic construct
  source 1..20: mol_type = other DNA
gaaccggctttggccactct

SEQ ID NO: 23057 - DNA, 20 bp, synthetic construct
  source 1..20: mol_type = other DNA
gaaataaagccagtgataag

SEQ ID NO: 23058 - DNA, 20 bp, synthetic construct
  source 1..20: mol_type = other DNA
cccttgtttgaagagctcct

SEQ ID NO: 23059 - DNA, 20 bp, synthetic construct
  source 1..20: mol_type = other DNA
ctgaaaaaaggcagaaacat

SEQ ID NO: 23060 - DNA, 20 bp, synthetic construct
  source 1..20: mol_type = other DNA
atacaaaagtactatttcaa

SEQ ID NO: 23061 - DNA, 20 bp, synthetic construct
  source 1..20: mol_type = other DNA
accatagcatatgagaaagc

SEQ ID NO: 23062 - DNA, 20 bp, synthetic construct
  source 1..20: mol_type = other DNA
ctaactcagcaatggctaac

SEQ ID NO: 23063 - DNA, 20 bp, synthetic construct
  source 1..20: mol_type = other DNA
ggactaagttcagatcaagt

SEQ ID NO: 23064 - DNA, 20 bp, synthetic construct
  source 1..20: mol_type = other DNA
agacagtcagttaccttcaa

SEQ ID NO: 23065 - DNA, 20 bp, synthetic construct
  source 1..20: mol_type = other DNA
gatccagcaatcagcaacag

SEQ ID NO: 23066 - DNA, 20 bp, synthetic construct
  source 1..20: mol_type = other DNA
tacctcttacctcatttctt

SEQ ID NO: 23067 - DNA, 20 bp, synthetic construct
  source 1..20: mol_type = other DNA
gtctgatcctgcaaaagact

SEQ ID NO: 23068 - DNA, 20 bp, synthetic construct
  source 1..20: mol_type = other DNA
agcagtgaaggaagaaccac

SEQ ID NO: 23069 - DNA, 20 bp, synthetic construct
  source 1..20: mol_type = other DNA
aagcccggataaaactgaga

SEQ ID NO: 23070 - DNA, 20 bp, synthetic construct
  source 1..20: mol_type = other DNA
tgttcgaggatcacccccct

SEQ ID NO: 23071 - DNA, 20 bp, synthetic construct
  source 1..20: mol_type = other DNA
cttcccgcacgacactgatc

SEQ ID NO: 23072 - DNA, 20 bp, synthetic construct
  source 1..20: mol_type = other DNA
tctaacaacaatctcccaca

SEQ ID NO: 23073 - DNA, 20 bp, synthetic construct
  source 1..20: mol_type = other DNA
ctctgttccctcaaagttac

SEQ ID NO: 23074 - DNA, 20 bp, synthetic construct
  source 1..20: mol_type = other DNA
atcagcaaacggctgtttgc

SEQ ID NO: 23075 - DNA, 20 bp, synthetic construct
  source 1..20: mol_type = other DNA
tcaggcattcggtggaaatt

SEQ ID NO: 23076 - DNA, 20 bp, synthetic construct
  source 1..20: mol_type = other DNA
gatttggtgcatatcattgg

SEQ ID NO: 23077 - DNA, 20 bp, synthetic construct
  source 1..20: mol_type = other DNA
gaatcttatctgcattttca

SEQ ID NO: 23078 - DNA, 20 bp, synthetic construct
  source 1..20: mol_type = other DNA
tacagatcagaagattcggt

SEQ ID NO: 23079 - DNA, 20 bp, synthetic construct
  source 1..20: mol_type = other DNA
tcttgaatatgcccctataa

SEQ ID NO: 23080 - DNA, 20 bp, synthetic construct
  source 1..20: mol_type = other DNA
aagaagattggttgacgttt

SEQ ID NO: 23081 - DNA, 20 bp, synthetic construct
  source 1..20: mol_type = other DNA
gcgtgcatgtcaagtcatag

SEQ ID NO: 23082 - DNA, 20 bp, synthetic construct
  source 1..20: mol_type = other DNA
aatggctatatttgctgaac

SEQ ID NO: 23083 - DNA, 20 bp, synthetic construct
  source 1..20: mol_type = other DNA
aaagaaagagatctgtgcaa

SEQ ID NO: 23084 - DNA, 20 bp, synthetic construct
  source 1..20: mol_type = other DNA
aatgtcaagatgttgctttt

SEQ ID NO: 23085 - DNA, 20 bp, synthetic construct
  source 1..20: mol_type = other DNA
gagaatgattgatcacagta

SEQ ID NO: 23086 - DNA, 20 bp, synthetic construct
  source 1..20: mol_type = other DNA
attgagatctcacatgtgga

SEQ ID NO: 23087 - DNA, 20 bp, synthetic construct
  source 1..20: mol_type = other DNA
attggatcaggtagatagag

SEQ ID NO: 23088 - DNA, 20 bp, synthetic construct
  source 1..20: mol_type = other DNA
tgaggaacttcatgatgtcc

SEQ ID NO: 23089 - DNA, 20 bp, synthetic construct
  source 1..20: mol_type = other DNA
agtttcaggaaatgttgtta

SEQ ID NO: 23090 - DNA, 20 bp, synthetic construct
  source 1..20: mol_type = other DNA
tttagtggcacgtaattatg

SEQ ID NO: 23091 - DNA, 20 bp, synthetic construct
  source 1..20: mol_type = other DNA
aaatttgttagatcagctac

SEQ ID NO: 23092 - DNA, 20 bp, synthetic construct
  source 1..20: mol_type = other DNA
cacattgaaccatgtgaata

SEQ ID NO: 23093 - DNA, 20 bp, synthetic construct
  source 1..20: mol_type = other DNA
tggtatattgtcatttatag

SEQ ID NO: 23094 - DNA, 20 bp, synthetic construct
  source 1..20: mol_type = other DNA
aattctttacgggaagagtc

SEQ ID NO: 23095 - DNA, 20 bp, synthetic construct
  source 1..20: mol_type = other DNA
aaagccaaatcctgagttat

SEQ ID NO: 23096 - DNA, 20 bp, synthetic construct
  source 1..20: mol_type = other DNA
tgcattcagacggcgtttag

SEQ ID NO: 23097 - DNA, 20 bp, synthetic construct
  source 1..20: mol_type = other DNA
atacaagatcactccggaga

SEQ ID NO: 23098 - DNA, 20 bp, synthetic construct
  source 1..20: mol_type = other DNA
catgttcatcccagccagtg

SEQ ID NO: 23099 - DNA, 20 bp, synthetic construct
  source 1..20: mol_type = other DNA
gagcgccgagcgttcagcac

SEQ ID NO: 23100 - DNA, 20 bp, synthetic construct
  source 1..20: mol_type = other DNA
ccatggatgtttccccgttc

SEQ ID NO: 23101 - DNA, 20 bp, synthetic construct
  source 1..20: mol_type = other DNA
gaattctcagattttatcac

SEQ ID NO: 23102 - DNA, 20 bp, synthetic construct
  source 1..20: mol_type = other DNA
tactctcatcaactgtgtat

SEQ ID NO: 23103 - DNA, 20 bp, synthetic construct
  source 1..20: mol_type = other DNA
ggagtggtttgctatttagc

SEQ ID NO: 23104 - DNA, 20 bp, synthetic construct
  source 1..20: mol_type = other DNA
ctaattccaggaggtagtgt

SEQ ID NO: 23105 - DNA, 20 bp, synthetic construct
  source 1..20: mol_type = other DNA
tctgtgacatcttcagtata

SEQ ID NO: 23106 - DNA, 20 bp, synthetic construct
  source 1..20: mol_type = other DNA
aacaatgccattgatcccac

SEQ ID NO: 23107 - DNA, 20 bp, synthetic construct
  source 1..20: mol_type = other DNA
caaccaatagaaagtatcct

SEQ ID NO: 23108 - DNA, 20 bp, synthetic construct
  source 1..20: mol_type = other DNA
acggtcgcattgcaattcgt

SEQ ID NO: 23109 - DNA, 20 bp, synthetic construct
  source 1..20: mol_type = other DNA
gacacatctacaatgttgac

SEQ ID NO: 23110 - DNA, 20 bp, synthetic construct
  source 1..20: mol_type = other DNA
agcttgccttattatagtcc

SEQ ID NO: 23111 - DNA, 20 bp, synthetic construct
  source 1..20: mol_type = other DNA
tttggacctgccgaattggc

SEQ ID NO: 23112 - DNA, 20 bp, synthetic construct
  source 1..20: mol_type = other DNA
tttgagccccaacgccttgg

SEQ ID NO: 23113 - DNA, 20 bp, synthetic construct
  source 1..20: mol_type = other DNA
tgccaatcggagggcgacag

SEQ ID NO: 23114 - DNA, 20 bp, synthetic construct
  source 1..20: mol_type = other DNA
ctaggggctaaggatgtcct

SEQ ID NO: 23115 - DNA, 20 bp, synthetic construct
  source 1..20: mol_type = other DNA
gacaatggcaggcaacatgg

SEQ ID NO: 23116 - DNA, 20 bp, synthetic construct
  source 1..20: mol_type = other DNA
agtcaaaatggcttcttcat

SEQ ID NO: 23117 - DNA, 20 bp, synthetic construct
  source 1..20: mol_type = other DNA
caattctggtacaatcgtga

SEQ ID NO: 23118 - DNA, 20 bp, synthetic construct
  source 1..20: mol_type = other DNA
tctctacccacaccagtttc

SEQ ID NO: 23119 - DNA, 20 bp, synthetic construct
  source 1..20: mol_type = other DNA
aaccatgaccataaccccca

SEQ ID NO: 23120 - DNA, 20 bp, synthetic construct
  source 1..20: mol_type = other DNA
gtttactgactttttgcagg

SEQ ID NO: 23121 - DNA, 20 bp, synthetic construct
  source 1..20: mol_type = other DNA
tttggctctcaattacaccc

SEQ ID NO: 23122 - DNA, 20 bp, synthetic construct
  source 1..20: mol_type = other DNA
ttctagctttaaatttgtta

SEQ ID NO: 23123 - DNA, 20 bp, synthetic construct
  source 1..20: mol_type = other DNA
gaacgcccgccccttgacgc

SEQ ID NO: 23124 - DNA, 20 bp, synthetic construct
  source 1..20: mol_type = other DNA
cgaatccaacccagggccta

SEQ ID NO: 23125 - DNA, 20 bp, synthetic construct
  source 1..20: mol_type = other DNA
ggacggtgaaccagaagttc

SEQ ID NO: 23126 - DNA, 20 bp, synthetic construct
  source 1..20: mol_type = other DNA
agacgaacagtataagacag

SEQ ID NO: 23127 - DNA, 20 bp, synthetic construct
  source 1..20: mol_type = other DNA
tttttctcttgtgatttatt

SEQ ID NO: 23128 - DNA, 20 bp, synthetic construct
  source 1..20: mol_type = other DNA
agtggatgtgattgatcaat

SEQ ID NO: 23129 - DNA, 20 bp, synthetic construct
  source 1..20: mol_type = other DNA
tcacggtacttacattggat

SEQ ID NO: 23130 - DNA, 20 bp, synthetic construct
  source 1..20: mol_type = other DNA
caatggacccatttcagagt

SEQ ID NO: 23131 - DNA, 20 bp, synthetic construct
  source 1..20: mol_type = other DNA
caactacgaggaaggtgacc

SEQ ID NO: 23132 - DNA, 20 bp, synthetic construct
  source 1..20: mol_type = other DNA
aaggctcttccgcccgtttg

SEQ ID NO: 23133 - DNA, 20 bp, synthetic construct
  source 1..20: mol_type = other DNA
ccgttaccctaaaattccct

SEQ ID NO: 23134 - DNA, 20 bp, synthetic construct
  source 1..20: mol_type = other DNA
acattcctgatacccttaat

SEQ ID NO: 23135 - DNA, 20 bp, synthetic construct
  source 1..20: mol_type = other DNA
tggtgggagacattggcaag

SEQ ID NO: 23136 - DNA, 20 bp, synthetic construct
  source 1..20: mol_type = other DNA
caaggaaacagcagggagct

SEQ ID NO: 23137 - DNA, 20 bp, synthetic construct
  source 1..20: mol_type = other DNA
tcaacccccccataccgcaa

SEQ ID NO: 23138 - DNA, 20 bp, synthetic construct
  source 1..20: mol_type = other DNA
ccaaaacccgccaaaaacga

SEQ ID NO: 23139 - DNA, 20 bp, synthetic construct
  source 1..20: mol_type = other DNA
atctgcttctgcatgatgca

SEQ ID NO: 23140 - DNA, 20 bp, synthetic construct
  source 1..20: mol_type = other DNA
cctatgtaatccgttatcac

SEQ ID NO: 23141 - DNA, 20 bp, synthetic construct
  source 1..20: mol_type = other DNA
ttgaaaggctctctatctta

SEQ ID NO: 23142 - DNA, 20 bp, synthetic construct
  source 1..20: mol_type = other DNA
aagcccccttcacaataatg

SEQ ID NO: 23143 - DNA, 20 bp, synthetic construct
  source 1..20: mol_type = other DNA
agttatcacccctgaacttg

SEQ ID NO: 23144 - DNA, 20 bp, synthetic construct
  source 1..20: mol_type = other DNA
aaaagcccttgataaggatg

SEQ ID NO: 23145 - DNA, 20 bp, synthetic construct
  source 1..20: mol_type = other DNA
tcctatgcccaatccattta

SEQ ID NO: 23146 - DNA, 20 bp, synthetic construct
  source 1..20: mol_type = other DNA
gaggttaattaaatgtggtg

SEQ ID NO: 23147 - DNA, 20 bp, synthetic construct
  source 1..20: mol_type = other DNA
atcttgttgtgttagaagtg

SEQ ID NO: 23148 - DNA, 20 bp, synthetic construct
  source 1..20: mol_type = other DNA
actaggagtgtcatccacag

SEQ ID NO: 23149 - DNA, 20 bp, synthetic construct
  source 1..20: mol_type = other DNA
tagtggagagaatcctccac

SEQ ID NO: 23150 - DNA, 20 bp, synthetic construct
  source 1..20: mol_type = other DNA
agttgcattcataatacata

SEQ ID NO: 23151 - DNA, 20 bp, synthetic construct
  source 1..20: mol_type = other DNA
tactcttcacaatgacggat

SEQ ID NO: 23152 - DNA, 20 bp, synthetic construct
  source 1..20: mol_type = other DNA
ggaggaagaactaggtgtga

SEQ ID NO: 23153 - DNA, 20 bp, synthetic construct
  source 1..20: mol_type = other DNA
caagaactggacaaatgaca

SEQ ID NO: 23154 - DNA, 20 bp, synthetic construct
  source 1..20: mol_type = other DNA
ggcaaacaataaacgagaca

SEQ ID NO: 23155 - DNA, 20 bp, synthetic construct
  source 1..20: mol_type = other DNA
tacaagcccacagaaattgg

SEQ ID NO: 23156 - DNA, 20 bp, synthetic construct
  source 1..20: mol_type = other DNA
attaccaacccaagtccaga

SEQ ID NO: 23157 - DNA, 20 bp, synthetic construct
  source 1..20: mol_type = other DNA
catggtagattcgatccatg

SEQ ID NO: 23158 - DNA, 20 bp, synthetic construct
  source 1..20: mol_type = other DNA
ggatgtaaatccacatatga

SEQ ID NO: 23159 - DNA, 20 bp, synthetic construct
  source 1..20: mol_type = other DNA
cccattagctctaaatcgta

SEQ ID NO: 23160 - DNA, 20 bp, synthetic construct
  source 1..20: mol_type = other DNA
atctgccacaaatttcctag

SEQ ID NO: 23161 - DNA, 20 bp, synthetic construct
  source 1..20: mol_type = other DNA
cagacaagaagtaatatcaa

SEQ ID NO: 23162 - DNA, 20 bp, synthetic construct
  source 1..20: mol_type = other DNA
ttcatcaaacttaatcactc

SEQ ID NO: 23163 - DNA, 20 bp, synthetic construct
  source 1..20: mol_type = other DNA
aaggggttatcagttatgct

SEQ ID NO: 23164 - DNA, 20 bp, synthetic construct
  source 1..20: mol_type = other DNA
tgtaggaagtgggataaaaa

SEQ ID NO: 23165 - DNA, 20 bp, synthetic construct
  source 1..20: mol_type = other DNA
tggtgaggatgtatataata

SEQ ID NO: 23166 - DNA, 20 bp, synthetic construct
  source 1..20: mol_type = other DNA
ttcaaatgggtattgggatg

SEQ ID NO: 23167 - DNA, 20 bp, synthetic construct
  source 1..20: mol_type = other DNA
tgccatacgtatcccttatt

SEQ ID NO: 23168 - DNA, 20 bp, synthetic construct
  source 1..20: mol_type = other DNA
cttgtgtagtttggcagaga

SEQ ID NO: 23169 - DNA, 20 bp, synthetic construct
  source 1..20: mol_type = other DNA
agtattaagagatacaatct

SEQ ID NO: 23170 - DNA, 20 bp, synthetic construct
  source 1..20: mol_type = other DNA
ggatggaccatgggtgtgat

SEQ ID NO: 23171 - DNA, 20 bp, synthetic construct
  source 1..20: mol_type = other DNA
ctaccatcatttgcaaccaa

SEQ ID NO: 23172 - DNA, 20 bp, synthetic construct
  source 1..20: mol_type = other DNA
atggccagcaaagaattctg

SEQ ID NO: 23173 - DNA, 20 bp, synthetic construct
  source 1..20: mol_type = other DNA
agtattgtgggctgcgctaa

SEQ ID NO: 23174 - DNA, 20 bp, synthetic construct
  source 1..20: mol_type = other DNA
caaggaactctgatcactac

SEQ ID NO: 23175 - DNA, 20 bp, synthetic construct
  source 1..20: mol_type = other DNA
cataaaacaattgtcgttgg

SEQ ID NO: 23176 - DNA, 20 bp, synthetic construct
  source 1..20: mol_type = other DNA
ccagatgatccagagacatt

SEQ ID NO: 23177 - DNA, 20 bp, synthetic construct
  source 1..20: mol_type = other DNA
ccccttaaattcaccatgga

SEQ ID NO: 23178 - DNA, 20 bp, synthetic construct
  source 1..20: mol_type = other DNA
atgctgcttggccttatgtt

SEQ ID NO: 23179 - DNA, 20 bp, synthetic construct
  source 1..20: mol_type = other DNA
gtgggaatgatagcaacaga

SEQ ID NO: 23180 - DNA, 20 bp, synthetic construct
  source 1..20: mol_type = other DNA
agaattacagcagcctccat

SEQ ID NO: 23181 - DNA, 20 bp, synthetic construct
  source 1..20: mol_type = other DNA
atggcaaaagtccttagagg

SEQ ID NO: 23182 - DNA, 20 bp, synthetic construct
  source 1..20: mol_type = other DNA
ttgaagcctgttgagaaagg

SEQ ID NO: 23183 - DNA, 20 bp, synthetic construct
  source 1..20: mol_type = other DNA
aaagtggcttcagatggcaa

SEQ ID NO: 23184 - DNA, 20 bp, synthetic construct
  source 1..20: mol_type = other DNA
cttcttactgtgatgcaagc

SEQ ID NO: 23185 - DNA, 20 bp, synthetic construct
  source 1..20: mol_type = other DNA
aaactggacacattgaatgg

SEQ ID NO: 23186 - DNA, 20 bp, synthetic construct
  source 1..20: mol_type = other DNA
gaaccatgggcaatgcttga

SEQ ID NO: 23187 - DNA, 20 bp, synthetic construct
  source 1..20: mol_type = other DNA
catgcggtctccagaggaac

SEQ ID NO: 23188 - DNA, 20 bp, synthetic construct
  source 1..20: mol_type = other DNA
atcaaggctgagaaatcagg

SEQ ID NO: 23189 - DNA, 20 bp, synthetic construct
  source 1..20: mol_type = other DNA
ttcatccaaaaagtaagatc

SEQ ID NO: 23190 - DNA, 20 bp, synthetic construct
  source 1..20: mol_type = other DNA
gcaacttttgaggacttcgg

SEQ ID NO: 23191 - DNA, 20 bp, synthetic construct
  source 1..20: mol_type = other DNA
ggctgtctagccaaggcgta

SEQ ID NO: 23192 - DNA, 20 bp, synthetic construct
  source 1..20: mol_type = other DNA
cctctgcattcttgtaaata

SEQ ID NO: 23193 - DNA, 20 bp, synthetic construct
  source 1..20: mol_type = other DNA
tcctccggactctgctaaac

SEQ ID NO: 23194 - DNA, 20 bp, synthetic construct
  source 1..20: mol_type = other DNA
acaggctaaaacgatcgctg

SEQ ID NO: 23195 - DNA, 20 bp, synthetic construct
  source 1..20: mol_type = other DNA
gcttcagtgatagaggctgg

SEQ ID NO: 23196 - DNA, 20 bp, synthetic construct
  source 1..20: mol_type = other DNA
ctagtaactcttaccatctc

SEQ ID NO: 23197 - DNA, 20 bp, synthetic construct
  source 1..20: mol_type = other DNA
actggtttctggaagatcag

SEQ ID NO: 23198 - DNA, 20 bp, synthetic construct
  source 1..20: mol_type = other DNA
ccacccaaggaggggtaaca

SEQ ID NO: 23199 - DNA, 20 bp, synthetic construct
  source 1..20: mol_type = other DNA
gagttctctctgtgatgttg

SEQ ID NO: 23200 - DNA, 20 bp, synthetic construct
  source 1..20: mol_type = other DNA
ttttggattccttgggcttt

SEQ ID NO: 23201 - DNA, 20 bp, synthetic construct
  source 1..20: mol_type = other DNA
gagcagccatttgcaaaaat

SEQ ID NO: 23202 - DNA, 20 bp, synthetic construct
  source 1..20: mol_type = other DNA
acatctgtgggaggaaaatc

SEQ ID NO: 23203 - DNA, 20 bp, synthetic construct
  source 1..20: mol_type = other DNA
cacaaccaaagacacttgaa

SEQ ID NO: 23204 - DNA, 20 bp, synthetic construct
  source 1..20: mol_type = other DNA
agatggaaagtgctctcaaa

SEQ ID NO: 23205 - DNA, 20 bp, synthetic construct
  source 1..20: mol_type = other DNA
gttatgaatggataacagac

SEQ ID NO: 23206 - DNA, 20 bp, synthetic construct
  source 1..20: mol_type = other DNA
tactcaccactgacatttcg

SEQ ID NO: 23207 - DNA, 20 bp, synthetic construct
  source 1..20: mol_type = other DNA
cagtggttagtggattaaca

SEQ ID NO: 23208 - DNA, 20 bp, synthetic construct
  source 1..20: mol_type = other DNA
gccgcggcggctggagctac

SEQ ID NO: 23209 - DNA, 20 bp, synthetic construct
  source 1..20: mol_type = other DNA
ccaggttttggaatatggtg

SEQ ID NO: 23210 - DNA, 20 bp, synthetic construct
  source 1..20: mol_type = other DNA
tggtaaacgcatgtgatgaa

SEQ ID NO: 23211 - DNA, 20 bp, synthetic construct
  source 1..20: mol_type = other DNA
tggtcgtcccctgcaggagt

SEQ ID NO: 23212 - DNA, 20 bp, synthetic construct
  source 1..20: mol_type = other DNA
ccagaggacaagacatgtgt

SEQ ID NO: 23213 - DNA, 20 bp, synthetic construct
  source 1..20: mol_type = other DNA
gagcaacttgggccaaactc

SEQ ID NO: 23214 - DNA, 20 bp, synthetic construct
  source 1..20: mol_type = other DNA
gtaagaggaacaccaggacc

SEQ ID NO: 23215 - DNA, 20 bp, synthetic construct
  source 1..20: mol_type = other DNA
tgctctatggatttgggaac

SEQ ID NO: 23216 - DNA, 20 bp, synthetic construct
  source 1..20: mol_type = other DNA
tgtgtaagcgaggtttcagt

SEQ ID NO: 23217 - DNA, 20 bp, synthetic construct
  source 1..20: mol_type = other DNA
atgaaatctccaagtccaac

SEQ ID NO: 23218 - DNA, 20 bp, synthetic construct
  source 1..20: mol_type = other DNA
agtacacaggtgaaggagcc

SEQ ID NO: 23219 - DNA, 20 bp, synthetic construct
  source 1..20: mol_type = other DNA
agctgacttgtggggatgga

SEQ ID NO: 23220 - DNA, 20 bp, synthetic construct
  source 1..20: mol_type = other DNA
ggaagccatggggtattatg

SEQ ID NO: 23221 - DNA, 20 bp, synthetic construct
  source 1..20: mol_type = other DNA
tgggggctgctgtggccaag

SEQ ID NO: 23222 - DNA, 20 bp, synthetic construct
  source 1..20: mol_type = other DNA
tagaagtcaagaagttgagc

SEQ ID NO: 23223 - DNA, 20 bp, synthetic construct
  source 1..20: mol_type = other DNA
aaaccgaacctgaagtgctg

SEQ ID NO: 23224 - DNA, 20 bp, synthetic construct
  source 1..20: mol_type = other DNA
agatggagcaggcactcaga

SEQ ID NO: 23225 - DNA, 20 bp, synthetic construct
  source 1..20: mol_type = other DNA
cagacccctctagcattgcg

SEQ ID NO: 23226 - DNA, 20 bp, synthetic construct
  source 1..20: mol_type = other DNA
gacgtcaagctgagtacgtc

SEQ ID NO: 23227 - DNA, 20 bp, synthetic construct
  source 1..20: mol_type = other DNA
taactgctggctcagcggtt

SEQ ID NO: 23228 - DNA, 20 bp, synthetic construct
  source 1..20: mol_type = other DNA
ccgctgttgtcgctaatgaa

SEQ ID NO: 23229 - DNA, 20 bp, synthetic construct
  source 1..20: mol_type = other DNA
acgaaattgacagagccgaa

SEQ ID NO: 23230 - DNA, 20 bp, synthetic construct
  source 1..20: mol_type = other DNA
atcatgttgtcaagcttctg

SEQ ID NO: 23231 - DNA, 20 bp, synthetic construct
  source 1..20: mol_type = other DNA
ttggcaaagctctgacatgg

SEQ ID NO: 23232 - DNA, 20 bp, synthetic construct
  source 1..20: mol_type = other DNA
atgaattggttggacggtca

SEQ ID NO: 23233 - DNA, 20 bp, synthetic construct
  source 1..20: mol_type = other DNA
gagcgcagtgggcaaaacta

SEQ ID NO: 23234 - DNA, 20 bp, synthetic construct
  source 1..20: mol_type = other DNA
gtcaccaaatatagatttgg

SEQ ID NO: 23235 - DNA, 20 bp, synthetic construct
  source 1..20: mol_type = other DNA
tttgcgtcttgatatgctgt

SEQ ID NO: 23236 - DNA, 20 bp, synthetic construct
  source 1..20: mol_type = other DNA
aaggacttgcccagaaaagg

SEQ ID NO: 23237 - DNA, 20 bp, synthetic construct
  source 1..20: mol_type = other DNA
ggtagaaccactggcagtga

SEQ ID NO: 23238 - DNA, 20 bp, synthetic construct
  source 1..20: mol_type = other DNA
aggagcttacacggaatatg

SEQ ID NO: 23239 - DNA, 20 bp, synthetic construct
  source 1..20: mol_type = other DNA
ttcaacatagaaccctggat

SEQ ID NO: 23240 - DNA, 20 bp, synthetic construct
  source 1..20: mol_type = other DNA
aacttctccttcgcaggtac

SEQ ID NO: 23241 - DNA, 20 bp, synthetic construct
  source 1..20: mol_type = other DNA
ctggtacttagggcattgag

SEQ ID NO: 23242 - DNA, 20 bp, synthetic construct
  source 1..20: mol_type = other DNA
gcactggcaaggagtaaaag

SEQ ID NO: 23243 - DNA, 20 bp, synthetic construct
  source 1..20: mol_type = other DNA
aagatacactggcgggcctt

SEQ ID NO: 23244 - DNA, 20 bp, synthetic construct
  source 1..20: mol_type = other DNA
caactagtctgccccatagg

SEQ ID NO: 23245 - DNA, 20 bp, synthetic construct
  source 1..20: mol_type = other DNA
aacagggaaggtgttgaaat

SEQ ID NO: 23246 - DNA, 20 bp, synthetic construct
  source 1..20: mol_type = other DNA
atctgtctataccactgctt

SEQ ID NO: 23247 - DNA, 20 bp, synthetic construct
  source 1..20: mol_type = other DNA
cccatgctcatccctttagt

SEQ ID NO: 23248 - DNA, 20 bp, synthetic construct
  source 1..20: mol_type = other DNA
gcagcagtgttccttataag

SEQ ID NO: 23249 - DNA, 20 bp, synthetic construct
  source 1..20: mol_type = other DNA
ctagcggactttgaagagag

SEQ ID NO: 23250 - DNA, 20 bp, synthetic construct
  source 1..20: mol_type = other DNA
gacttttgggcagagtcaag

SEQ ID NO: 23251 - DNA, 20 bp, synthetic construct
  source 1..20: mol_type = other DNA
aagaagatcacaagtcatga

SEQ ID NO: 23252 - DNA, 20 bp, synthetic construct
  source 1..20: mol_type = other DNA
aaggtagggaagaatgaagg

SEQ ID NO: 23253 - DNA, 20 bp, synthetic construct
  source 1..20: mol_type = other DNA
tcctatggatacttctgcca

SEQ ID NO: 23254 - DNA, 20 bp, synthetic construct
  source 1..20: mol_type = other DNA
gtcgagacagcaaagaaatt

SEQ ID NO: 23255 - DNA, 20 bp, synthetic construct
  source 1..20: mol_type = other DNA
taccattatgatctgctaca

SEQ ID NO: 23256 - DNA, 20 bp, synthetic construct
  source 1..20: mol_type = other DNA
tacatctatgccacggaaga

SEQ ID NO: 23257 - DNA, 20 bp, synthetic construct
  source 1..20: mol_type = other DNA
gcactatccaaaagacacat

SEQ ID NO: 23258 - DNA, 20 bp, synthetic construct
  source 1..20: mol_type = other DNA
actataaaaccgtgtttagg

SEQ ID NO: 23259 - DNA, 20 bp, synthetic construct
  source 1..20: mol_type = other DNA
gctacggatgacacaaagat

SEQ ID NO: 23260 - DNA, 20 bp, synthetic construct
  source 1..20: mol_type = other DNA
gttgtgagggcccaaacaga

SEQ ID NO: 23261 - DNA, 20 bp, synthetic construct
  source 1..20: mol_type = other DNA
gtgaagaaagaatgggatca

SEQ ID NO: 23262 - DNA, 20 bp, synthetic construct
  source 1..20: mol_type = other DNA
cccgtaagatgggctgacca

SEQ ID NO: 23263 - DNA, 20 bp, synthetic construct
  source 1..20: mol_type = other DNA
ctaagtatcactaagagacc

SEQ ID NO: 23264 - DNA, 20 bp, synthetic construct
  source 1..20: mol_type = other DNA
actttatgtaaatgcaaggc

SEQ ID NO: 23265 - DNA, 20 bp, synthetic construct
  source 1..20: mol_type = other DNA
caagtagagtagttagagtt

SEQ ID NO: 23266 - DNA, 20 bp, synthetic construct
  source 1..20: mol_type = other DNA
tgagatgctacgtggacgag

SEQ ID NO: 23267 - DNA, 20 bp, synthetic construct
  source 1..20: mol_type = other DNA
cctggctagggaagcaattg

SEQ ID NO: 23268 - DNA, 20 bp, synthetic construct
  source 1..20: mol_type = other DNA
tactaagggccataagggac

SEQ ID NO: 23269 - DNA, 20 bp, synthetic construct
  source 1..20: mol_type = other DNA
ggacgtgcatgagaggtgaa

SEQ ID NO: 23270 - DNA, 20 bp, synthetic construct
  source 1..20: mol_type = other DNA
gtggagtcgtgatcagcaaa

SEQ ID NO: 23271 - DNA, 20 bp, synthetic construct
  source 1..20: mol_type = other DNA
tggttgtctacatgatcctg

SEQ ID NO: 23272 - DNA, 20 bp, synthetic construct
  source 1..20: mol_type = other DNA
tctttcatgctatgaccaac

SEQ ID NO: 23273 - DNA, 20 bp, synthetic construct
  source 1..20: mol_type = other DNA
ccacataccctttgataata

SEQ ID NO: 23274 - DNA, 20 bp, synthetic construct
  source 1..20: mol_type = other DNA
aagccgtatatctgttcccc

SEQ ID NO: 23275 - DNA, 20 bp, synthetic construct
  source 1..20: mol_type = other DNA
atgaggaagaggtctatggg

SEQ ID NO: 23276 - DNA, 20 bp, synthetic construct
  source 1..20: mol_type = other DNA
gagtgaaaacggactcaggt

SEQ ID NO: 23277 - DNA, 20 bp, synthetic construct
  source 1..20: mol_type = other DNA
gaggggagtttaagcagatc

SEQ ID NO: 23278 - DNA, 20 bp, synthetic construct
  source 1..20: mol_type = other DNA
taggaaaaattcacaggttt

SEQ ID NO: 23279 - DNA, 20 bp, synthetic construct
  source 1..20: mol_type = other DNA
tgatcacgcaactagaaatc

SEQ ID NO: 23280 - DNA, 20 bp, synthetic construct
  source 1..20: mol_type = other DNA
acagctatgacagctattcg

SEQ ID NO: 23281 - DNA, 20 bp, synthetic construct
  source 1..20: mol_type = other DNA
aagaaactgagctaaaagaa

SEQ ID NO: 23282 - DNA, 20 bp, synthetic construct
  source 1..20: mol_type = other DNA
ctgcaaccgacttagttgta

SEQ ID NO: 23283 - DNA, 20 bp, synthetic construct
  source 1..20: mol_type = other DNA
ttgcttgtctgccctacgct

SEQ ID NO: 23284 - DNA, 20 bp, synthetic construct
  source 1..20: mol_type = other DNA
gagtcgtcaccaggtgcaga

SEQ ID NO: 23285 - DNA, 20 bp, synthetic construct
  source 1..20: mol_type = other DNA
gggatgaacccaaccacaaa

SEQ ID NO: 23286 - DNA, 20 bp, synthetic construct
  source 1..20: mol_type = other DNA
tcccggaacgaactgtaaca

SEQ ID NO: 23287 - DNA, 20 bp, synthetic construct
  source 1..20: mol_type = other DNA
ccaaaaatatgaccaccggg

SEQ ID NO: 23288 - DNA, 20 bp, synthetic construct
  source 1..20: mol_type = other DNA
tggtgataggttccaataag

SEQ ID NO: 23289 - DNA, 20 bp, synthetic construct
  source 1..20: mol_type = other DNA
aagaacttctgctacagtgc

SEQ ID NO: 23290 - DNA, 20 bp, synthetic construct
  source 1..20: mol_type = other DNA
agcttatagaagagtacaac

SEQ ID NO: 23291 - DNA, 20 bp, synthetic construct
  source 1..20: mol_type = other DNA
gaagacctatcaagtattac

SEQ ID NO: 23292 - DNA, 20 bp, synthetic construct
  source 1..20: mol_type = other DNA
caggaaaggtctacttgcaa

SEQ ID NO: 23293 - DNA, 20 bp, synthetic construct
  source 1..20: mol_type = other DNA
tcgtgctgtcgcgcatgctg

SEQ ID NO: 23294 - DNA, 20 bp, synthetic construct
  source 1..20: mol_type = other DNA
acatgggagagtggtgtgaa

SEQ ID NO: 23295 - DNA, 20 bp, synthetic construct
  source 1..20: mol_type = other DNA
tcctcttggcgttgagtcta

SEQ ID NO: 23296 - DNA, 20 bp, synthetic construct
  source 1..20: mol_type = other DNA
acatttttcaggaaagcccg

SEQ ID NO: 23297 - DNA, 20 bp, synthetic construct
  source 1..20: mol_type = other DNA
ttggattcatccctaagatg

SEQ ID NO: 23298 - DNA, 20 bp, synthetic construct
  source 1..20: mol_type = other DNA
gctgtggagaagggcttgtt

SEQ ID NO: 23299 - DNA, 20 bp, synthetic construct
  source 1..20: mol_type = other DNA
ctccggaactcaacttggtg

SEQ ID NO: 23300 - DNA, 20 bp, synthetic construct
  source 1..20: mol_type = other DNA
ccgtgaagaatggaaaagcc

SEQ ID NO: 23301 - DNA, 20 bp, synthetic construct
  source 1..20: mol_type = other DNA
tccacttggaattgggacca

SEQ ID NO: 23302 - DNA, 20 bp, synthetic construct
  source 1..20: mol_type = other DNA
gtgaggtaagcttgaaggtc

SEQ ID NO: 23303 - DNA, 20 bp, synthetic construct
  source 1..20: mol_type = other DNA
aatgccagccaggaaagctg

SEQ ID NO: 23304 - DNA, 20 bp, synthetic construct
  source 1..20: mol_type = other DNA
aggtggccataatggatgag

SEQ ID NO: 23305 - DNA, 20 bp, synthetic construct
  source 1..20: mol_type = other DNA
aacccattcccgaaggagag

SEQ ID NO: 23306 - DNA, 20 bp, synthetic construct
  source 1..20: mol_type = other DNA
aacgcagagggcgagttgga

SEQ ID NO: 23307 - DNA, 20 bp, synthetic construct
  source 1..20: mol_type = other DNA
atggtccaggcggcgaactg

SEQ ID NO: 23308 - DNA, 20 bp, synthetic construct
  source 1..20: mol_type = other DNA
gagaggataaccgactggcc

SEQ ID NO: 23309 - DNA, 20 bp, synthetic construct
  source 1..20: mol_type = other DNA
ctgcccgatcctggggaact

SEQ ID NO: 23310 - DNA, 20 bp, synthetic construct
  source 1..20: mol_type = other DNA
tggcactcggtgtgacctct

SEQ ID NO: 23311 - DNA, 20 bp, synthetic construct
  source 1..20: mol_type = other DNA
agatcatcaaccccattccg

SEQ ID NO: 23312 - DNA, 20 bp, synthetic construct
  source 1..20: mol_type = other DNA
actcatgcaccaaagaagaa

SEQ ID NO: 23313 - DNA, 20 bp, synthetic construct
  source 1..20: mol_type = other DNA
ggagagaccagaggggatca

SEQ ID NO: 23314 - DNA, 20 bp, synthetic construct
  source 1..20: mol_type = other DNA
gagaccttcgcacccttggt

SEQ ID NO: 23315 - DNA, 20 bp, synthetic construct
  source 1..20: mol_type = other DNA
cccccgagcataactcggga

SEQ ID NO: 23316 - DNA, 20 bp, synthetic construct
  source 1..20: mol_type = other DNA
gggatttttccgcctcctat

SEQ ID NO: 23317 - DNA, 20 bp, synthetic construct
  source 1..20: mol_type = other DNA
ttgcgggtccaaatgccaaa

SEQ ID NO: 23318 - DNA, 20 bp, synthetic construct
  source 1..20: mol_type = other DNA
gtaggcctgcaccgccgagg

SEQ ID NO: 23319 - DNA, 20 bp, synthetic construct
  source 1..20: mol_type = other DNA
ggcacttgtgtcattcttgc

SEQ ID NO: 23320 - DNA, 20 bp, synthetic construct
  source 1..20: mol_type = other DNA
tccaggcgctccgtgctgat

SEQ ID NO: 23321 - DNA, 20 bp, synthetic construct
  source 1..20: mol_type = other DNA
gacctgaaccatcagtggtt

SEQ ID NO: 23322 - DNA, 20 bp, synthetic construct
  source 1..20: mol_type = other DNA
gacacagagcgaatggagct

SEQ ID NO: 23323 - DNA, 20 bp, synthetic construct
  source 1..20: mol_type = other DNA
atggccatgtggagaagctc

SEQ ID NO: 23324 - DNA, 20 bp, synthetic construct
  source 1..20: mol_type = other DNA
gcgtcggtgagaagcactac

SEQ ID NO: 23325 - DNA, 20 bp, synthetic construct
  source 1..20: mol_type = other DNA
gtagcagtcggtctggtgtt

SEQ ID NO: 23326 - DNA, 20 bp, synthetic construct
  source 1..20: mol_type = other DNA
ggcattccagtgaagggtct

SEQ ID NO: 23327 - DNA, 20 bp, synthetic construct
  source 1..20: mol_type = other DNA
accatttcggagatgcttgg

SEQ ID NO: 23328 - DNA, 20 bp, synthetic construct
  source 1..20: mol_type = other DNA
gtgctacacaccatgtggca

SEQ ID NO: 23329 - DNA, 20 bp, synthetic construct
  source 1..20: mol_type = other DNA
gtcagcagcatagcacaggg

SEQ ID NO: 23330 - DNA, 20 bp, synthetic construct
  source 1..20: mol_type = other DNA
gggagacaaaactgggaggt

SEQ ID NO: 23331 - DNA, 20 bp, synthetic construct
  source 1..20: mol_type = other DNA
atagccagtgaggagagaca

SEQ ID NO: 23332 - DNA, 20 bp, synthetic construct
  source 1..20: mol_type = other DNA
tttgacaaggagtactcaag

SEQ ID NO: 23333 - DNA, 20 bp, synthetic construct
  source 1..20: mol_type = other DNA
accgcgtctgctgcacagcg

SEQ ID NO: 23334 - DNA, 20 bp, synthetic construct
  source 1..20: mol_type = other DNA
ctgggagttgtctggtgttt

SEQ ID NO: 23335 - DNA, 20 bp, synthetic construct
  source 1..20: mol_type = other DNA
aatttggacatccagccggc

SEQ ID NO: 23336 - DNA, 20 bp, synthetic construct
  source 1..20: mol_type = other DNA
atgcagttgctgagacctga

SEQ ID NO: 23337 - DNA, 20 bp, synthetic construct
  source 1..20: mol_type = other DNA
gcaggcatggatgtgttctc

SEQ ID NO: 23338 - DNA, 20 bp, synthetic construct
  source 1..20: mol_type = other DNA
gctccttatcgtcccgaggt

SEQ ID NO: 23339 - DNA, 20 bp, synthetic construct
  source 1..20: mol_type = other DNA
agctacttccacaggaggga

SEQ ID NO: 23340 - DNA, 20 bp, synthetic construct
  source 1..20: mol_type = other DNA
caacacacaagaaaaatggt

SEQ ID NO: 23341 - DNA, 20 bp, synthetic construct
  source 1..20: mol_type = other DNA
caggccacgaagggtatttg

SEQ ID NO: 23342 - DNA, 20 bp, synthetic construct
  source 1..20: mol_type = other DNA
acccctgtaagtagttgatc

SEQ ID NO: 23343 - DNA, 20 bp, synthetic construct
  source 1..20: mol_type = other DNA
gaaaagttttgaaacttttc

SEQ ID NO: 23344 - DNA, 20 bp, synthetic construct
  source 1..20: mol_type = other DNA
ccgcagagaacttgcaatcg

SEQ ID NO: 23345 - DNA, 20 bp, synthetic construct
  source 1..20: mol_type = other DNA
taacaatagaaccatcggaa

SEQ ID NO: 23346 - DNA, 20 bp, synthetic construct
  source 1..20: mol_type = other DNA
agcaaagtgtttttaacgcc

SEQ ID NO: 23347 - DNA, 20 bp, synthetic construct
  source 1..20: mol_type = other DNA
ttgaaacagcgtgtgaagga

SEQ ID NO: 23348 - DNA, 20 bp, synthetic construct
  source 1..20: mol_type = other DNA
gtatttttgtaaatatagct

SEQ ID NO: 23349 - DNA, 20 bp, synthetic construct
  source 1..20: mol_type = other DNA
atagtccattagtaagtaag

SEQ ID NO: 23350 - DNA, 20 bp, synthetic construct
  source 1..20: mol_type = other DNA
cctccccaactaccatttgg

SEQ ID NO: 23351 - DNA, 20 bp, synthetic construct
  source 1..20: mol_type = other DNA
tcaatgaagggtgggtaggc

SEQ ID NO: 23352 - DNA, 20 bp, synthetic construct
  source 1..20: mol_type = other DNA
caaccctaagtgtaatagcg

SEQ ID NO: 23353 - DNA, 20 bp, synthetic construct
  source 1..20: mol_type = other DNA
tgcgtataactctggtatca

SEQ ID NO: 23354 - DNA, 20 bp, synthetic construct
  source 1..20: mol_type = other DNA
ttgaatcggatttgaaaaat

SEQ ID NO: 23355 - DNA, 20 bp, synthetic construct
  source 1..20: mol_type = other DNA
gcttcccaagtggaagagtt

SEQ ID NO: 23356 - DNA, 20 bp, synthetic construct
  source 1..20: mol_type = other DNA
tcggatcgactgaagaagat

SEQ ID NO: 23357 - DNA, 20 bp, synthetic construct
  source 1..20: mol_type = other DNA
aggataaagatgcgactgtg

SEQ ID NO: 23358 - DNA, 20 bp, synthetic construct
  source 1..20: mol_type = other DNA
agaagtaagaaaattcctag

SEQ ID NO: 23359 - DNA, 20 bp, synthetic construct
  source 1..20: mol_type = other DNA
acgaatctcaaacctagttt

SEQ ID NO: 23360 - DNA, 20 bp, synthetic construct
  source 1..20: mol_type = other DNA
tatgacaagttagatggttt

SEQ ID NO: 23361 - DNA, 20 bp, synthetic construct
  source 1..20: mol_type = other DNA
ccgcatgttcaactcgacat

SEQ ID NO: 23362 - DNA, 20 bp, synthetic construct
  source 1..20: mol_type = other DNA
cagaaaggttctgatatctt

SEQ ID NO: 23363 - DNA, 20 bp, synthetic construct
  source 1..20: mol_type = other DNA
ggtaatgttgatggtgtaga

SEQ ID NO: 23364 - DNA, 20 bp, synthetic construct
  source 1..20: mol_type = other DNA
gatactctgtggtcaactgc

SEQ ID NO: 23365 - DNA, 20 bp, synthetic construct
  source 1..20: mol_type = other DNA
agacctgaaatcaaccctct

SEQ ID NO: 23366 - DNA, 20 bp, synthetic construct
  source 1..20: mol_type = other DNA
gagtgccctaacagcaccgg

SEQ ID NO: 23367 - DNA, 20 bp, synthetic construct
  source 1..20: mol_type = other DNA
gcgtaattcactcactaccg

SEQ ID NO: 23368 - DNA, 20 bp, synthetic construct
  source 1..20: mol_type = other DNA
tgagttcgcaagaatctctt

SEQ ID NO: 23369 - DNA, 20 bp, synthetic construct
  source 1..20: mol_type = other DNA
caaaagtacactatcttatc

SEQ ID NO: 23370 - DNA, 20 bp, synthetic construct
  source 1..20: mol_type = other DNA
atctgcatgggagtattcac

SEQ ID NO: 23371 - DNA, 20 bp, synthetic construct
  source 1..20: mol_type = other DNA
agctcataaaacaagagctt

SEQ ID NO: 23372 - DNA, 20 bp, synthetic construct
  source 1..20: mol_type = other DNA
tgcttatttaaaaagaagtt

SEQ ID NO: 23373 - DNA, 20 bp, synthetic construct
  source 1..20: mol_type = other DNA
ctggttttacatcttttagt

SEQ ID NO: 23374 - DNA, 20 bp, synthetic construct
  source 1..20: mol_type = other DNA
atgaatacgtctatcgtgta

SEQ ID NO: 23375 - DNA, 20 bp, synthetic construct
  source 1..20: mol_type = other DNA
ttcttgattcttcctgaggg

SEQ ID NO: 23376 - DNA, 20 bp, synthetic construct
  source 1..20: mol_type = other DNA
ttaagattcttgacctcaca

SEQ ID NO: 23377 - DNA, 20 bp, synthetic construct
  source 1..20: mol_type = other DNA
cacaaagtggccctgttatg

SEQ ID NO: 23378 - DNA, 20 bp, synthetic construct
  source 1..20: mol_type = other DNA
ttacaatgagctttatgaga

SEQ ID NO: 23379 - DNA, 20 bp, synthetic construct
  source 1..20: mol_type = other DNA
caaaacacatggaaaatgct

SEQ ID NO: 23380 - DNA, 20 bp, synthetic construct
  source 1..20: mol_type = other DNA
attttggtgatgctaaaata

SEQ ID NO: 23381 - DNA, 20 bp, synthetic construct
  source 1..20: mol_type = other DNA
attgttatactttcgtggaa

SEQ ID NO: 23382 - DNA, 20 bp, synthetic construct
  source 1..20: mol_type = other DNA
ggatacctggagaagactat

SEQ ID NO: 23383 - DNA, 20 bp, synthetic construct
  source 1..20: mol_type = other DNA
cgagacaagggaagatattg

SEQ ID NO: 23384 - DNA, 20 bp, synthetic construct
  source 1..20: mol_type = other DNA
tagaccatatttccgtgggg

SEQ ID NO: 23385 - DNA, 20 bp, synthetic construct
  source 1..20: mol_type = other DNA
acattgtaactaatgtattc

SEQ ID NO: 23386 - DNA, 20 bp, synthetic construct
  source 1..20: mol_type = other DNA
tttcaggttatgagtagttt

SEQ ID NO: 23387 - DNA, 20 bp, synthetic construct
  source 1..20: mol_type = other DNA
ccttatgcattccatggaca

SEQ ID NO: 23388 - DNA, 20 bp, synthetic construct
  source 1..20: mol_type = other DNA
catttacctttcctcaaatc

SEQ ID NO: 23389 - DNA, 20 bp, synthetic construct
  source 1..20: mol_type = other DNA
aagggagtcgcagagttcca

SEQ ID NO: 23390 - DNA, 20 bp, synthetic construct
  source 1..20: mol_type = other DNA
tccatctttatcggtacgcc

SEQ ID NO: 23391 - DNA, 20 bp, synthetic construct
  source 1..20: mol_type = other DNA
tgagctcctttagagggagg

SEQ ID NO: 23392 - DNA, 20 bp, synthetic construct
  source 1..20: mol_type = other DNA
caaccaacaacatcaactcc

SEQ ID NO: 23393 - DNA, 20 bp, synthetic construct
  source 1..20: mol_type = other DNA
tggaaaactctctaccgaca

SEQ ID NO: 23394 - DNA, 20 bp, synthetic construct
  source 1..20: mol_type = other DNA
ttatggcaggaaaatctctg

SEQ ID NO: 23395 - DNA, 20 bp, synthetic construct
  source 1..20: mol_type = other DNA
aagttggcaaagaacttgaa

SEQ ID NO: 23396 - DNA, 20 bp, synthetic construct
  source 1..20: mol_type = other DNA
gtcgtgcatatcagtggcta

SEQ ID NO: 23397 - DNA, 20 bp, synthetic construct
  source 1..20: mol_type = other DNA
atatcaaagataccatgagt

SEQ ID NO: 23398 - DNA, 20 bp, synthetic construct
  source 1..20: mol_type = other DNA
ttatttacgaaatgctaaac

SEQ ID NO: 23399 - DNA, 20 bp, synthetic construct
  source 1..20: mol_type = other DNA
aattgtatacagccaatttc

SEQ ID NO: 23400 - DNA, 20 bp, synthetic construct
  source 1..20: mol_type = other DNA
aagcagagagaacgcaagag

SEQ ID NO: 23401 - DNA, 20 bp, synthetic construct
  source 1..20: mol_type = other DNA
ctgcagtgacgaccacagtt

SEQ ID NO: 23402 - DNA, 20 bp, synthetic construct
  source 1..20: mol_type = other DNA
cacttcagtaggggctgtac

SEQ ID NO: 23403 - DNA, 20 bp, synthetic construct
  source 1..20: mol_type = other DNA
agcggattacccctagtggt

SEQ ID NO: 23404 - DNA, 20 bp, synthetic construct
  source 1..20: mol_type = other DNA
catgggggcagtctcgttat

SEQ ID NO: 23405 - DNA, 20 bp, synthetic construct
  source 1..20: mol_type = other DNA
tactcgacttggattttcag

SEQ ID NO: 23406 - DNA, 20 bp, synthetic construct
  source 1..20: mol_type = other DNA
tctcacctgttaattgggtt

SEQ ID NO: 23407 - DNA, 20 bp, synthetic construct
  source 1..20: mol_type = other DNA
aaggcgcctacacacaggat

SEQ ID NO: 23408 - DNA, 20 bp, synthetic construct
  source 1..20: mol_type = other DNA
ccggacttggttctctcttc

SEQ ID NO: 23409 - DNA, 20 bp, synthetic construct
  source 1..20: mol_type = other DNA
caggccctgacattgagttg

SEQ ID NO: 23410 - DNA, 20 bp, synthetic construct
  source 1..20: mol_type = other DNA
ctcttctttcattgcttgct

SEQ ID NO: 23411 - DNA, 20 bp, synthetic construct
  source 1..20: mol_type = other DNA
agattttggtgcggcttttg

SEQ ID NO: 23412 - DNA, 20 bp, synthetic construct
  source 1..20: mol_type = other DNA
tctggaaaattgctgagaat

SEQ ID NO: 23413 - DNA, 20 bp, synthetic construct
  source 1..20: mol_type = other DNA
tgaaacaaatcacggcagtt

SEQ ID NO: 23414 - DNA, 20 bp, synthetic construct
  source 1..20: mol_type = other DNA
agctctcattagtgaaaacc

SEQ ID NO: 23415 - DNA, 20 bp, synthetic construct
  source 1..20: mol_type = other DNA
tgcatggcacattcaaggtt

SEQ ID NO: 23416 - DNA, 20 bp, synthetic construct
  source 1..20: mol_type = other DNA
atcccagtcccttgaatggt

SEQ ID NO: 23417 - DNA, 20 bp, synthetic construct
  source 1..20: mol_type = other DNA
aaccgcaagcaattgcctgt

SEQ ID NO: 23418 - DNA, 20 bp, synthetic construct
  source 1..20: mol_type = other DNA
tgctcgtaatgagagcacat

SEQ ID NO: 23419 - DNA, 20 bp, synthetic construct
  source 1..20: mol_type = other DNA
ctactgctgtgaagaatgtc

SEQ ID NO: 23420 - DNA, 20 bp, synthetic construct
  source 1..20: mol_type = other DNA
tgcgagcagactctactagc

SEQ ID NO: 23421 - DNA, 20 bp, synthetic construct
  source 1..20: mol_type = other DNA
tatgactttgagtcattggg

SEQ ID NO: 23422 - DNA, 20 bp, synthetic construct
  source 1..20: mol_type = other DNA
cctcattcacaatcacacgg

SEQ ID NO: 23423 - DNA, 20 bp, synthetic construct
  source 1..20: mol_type = other DNA
gctgcgccaaaaacgcgcga

SEQ ID NO: 23424 - DNA, 20 bp, synthetic construct
  source 1..20: mol_type = other DNA
tcccctgtggacatgcatgt

SEQ ID NO: 23425 - DNA, 20 bp, synthetic construct
  source 1..20: mol_type = other DNA
ttcttctccgacttggagtt

SEQ ID NO: 23426 - DNA, 20 bp, synthetic construct
  source 1..20: mol_type = other DNA
tctatattgctgacatctga

SEQ ID NO: 23427 - DNA, 20 bp, synthetic construct
  source 1..20: mol_type = other DNA
tttaaacttgcaacactggc

SEQ ID NO: 23428 - DNA, 20 bp, synthetic construct
  source 1..20: mol_type = other DNA
aaaggcctcttttccctgct

SEQ ID NO: 23429 - DNA, 20 bp, synthetic construct
  source 1..20: mol_type = other DNA
tcccctgttgttatttgtac

SEQ ID NO: 23430 - DNA, 20 bp, synthetic construct
  source 1..20: mol_type = other DNA
tcgtggtctgacttgtttaa

SEQ ID NO: 23431 - DNA, 20 bp, synthetic construct
  source 1..20: mol_type = other DNA
cctgcccgcatcattggcat

SEQ ID NO: 23432 - DNA, 20 bp, synthetic construct
  source 1..20: mol_type = other DNA
cgggtctttgcccgtattgg

SEQ ID NO: 23433 - DNA, 20 bp, synthetic construct
  source 1..20: mol_type = other DNA
tttgtggcaaagtttcatga

SEQ ID NO: 23434 - DNA, 20 bp, synthetic construct
  source 1..20: mol_type = other DNA
attcttgcagctatgatgaa

SEQ ID NO: 23435 - DNA, 20 bp, synthetic construct
  source 1..20: mol_type = other DNA
gaaccagaacagtatgagcg

SEQ ID NO: 23436 - DNA, 20 bp, synthetic construct
  source 1..20: mol_type = other DNA
ttacgtttcagcttgcacag

SEQ ID NO: 23437 - DNA, 20 bp, synthetic construct
  source 1..20: mol_type = other DNA
ctgatttcctgcaagtagct

SEQ ID NO: 23438 - DNA, 20 bp, synthetic construct
  source 1..20: mol_type = other DNA
ttcagtacacccagtataga

SEQ ID NO: 23439 - DNA, 20 bp, synthetic construct
  source 1..20: mol_type = other DNA
acataacagcagaatttgtg

SEQ ID NO: 23440 - DNA, 20 bp, synthetic construct
  source 1..20: mol_type = other DNA
gggatgttgaacttaacccc

SEQ ID NO: 23441 - DNA, 20 bp, synthetic construct
  source 1..20: mol_type = other DNA
agtccgaagatggagaaccg

SEQ ID NO: 23442 - DNA, 20 bp, synthetic construct
  source 1..20: mol_type = other DNA
aggggatttcctccactctc

SEQ ID NO: 23443 - DNA, 20 bp, synthetic construct
  source 1..20: mol_type = other DNA
ttagcgcagatgatcagtat

SEQ ID NO: 23444 - DNA, 20 bp, synthetic construct
  source 1..20: mol_type = other DNA
cttttcattttaaggaaact

SEQ ID NO: 23445 - DNA, 20 bp, synthetic construct
  source 1..20: mol_type = other DNA
tggaggcagtggatgtaatt

SEQ ID NO: 23446 - DNA, 20 bp, synthetic construct
  source 1..20: mol_type = other DNA
gcgacgtggaaccagccgtc

SEQ ID NO: 23447 - DNA, 20 bp, synthetic construct
  source 1..20: mol_type = other DNA
gtactgacaatggaatcatt

SEQ ID NO: 23448 - DNA, 20 bp, synthetic construct
  source 1..20: mol_type = other DNA
ctaacaatggattaggcatt

SEQ ID NO: 23449 - DNA, 20 bp, synthetic construct
  source 1..20: mol_type = other DNA
gcggctggccgtctgtactt

SEQ ID NO: 23450 - DNA, 20 bp, synthetic construct
  source 1..20: mol_type = other DNA
caacactggagtgatcaatt

SEQ ID NO: 23451 - DNA, 20 bp, synthetic construct
  source 1..20: mol_type = other DNA
gtttgtgacccttagggccc

SEQ ID NO: 23452 - DNA, 20 bp, synthetic construct
  source 1..20: mol_type = other DNA
cacttttgatgatacagata

SEQ ID NO: 23453 - DNA, 20 bp, synthetic construct
  source 1..20: mol_type = other DNA
ccactgtccctgggctattg

SEQ ID NO: 23454 - DNA, 20 bp, synthetic construct
  source 1..20: mol_type = other DNA
taacgcaccaatgccaacca

SEQ ID NO: 23455 - DNA, 20 bp, synthetic construct
  source 1..20: mol_type = other DNA
aaacatggattctccacttc

SEQ ID NO: 23456 - DNA, 20 bp, synthetic construct
  source 1..20: mol_type = other DNA
tgacccgcaatacttgcggt

SEQ ID NO: 23457 - DNA, 20 bp, synthetic construct
  source 1..20: mol_type = other DNA
ccctgatgaactgaaccctt

SEQ ID NO: 23458 - DNA, 20 bp, synthetic construct
  source 1..20: mol_type = other DNA
catgtttcctgaatttgacc

SEQ ID NO: 23459 - DNA, 20 bp, synthetic construct
  source 1..20: mol_type = other DNA
agccaatatggaaatggaaa

SEQ ID NO: 23460 - DNA, 20 bp, synthetic construct
  source 1..20: mol_type = other DNA
cagttatatctggtctggtg

SEQ ID NO: 23461 - DNA, 20 bp, synthetic construct
  source 1..20: mol_type = other DNA
agatggtgccataggtgcag

SEQ ID NO: 23462 - DNA, 20 bp, synthetic construct
  source 1..20: mol_type = other DNA
aggatcagctgttggagtta

SEQ ID NO: 23463 - DNA, 20 bp, synthetic construct
  source 1..20: mol_type = other DNA
ttcctatattgattctctct

SEQ ID NO: 23464 - DNA, 20 bp, synthetic construct
  source 1..20: mol_type = other DNA
tagtctcgtgcgaccagtca

SEQ ID NO: 23465 - DNA, 20 bp, synthetic construct
  source 1..20: mol_type = other DNA
gctggatatgaaatccccag

SEQ ID NO: 23466 - DNA, 20 bp, synthetic construct
  source 1..20: mol_type = other DNA
ctgatagggtcgcggctggc

SEQ ID NO: 23467 - DNA, 20 bp, synthetic construct
  source 1..20: mol_type = other DNA
ctcagacatgattatgaaag

SEQ ID NO: 23468 - DNA, 20 bp, synthetic construct
  source 1..20: mol_type = other DNA
taattcttgcataacaacac

SEQ ID NO: 23469 - DNA, 20 bp, synthetic construct
  source 1..20: mol_type = other DNA
tgcatataccccacctggtg

SEQ ID NO: 23470 - DNA, 20 bp, synthetic construct
  source 1..20: mol_type = other DNA
atgggtaactgtattccagc

SEQ ID NO: 23471 - DNA, 20 bp, synthetic construct
  source 1..20: mol_type = other DNA
agcctcatttagaataccat

SEQ ID NO: 23472 - DNA, 20 bp, synthetic construct
  source 1..20: mol_type = other DNA
gaccaaatgggctaactatt

SEQ ID NO: 23473 - DNA, 20 bp, synthetic construct
  source 1..20: mol_type = other DNA
ctttactacttacttaaagg

SEQ ID NO: 23474 - DNA, 20 bp, synthetic construct
  source 1..20: mol_type = other DNA
accgttaaccgcccacctac

SEQ ID NO: 23475 - DNA, 20 bp, synthetic construct
  source 1..20: mol_type = other DNA
tctttaatcaatcttatggt

SEQ ID NO: 23476 - DNA, 20 bp, synthetic construct
  source 1..20: mol_type = other DNA
taatatcaattattatagag

SEQ ID NO: 23477 - DNA, 20 bp, synthetic construct
  source 1..20: mol_type = other DNA
ggtgtctaatgctgataggg

SEQ ID NO: 23478 - DNA, 20 bp, synthetic construct
  source 1..20: mol_type = other DNA
ccaagggctgccagtactca

SEQ ID NO: 23479 - DNA, 20 bp, synthetic construct
  source 1..20: mol_type = other DNA
gatttcgcaagacggatttc

SEQ ID NO: 23480 - DNA, 20 bp, synthetic construct
  source 1..20: mol_type = other DNA
gaacataaagactgttacca

SEQ ID NO: 23481 - DNA, 20 bp, synthetic construct
  source 1..20: mol_type = other DNA
ccgagattattgcagacgaa

SEQ ID NO: 23482 - DNA, 20 bp, synthetic construct
  source 1..20: mol_type = other DNA
tagggttcttggcatacatg

SEQ ID NO: 23483 - DNA, 20 bp, synthetic construct
  source 1..20: mol_type = other DNA
gatgatagcatatggtgatg

SEQ ID NO: 23484 - DNA, 20 bp, synthetic construct
  source 1..20: mol_type = other DNA
agatgagagatttcctttcc

SEQ ID NO: 23485 - DNA, 20 bp, synthetic construct
  source 1..20: mol_type = other DNA
cacagaaccatcctaaccat

SEQ ID NO: 23486 - DNA, 20 bp, synthetic construct
  source 1..20: mol_type = other DNA
gtgtatccgtcttggcacac

SEQ ID NO: 23487 - DNA, 20 bp, synthetic construct
  source 1..20: mol_type = other DNA
tattgatcagcgtgagtgga

SEQ ID NO: 23488 - DNA, 20 bp, synthetic construct
  source 1..20: mol_type = other DNA
ggcagggggtctcatagcag

SEQ ID NO: 23489 - DNA, 20 bp, synthetic construct
  source 1..20: mol_type = other DNA
cattgtcaatttggctaatt

SEQ ID NO: 23490 - DNA, 20 bp, synthetic construct
  source 1..20: mol_type = other DNA
gccaggcactcagatctggt

SEQ ID NO: 23491 - DNA, 20 bp, synthetic construct
  source 1..20: mol_type = other DNA
gtccctctggccttatgcaa

SEQ ID NO: 23492 - DNA, 20 bp, synthetic construct
  source 1..20: mol_type = other DNA
ccaactgtatcgtggttctc

SEQ ID NO: 23493 - DNA, 20 bp, synthetic construct
  source 1..20: mol_type = other DNA
acgcatagataggacactca

SEQ ID NO: 23494 - DNA, 20 bp, synthetic construct
  source 1..20: mol_type = other DNA
caactcaccattcattatag

SEQ ID NO: 23495 - DNA, 20 bp, synthetic construct
  source 1..20: mol_type = other DNA
caatcacttttctactgagg

SEQ ID NO: 23496 - DNA, 20 bp, synthetic construct
  source 1..20: mol_type = other DNA
caagaccagagccatagagg

SEQ ID NO: 23497 - DNA, 20 bp, synthetic construct
  source 1..20: mol_type = other DNA
tgtccatggttctatgccat

SEQ ID NO: 23498 - DNA, 20 bp, synthetic construct
  source 1..20: mol_type = other DNA
tatttctgaggagactgttt

SEQ ID NO: 23499 - DNA, 20 bp, synthetic construct
  source 1..20: mol_type = other DNA
tccaacttacaaagagctgg

SEQ ID NO: 23500 - DNA, 20 bp, synthetic construct
  source 1..20: mol_type = other DNA
tttccgcctgcctggtcgtt

SEQ ID NO: 23501 - DNA, 20 bp, synthetic construct
  source 1..20: mol_type = other DNA
acaggctaaggatgcccttc

SEQ ID NO: 23502 - DNA, 20 bp, synthetic construct
  source 1..20: mol_type = other DNA
acctttcttcgactgggtct

SEQ ID NO: 23503 - DNA, 20 bp, synthetic construct
  source 1..20: mol_type = other DNA
ggtatgcatggttgacggta

SEQ ID NO: 23504 - DNA, 20 bp, synthetic construct
  source 1..20: mol_type = other DNA
ggaccgcatcctcaccacga

SEQ ID NO: 23505 - DNA, 20 bp, synthetic construct
  source 1..20: mol_type = other DNA
aatctacggacatgtgtaca

SEQ ID NO: 23506 - DNA, 20 bp, synthetic construct
  source 1..20: mol_type = other DNA
tgcagcacactgttaccatt

SEQ ID NO: 23507 - DNA, 20 bp, synthetic construct
  source 1..20: mol_type = other DNA
tctccttgaccgcagcacac

SEQ ID NO: 23508 - DNA, 20 bp, synthetic construct
  source 1..20: mol_type = other DNA
cggtgcgccacgcacaaccc

SEQ ID NO: 23509 - DNA, 20 bp, synthetic construct
  source 1..20: mol_type = other DNA
ggcgcggaaatactcttccg

SEQ ID NO: 23510 - DNA, 20 bp, synthetic construct
  source 1..20: mol_type = other DNA
ccggttggtgaccgcatttg

SEQ ID NO: 23511 - DNA, 20 bp, synthetic construct
  source 1..20: mol_type = other DNA
gcgtgatctcaatgatccgt

SEQ ID NO: 23512 - DNA, 20 bp, synthetic construct
  source 1..20: mol_type = other DNA
tggccaaggtaaaagtttcc

SEQ ID NO: 23513 - DNA, 20 bp, synthetic construct
  source 1..20: mol_type = other DNA
cttcaagtacttcgcccaaa

SEQ ID NO: 23514 - DNA, 20 bp, synthetic construct
  source 1..20: mol_type = other DNA
tcaaccaccaattctcaacg

SEQ ID NO: 23515 - DNA, 20 bp, synthetic construct
  source 1..20: mol_type = other DNA
accatacgaggggccagtga

SEQ ID NO: 23516 - DNA, 20 bp, synthetic construct
  source 1..20: mol_type = other DNA
accacaccacgaggggttaa

SEQ ID NO: 23517 - DNA, 20 bp, synthetic construct
  source 1..20: mol_type = other DNA
ccattttgcccagtacaaaa

SEQ ID NO: 23518 - DNA, 20 bp, synthetic construct
  source 1..20: mol_type = other DNA
tgattacgatctggactttg

SEQ ID NO: 23519 - DNA, 20 bp, synthetic construct
  source 1..20: mol_type = other DNA
gcgttgggtgaacgccgtgt

SEQ ID NO: 23520 - DNA, 20 bp, synthetic construct
  source 1..20: mol_type = other DNA
ctaaaggagctgtggctata

SEQ ID NO: 23521 - DNA, 20 bp, synthetic construct
  source 1..20: mol_type = other DNA
tgtgtgtcgatttcaacaat

SEQ ID NO: 23522 - DNA, 20 bp, synthetic construct
  source 1..20: mol_type = other DNA
aagtttgtggattcatgggg

SEQ ID NO: 23523 - DNA, 20 bp, synthetic construct
  source 1..20: mol_type = other DNA
tgacaacattccttaaacat

SEQ ID NO: 23524 - DNA, 20 bp, synthetic construct
  source 1..20: mol_type = other DNA
taactttaattggtcttgat

SEQ ID NO: 23525 - DNA, 20 bp, synthetic construct
  source 1..20: mol_type = other DNA
actgggttgattgtaacact

SEQ ID NO: 23526 - DNA, 20 bp, synthetic construct
  source 1..20: mol_type = other DNA
taataacgtcaattgtctca

SEQ ID NO: 23527 - DNA, 20 bp, synthetic construct
  source 1..20: mol_type = other DNA
atggcactctcaccacccaa

SEQ ID NO: 23528 - DNA, 20 bp, synthetic construct
  source 1..20: mol_type = other DNA
tgggtgagaacccttccttt

SEQ ID NO: 23529 - DNA, 20 bp, synthetic construct
  source 1..20: mol_type = other DNA
gttgtgaattgttctcaatt

SEQ ID NO: 23530 - DNA, 20 bp, synthetic construct
  source 1..20: mol_type = other DNA
tagttgtggaaacagtttgt

SEQ ID NO: 23531 - DNA, 20 bp, synthetic construct
  source 1..20: mol_type = other DNA
gggaaattggagacttattt

SEQ ID NO: 23532 - DNA, 20 bp, synthetic construct
  source 1..20: mol_type = other DNA
atgaacaggtgctacatgct

SEQ ID NO: 23533 - DNA, 20 bp, synthetic construct
  source 1..20: mol_type = other DNA
agaagttcaaatgggttcaa

SEQ ID NO: 23534 - DNA, 20 bp, synthetic construct
  source 1..20: mol_type = other DNA
acaccaatgagagatcaaat

SEQ ID NO: 23535 - DNA, 20 bp, synthetic construct
  source 1..20: mol_type = other DNA
tttccgcctacttggtcgtc

SEQ ID NO: 23536 - DNA, 20 bp, synthetic construct
  source 1..20: mol_type = other DNA
gttctaccgtcgttcccgac

SEQ ID NO: 23537 - DNA, 20 bp, synthetic construct
  source 1..20: mol_type = other DNA
tagcggagcatggtggccgt

SEQ ID NO: 23538 - DNA, 20 bp, synthetic construct
  source 1..20: mol_type = other DNA
atgcccttcaggtaccccga

SEQ ID NO: 23539 - DNA, 20 bp, synthetic construct
  source 1..20: mol_type = other DNA
tctgctatacgctctcagag

SEQ ID NO: 23540 - DNA, 20 bp, synthetic construct
  source 1..20: mol_type = other DNA
cctcgaatgggtctacgact

SEQ ID NO: 23541 - DNA, 20 bp, synthetic construct
  source 1..20: mol_type = other DNA
cgatcaagaaccattcaacg

SEQ ID NO: 23542 - DNA, 20 bp, synthetic construct
  source 1..20: mol_type = other DNA
cagtgacccgtttgggcggt

SEQ ID NO: 23543 - DNA, 20 bp, synthetic construct
  source 1..20: mol_type = other DNA
gctagctagtgctggcaaag

SEQ ID NO: 23544 - DNA, 20 bp, synthetic construct
  source 1..20: mol_type = other DNA
cgtgaaagtcaagccaaagg

SEQ ID NO: 23545 - DNA, 20 bp, synthetic construct
  source 1..20: mol_type = other DNA
actggacaacactaccaacc

SEQ ID NO: 23546 - DNA, 20 bp, synthetic construct
  source 1..20: mol_type = other DNA
caccttcgtggtaaagaaga

SEQ ID NO: 23547 - DNA, 20 bp, synthetic construct
  source 1..20: mol_type = other DNA
tgacatcaacgacatatttg

SEQ ID NO: 23548 - DNA, 20 bp, synthetic construct
  source 1..20: mol_type = other DNA
atacaaggaggccaaggaat

SEQ ID NO: 23549 - DNA, 20 bp, synthetic construct
  source 1..20: mol_type = other DNA
gaacgttctcgcgcaggcaa

SEQ ID NO: 23550 - DNA, 20 bp, synthetic construct
  source 1..20: mol_type = other DNA
atccaccacggggttcatcc

SEQ ID NO: 23551 - DNA, 20 bp, synthetic construct
  source 1..20: mol_type = other DNA
agacgggtacaagatcaaca

SEQ ID NO: 23552 - DNA, 20 bp, synthetic construct
  source 1..20: mol_type = other DNA
cgacgtaactcttggcgacg

SEQ ID NO: 23553 - DNA, 20 bp, synthetic construct
  source 1..20: mol_type = other DNA
cgacaagatcatgttggacg

SEQ ID NO: 23554 - DNA, 20 bp, synthetic construct
  source 1..20: mol_type = other DNA
gaagggaacccccgtcgtcg

SEQ ID NO: 23555 - DNA, 20 bp, synthetic construct
  source 1..20: mol_type = other DNA
ccacgtgatgcgcaaaacca

SEQ ID NO: 23556 - DNA, 20 bp, synthetic construct
  source 1..20: mol_type = other DNA
cgccctgatcgacttcgaaa

SEQ ID NO: 23557 - DNA, 20 bp, synthetic construct
  source 1..20: mol_type = other DNA
acacattctctacaccagaa

SEQ ID NO: 23558 - DNA, 20 bp, synthetic construct
  source 1..20: mol_type = other DNA
aagcatcatcaacacaattt

SEQ ID NO: 23559 - DNA, 20 bp, synthetic construct
  source 1..20: mol_type = other DNA
gtgcggctccggtccctgga

SEQ ID NO: 23560 - DNA, 20 bp, synthetic construct
  source 1..20: mol_type = other DNA
ggaggttctctaccaggagt

SEQ ID NO: 23561 - DNA, 20 bp, synthetic construct
  source 1..20: mol_type = other DNA
ccttcttttttcctttcttt

SEQ ID NO: 23562 - DNA, 20 bp, synthetic construct
  source 1..20: mol_type = other DNA
cggtgtgggttctcttcagc

SEQ ID NO: 23563 - DNA, 20 bp, synthetic construct
  source 1..20: mol_type = other DNA
tacagtatgagtgtgttact

SEQ ID NO: 23564 - DNA, 20 bp, synthetic construct
  source 1..20: mol_type = other DNA
caacactgtggctgaaatgg

SEQ ID NO: 23565 - DNA, 20 bp, synthetic construct
  source 1..20: mol_type = other DNA
tgaagctaaagggaacaact

SEQ ID NO: 23566 - DNA, 20 bp, synthetic construct
  source 1..20: mol_type = other DNA
gaagtttgattacatcaaat

SEQ ID NO: 23567 - DNA, 20 bp, synthetic construct
  source 1..20: mol_type = other DNA
aggacccagaaacattcctg

SEQ ID NO: 23568 - DNA, 20 bp, synthetic construct
  source 1..20: mol_type = other DNA
atgaagtgaatggaactgtg

SEQ ID NO: 23569 - DNA, 20 bp, synthetic construct
  source 1..20: mol_type = other DNA
aacaaaacaagtgtccctgg

SEQ ID NO: 23570 - DNA, 20 bp, synthetic construct
  source 1..20: mol_type = other DNA
aagggaattggggaccttcc

SEQ ID NO: 23571 - DNA, 20 bp, synthetic construct
  source 1..20: mol_type = other DNA
ctgggtttgctgtagggttc

SEQ ID NO: 23572 - DNA, 20 bp, synthetic construct
  source 1..20: mol_type = other DNA
gacagagttatctctatgtc

SEQ ID NO: 23573 - DNA, 20 bp, synthetic construct
  source 1..20: mol_type = other DNA
ttcttttctttctttttcag

SEQ ID NO: 23574 - DNA, 20 bp, synthetic construct
  source 1..20: mol_type = other DNA
gaagtctgattgatgtgatg

SEQ ID NO: 23575 - DNA, 20 bp, synthetic construct
  source 1..20: mol_type = other DNA
ggattgcgaaaaccttaagg

SEQ ID NO: 23576 - DNA, 20 bp, synthetic construct
  source 1..20: mol_type = other DNA
aagatttggctgggttcata

SEQ ID NO: 23577 - DNA, 20 bp, synthetic construct
  source 1..20: mol_type = other DNA
ttttgatatcatttattttg

SEQ ID NO: 23578 - DNA, 20 bp, synthetic construct
  source 1..20: mol_type = other DNA
ctcaaactagtcctagtgtg

SEQ ID NO: 23579 - DNA, 20 bp, synthetic construct
  source 1..20: mol_type = other DNA
gaaaggagagtgcaatggaa

SEQ ID NO: 23580 - DNA, 20 bp, synthetic construct
  source 1..20: mol_type = other DNA
tgtggaaaccttcagcaggt

SEQ ID NO: 23581 - DNA, 20 bp, synthetic construct
  source 1..20: mol_type = other DNA
ctgcttgtttagctaaggca

SEQ ID NO: 23582 - DNA, 20 bp, synthetic construct
  source 1..20: mol_type = other DNA
gctcaatgggtgtgacgacc

SEQ ID NO: 23583 - DNA, 20 bp, synthetic construct
  source 1..20: mol_type = other DNA
catctctggtatcaaatttc

SEQ ID NO: 23584 - DNA, 20 bp, synthetic construct
  source 1..20: mol_type = other DNA
ccaaactagcatcaactata

SEQ ID NO: 23585 - DNA, 20 bp, synthetic construct
  source 1..20: mol_type = other DNA
acacagaactattttcagca

SEQ ID NO: 23586 - DNA, 20 bp, synthetic construct
  source 1..20: mol_type = other DNA
cttggagctgggacccaagt

SEQ ID NO: 23587 - DNA, 20 bp, synthetic construct
  source 1..20: mol_type = other DNA
aaattgagaatcccagacaa

SEQ ID NO: 23588 - DNA, 20 bp, synthetic construct
  source 1..20: mol_type = other DNA
atgctggaataacaccagca

SEQ ID NO: 23589 - DNA, 20 bp, synthetic construct
  source 1..20: mol_type = other DNA
gctacaaaggagtaagctgt

SEQ ID NO: 23590 - DNA, 20 bp, synthetic construct
  source 1..20: mol_type = other DNA
ccatgcaaatatgaagtgcg

SEQ ID NO: 23591 - DNA, 20 bp, synthetic construct
  source 1..20: mol_type = other DNA
actaataaactatatgaaac

SEQ ID NO: 23592 - DNA, 20 bp, synthetic construct
  source 1..20: mol_type = other DNA
attgaaggatggtgtcaaaa

SEQ ID NO: 23593 - DNA, 20 bp, synthetic construct
  source 1..20: mol_type = other DNA
cgcttagcagtaaaaatgct

SEQ ID NO: 23594 - DNA, 20 bp, synthetic construct
  source 1..20: mol_type = other DNA
atcaatagaacagcagttac

SEQ ID NO: 23595 - DNA, 20 bp, synthetic construct
  source 1..20: mol_type = other DNA
ttactcaacaagatctgtct

SEQ ID NO: 23596 - DNA, 20 bp, synthetic construct
  source 1..20: mol_type = other DNA
ttatgtagttggggatctca

SEQ ID NO: 23597 - DNA, 20 bp, synthetic construct
  source 1..20: mol_type = other DNA
gaaggagcaggaaattggat

SEQ ID NO: 23598 - DNA, 20 bp, synthetic construct
  source 1..20: mol_type = other DNA
attgggaagatcaaggaaac

SEQ ID NO: 23599 - DNA, 20 bp, synthetic construct
  source 1..20: mol_type = other DNA
tttctctcatttgcgagttt

SEQ ID NO: 23600 - DNA, 20 bp, synthetic construct
  source 1..20: mol_type = other DNA
ttcttgattaaatatttact

SEQ ID NO: 23601 - DNA, 20 bp, synthetic construct
  source 1..20: mol_type = other DNA
cctttggcccgaacagccaa

SEQ ID NO: 23602 - DNA, 20 bp, synthetic construct
  source 1..20: mol_type = other DNA
gatcatctggaggatgatcc

SEQ ID NO: 23603 - DNA, 20 bp, synthetic construct
  source 1..20: mol_type = other DNA
acgaccgccaatcgaagact

SEQ ID NO: 23604 - DNA, 20 bp, synthetic construct
  source 1..20: mol_type = other DNA
gtaccagatgctgtgcaaga

SEQ ID NO: 23605 - DNA, 20 bp, synthetic construct
  source 1..20: mol_type = other DNA
tgctcttcgtcctgggctct

SEQ ID NO: 23606 - DNA, 20 bp, synthetic construct
  source 1..20: mol_type = other DNA
atttcgttcaggtgtgcctc

SEQ ID NO: 23607 - DNA, 20 bp, synthetic construct
  source 1..20: mol_type = other DNA
gatcagagcccggcgggaac

SEQ ID NO: 23608 - DNA, 20 bp, synthetic construct
  source 1..20: mol_type = other DNA
gcgaacccaatgacaaccac

SEQ ID NO: 23609 - DNA, 20 bp, synthetic construct
  source 1..20: mol_type = other DNA
tccgcccagagcccacagac

SEQ ID NO: 23610 - DNA, 20 bp, synthetic construct
  source 1..20: mol_type = other DNA
acaggaccaagctgattctg

SEQ ID NO: 23611 - DNA, 20 bp, synthetic construct
  source 1..20: mol_type = other DNA
cttggggagacaaaaagagg

SEQ ID NO: 23612 - DNA, 20 bp, synthetic construct
  source 1..20: mol_type = other DNA
tcaaaacaaatgactttgct

SEQ ID NO: 23613 - DNA, 20 bp, synthetic construct
  source 1..20: mol_type = other DNA
tatcacgttaaagatttaga

SEQ ID NO: 23614 - DNA, 20 bp, synthetic construct
  source 1..20: mol_type = other DNA
tgggcggcttccatttttac

SEQ ID NO: 23615 - DNA, 20 bp, synthetic construct
  source 1..20: mol_type = other DNA
tcatgatgcagcctttcttg

SEQ ID NO: 23616 - DNA, 20 bp, synthetic construct
  source 1..20: mol_type = other DNA
aagggtgccggaacaatttc

SEQ ID NO: 23617 - DNA, 20 bp, synthetic construct
  source 1..20: mol_type = other DNA
aaccgtattgtctgtttttc

SEQ ID NO: 23618 - DNA, 20 bp, synthetic construct
  source 1..20: mol_type = other DNA
caggacaccgagtggtaaac

SEQ ID NO: 23619 - DNA, 20 bp, synthetic construct
  source 1..20: mol_type = other DNA
tgatatagaaggaatattat

SEQ ID NO: 23620 - DNA, 20 bp, synthetic construct
  source 1..20: mol_type = other DNA
tgttatcagagatgctttgc

SEQ ID NO: 23621 - DNA, 20 bp, synthetic construct
  source 1..20: mol_type = other DNA
gtcgtcagttattagacatt

SEQ ID NO: 23622 - DNA, 20 bp, synthetic construct
  source 1..20: mol_type = other DNA
gtataaaataaatttaatta

SEQ ID NO: 23623 - DNA, 20 bp, synthetic construct
  source 1..20: mol_type = other DNA
aagatttgtgtcttaattag

SEQ ID NO: 23624 - DNA, 20 bp, synthetic construct
  source 1..20: mol_type = other DNA
gttgacattgacgttcacca

SEQ ID NO: 23625 - DNA, 20 bp, synthetic construct
  source 1..20: mol_type = other DNA
agaacagtgttgaccctaac

SEQ ID NO: 23626 - DNA, 20 bp, synthetic construct
  source 1..20: mol_type = other DNA
aatggtgtgtgctgctaatc

SEQ ID NO: 23627 - DNA, 20 bp, synthetic construct
  source 1..20: mol_type = other DNA
agcttcgaaaggtaccgggc

SEQ ID NO: 23628 - DNA, 20 bp, synthetic construct
  source 1..20: mol_type = other DNA
tgcttattcttactgtaatg

SEQ ID NO: 23629 - DNA, 20 bp, synthetic construct
  source 1..20: mol_type = other DNA
caaatcctgataatatcatg

SEQ ID NO: 23630 - DNA, 20 bp, synthetic construct
  source 1..20: mol_type = other DNA
atttaacttactatgatact

SEQ ID NO: 23631 - DNA, 20 bp, synthetic construct
  source 1..20: mol_type = other DNA
atatttcatagggagtgaag

SEQ ID NO: 23632 - DNA, 20 bp, synthetic construct
  source 1..20: mol_type = other DNA
aatgatcgatccagtttata

SEQ ID NO: 23633 - DNA, 20 bp, synthetic construct
  source 1..20: mol_type = other DNA
attcaacttagttgatgatg

SEQ ID NO: 23634 - DNA, 20 bp, synthetic construct
  source 1..20: mol_type = other DNA
caagggtggtacatcatctg

SEQ ID NO: 23635 - DNA, 20 bp, synthetic construct
  source 1..20: mol_type = other DNA
tgttaggttattaagttcaa

SEQ ID NO: 23636 - DNA, 20 bp, synthetic construct
  source 1..20: mol_type = other DNA
agtgtacaagacgttagatg

SEQ ID NO: 23637 - DNA, 20 bp, synthetic construct
  source 1..20: mol_type = other DNA
cataacatccagcttgtcaa

SEQ ID NO: 23638 - DNA, 20 bp, synthetic construct
  source 1..20: mol_type = other DNA
catattcaaacccaaaacag

SEQ ID NO: 23639 - DNA, 20 bp, synthetic construct
  source 1..20: mol_type = other DNA
ataaattaaagttatttgaa

SEQ ID NO: 23640 - DNA, 20 bp, synthetic construct
  source 1..20: mol_type = other DNA
cctcatattacttcaaaaaa

SEQ ID NO: 23641 - DNA, 20 bp, synthetic construct
  source 1..20: mol_type = other DNA
cacggtacagaagcctaatt

SEQ ID NO: 23642 - DNA, 20 bp, synthetic construct
  source 1..20: mol_type = other DNA
tgactattgatggaactaca

SEQ ID NO: 23643 - DNA, 20 bp, synthetic construct
  source 1..20: mol_type = other DNA
gagtgtatattaaagaccca

SEQ ID NO: 23644 - DNA, 20 bp, synthetic construct
  source 1..20: mol_type = other DNA
cagcgagaaggatatcttcg

SEQ ID NO: 23645 - DNA, 20 bp, synthetic construct
  source 1..20: mol_type = other DNA
tgactttgttaacgccatca

SEQ ID NO: 23646 - DNA, 20 bp, synthetic construct
  source 1..20: mol_type = other DNA
aattaacaggattcgtgaga

SEQ ID NO: 23647 - DNA, 20 bp, synthetic construct
  source 1..20: mol_type = other DNA
taagcaaaatatcgctggat

SEQ ID NO: 23648 - DNA, 20 bp, synthetic construct
  source 1..20: mol_type = other DNA
taaaccgtaagtaaattatc

SEQ ID NO: 23649 - DNA, 20 bp, synthetic construct
  source 1..20: mol_type = other DNA
caacgcagaggtggtgtttg

SEQ ID NO: 23650 - DNA, 20 bp, synthetic construct
  source 1..20: mol_type = other DNA
cagttgaatgttgaagtcaa

SEQ ID NO: 23651 - DNA, 20 bp, synthetic construct
  source 1..20: mol_type = other DNA
ggatcacgttatatgtctgc

SEQ ID NO: 23652 - DNA, 20 bp, synthetic construct
  source 1..20: mol_type = other DNA
gttattgttaatgaaagcac

SEQ ID NO: 23653 - DNA, 20 bp, synthetic construct
  source 1..20: mol_type = other DNA
attctcatctcagaatgaga

SEQ ID NO: 23654 - DNA, 20 bp, synthetic construct
  source 1..20: mol_type = other DNA
cattagtgcgtgtttatcac

SEQ ID NO: 23655 - DNA, 20 bp, synthetic construct
  source 1..20: mol_type = other DNA
gctattgtgggcttgtcggg

SEQ ID NO: 23656 - DNA, 20 bp, synthetic construct
  source 1..20: mol_type = other DNA
ttctcgccacagacatgggg

SEQ ID NO: 23657 - DNA, 20 bp, synthetic construct
  source 1..20: mol_type = other DNA
tgtcgattccagtgcatgct

SEQ ID NO: 23658 - DNA, 20 bp, synthetic construct
  source 1..20: mol_type = other DNA
ggttcattgtcataacagtg

SEQ ID NO: 23659 - DNA, 20 bp, synthetic construct
  source 1..20: mol_type = other DNA
atcgaaaaacggcatctttt

SEQ ID NO: 23660 - DNA, 20 bp, synthetic construct
  source 1..20: mol_type = other DNA
acatagagggcagtaagtac

SEQ ID NO: 23661 - DNA, 20 bp, synthetic construct
  source 1..20: mol_type = other DNA
ttggaggagtgggatttctc

SEQ ID NO: 23662 - DNA, 20 bp, synthetic construct
  source 1..20: mol_type = other DNA
tggagctacgttgtggtgag

SEQ ID NO: 23663 - DNA, 20 bp, synthetic construct
  source 1..20: mol_type = other DNA
gacgtgtggaggctgtgctc

SEQ ID NO: 23664 - DNA, 20 bp, synthetic construct
  source 1..20: mol_type = other DNA
gtgtcccagaatcgccacgg

SEQ ID NO: 23665 - DNA, 20 bp, synthetic construct
  source 1..20: mol_type = other DNA
tgggggctgcagtcaagagc

SEQ ID NO: 23666 - DNA, 20 bp, synthetic construct
  source 1..20: mol_type = other DNA
taagtgaaggtggagtccct

SEQ ID NO: 23667 - DNA, 20 bp, synthetic construct
  source 1..20: mol_type = other DNA
aggcctcactgagcaacatt

SEQ ID NO: 23668 - DNA, 20 bp, synthetic construct
  source 1..20: mol_type = other DNA
ccacggcaatggcggtctgg

SEQ ID NO: 23669 - DNA, 20 bp, synthetic construct
  source 1..20: mol_type = other DNA
tggtgggcgtcatgctcact

SEQ ID NO: 23670 - DNA, 20 bp, synthetic construct
  source 1..20: mol_type = other DNA
atgaggggggagaggtcaat

SEQ ID NO: 23671 - DNA, 20 bp, synthetic construct
  source 1..20: mol_type = other DNA
agatgctgagctcggggcga

SEQ ID NO: 23672 - DNA, 20 bp, synthetic construct
  source 1..20: mol_type = other DNA
ccatgtggcacgtcacaagg

SEQ ID NO: 23673 - DNA, 20 bp, synthetic construct
  source 1..20: mol_type = other DNA
agacacaccaatgtcagccg

SEQ ID NO: 23674 - DNA, 20 bp, synthetic construct
  source 1..20: mol_type = other DNA
tagttcttgcccctacccgg

SEQ ID NO: 23675 - DNA, 20 bp, synthetic construct
  source 1..20: mol_type = other DNA
cagctcaacgccggggcagg

SEQ ID NO: 23676 - DNA, 20 bp, synthetic construct
  source 1..20: mol_type = other DNA
agatgaagatgccagaagtg

SEQ ID NO: 23677 - DNA, 20 bp, synthetic construct
  source 1..20: mol_type = other DNA
tgtggtgctttgtggcaaga

SEQ ID NO: 23678 - DNA, 20 bp, synthetic construct
  source 1..20: mol_type = other DNA
gaagtagcgatgataataga

SEQ ID NO: 23679 - DNA, 20 bp, synthetic construct
  source 1..20: mol_type = other DNA
tccagccagcacgatcctgg

SEQ ID NO: 23680 - DNA, 20 bp, synthetic construct
  source 1..20: mol_type = other DNA
tccatcccgagactgagaca

SEQ ID NO: 23681 - DNA, 20 bp, synthetic construct
  source 1..20: mol_type = other DNA
ggctgaatggttgctctagg

SEQ ID NO: 23682 - DNA, 20 bp, synthetic construct
  source 1..20: mol_type = other DNA
gaccagaggtacttgaggct

SEQ ID NO: 23683 - DNA, 20 bp, synthetic construct
  source 1..20: mol_type = other DNA
accagcggggacctgccaag

SEQ ID NO: 23684 - DNA, 20 bp, synthetic construct
  source 1..20: mol_type = other DNA
taactagaagagaccaacgt

SEQ ID NO: 23685 - DNA, 20 bp, synthetic construct
  source 1..20: mol_type = other DNA
ctcaccatttccatgagctg

SEQ ID NO: 23686 - DNA, 20 bp, synthetic construct
  source 1..20: mol_type = other DNA
acaggagggatctgagaacg

SEQ ID NO: 23687 - DNA, 20 bp, synthetic construct
  source 1..20: mol_type = other DNA
cgggaagctggtcgctcccg

SEQ ID NO: 23688 - DNA, 20 bp, synthetic construct
  source 1..20: mol_type = other DNA
gaactgggaggttatgaagg

SEQ ID NO: 23689 - DNA, 20 bp, synthetic construct
  source 1..20: mol_type = other DNA
gatgttgaaagctattgcta

SEQ ID NO: 23690 - DNA, 20 bp, synthetic construct
  source 1..20: mol_type = other DNA
ggacatgacatacgcacaag

SEQ ID NO: 23691 - DNA, 20 bp, synthetic construct
  source 1..20: mol_type = other DNA
taacgacccggaactattgg

SEQ ID NO: 23692 - DNA, 20 bp, synthetic construct
  source 1..20: mol_type = other DNA
aatcttagctgcacagaatc

SEQ ID NO: 23693 - DNA, 20 bp, synthetic construct
  source 1..20: mol_type = other DNA
agtttaccgcaatcttttca

SEQ ID NO: 23694 - DNA, 20 bp, synthetic construct
  source 1..20: mol_type = other DNA
ctcgttttttgagcatactt

SEQ ID NO: 23695 - DNA, 20 bp, synthetic construct
  source 1..20: mol_type = other DNA
tccaagctgggcgtttatta

SEQ ID NO: 23696 - DNA, 20 bp, synthetic construct
  source 1..20: mol_type = other DNA
ctgacacagatgtaacgttc

SEQ ID NO: 23697 - DNA, 20 bp, synthetic construct
  source 1..20: mol_type = other DNA
ttgttgaagtttctggagca

SEQ ID NO: 23698 - DNA, 20 bp, synthetic construct
  source 1..20: mol_type = other DNA
gtgaagtaggagaatctagt

SEQ ID NO: 23699 - DNA, 20 bp, synthetic construct
  source 1..20: mol_type = other DNA
aagctaatgctggtccagtt

SEQ ID NO: 23700 - DNA, 20 bp, synthetic construct
  source 1..20: mol_type = other DNA
aacttctggcacgttccacc

SEQ ID NO: 23701 - DNA, 20 bp, synthetic construct
  source 1..20: mol_type = other DNA
cgtagtgattgtaagatcct

SEQ ID NO: 23702 - DNA, 20 bp, synthetic construct
  source 1..20: mol_type = other DNA
tccctgtgatcagtatcaac

SEQ ID NO: 23703 - DNA, 20 bp, synthetic construct
  source 1..20: mol_type = other DNA
tcttacgtggaccccgcggt

SEQ ID NO: 23704 - DNA, 20 bp, synthetic construct
  source 1..20: mol_type = other DNA
tctggtgttcttgaccccaa

SEQ ID NO: 23705 - DNA, 20 bp, synthetic construct
  source 1..20: mol_type = other DNA
tcttcccacatctccaaact

SEQ ID NO: 23706 - DNA, 20 bp, synthetic construct
  source 1..20: mol_type = other DNA
accgccccagtggtcgtcgc

SEQ ID NO: 23707 - DNA, 20 bp, synthetic construct
  source 1..20: mol_type = other DNA
aacaccctagccaaccccac

SEQ ID NO: 23708 - DNA, 20 bp, synthetic construct
  source 1..20: mol_type = other DNA
caggtggtggtgaacggtac

SEQ ID NO: 23709 - DNA, 20 bp, synthetic construct
  source 1..20: mol_type = other DNA
ggttgcacacccaataccac

SEQ ID NO: 23710 - DNA, 20 bp, synthetic construct
  source 1..20: mol_type = other DNA
tgctactcaccgccaagcgg

SEQ ID NO: 23711 - DNA, 20 bp, synthetic construct
  source 1..20: mol_type = other DNA
ccctatgacgccacctctcc

SEQ ID NO: 23712 - DNA, 20 bp, synthetic construct
  source 1..20: mol_type = other DNA
gatgtgctcaacaccacgct

SEQ ID NO: 23713 - DNA, 20 bp, synthetic construct
  source 1..20: mol_type = other DNA
aagacgaacgccatcgtcaa

SEQ ID NO: 23714 - DNA, 20 bp, synthetic construct
  source 1..20: mol_type = other DNA
agcgatggaacacgccagat

SEQ ID NO: 23715 - DNA, 20 bp, synthetic construct
  source 1..20: mol_type = other DNA
gtctctaacatcaccggtgt

SEQ ID NO: 23716 - DNA, 20 bp, synthetic construct
  source 1..20: mol_type = other DNA
agaaacaccactctgggcgc

SEQ ID NO: 23717 - DNA, 20 bp, synthetic construct
  source 1..20: mol_type = other DNA
tccctccttgcctctgtcct

SEQ ID NO: 23718 - DNA, 20 bp, synthetic construct
  source 1..20: mol_type = other DNA
gctaggttggatcgggcctc

SEQ ID NO: 23719 - DNA, 20 bp, synthetic construct
  source 1..20: mol_type = other DNA
tattcgggcatgcctcaact

SEQ ID NO: 23720 - DNA, 20 bp, synthetic construct
  source 1..20: mol_type = other DNA
cgctttctgggctcccaccc

SEQ ID NO: 23721 - DNA, 20 bp, synthetic construct
  source 1..20: mol_type = other DNA
tcctgcgcattcagaattgt

SEQ ID NO: 23722 - DNA, 20 bp, synthetic construct
  source 1..20: mol_type = other DNA
ccactgttcgtcctggtaga

SEQ ID NO: 23723 - DNA, 20 bp, synthetic construct
  source 1..20: mol_type = other DNA
agacaagcttttcactatcc

SEQ ID NO: 23724 - DNA, 20 bp, synthetic construct
  source 1..20: mol_type = other DNA
cactactcaagaggcagcga

SEQ ID NO: 23725 - DNA, 20 bp, synthetic construct
  source 1..20: mol_type = other DNA
acttccagacgcactgacag

SEQ ID NO: 23726 - DNA, 20 bp, synthetic construct
  source 1..20: mol_type = other DNA
ttcctaccagttcctcacta

SEQ ID NO: 23727 - DNA, 20 bp, synthetic construct
  source 1..20: mol_type = other DNA
aacggggaagctgctgttag

SEQ ID NO: 23728 - DNA, 20 bp, synthetic construct
  source 1..20: mol_type = other DNA
caatacaaacacagtatcag

SEQ ID NO: 23729 - DNA, 20 bp, synthetic construct
  source 1..20: mol_type = other DNA
tagattcagcgtcccgtttg

SEQ ID NO: 23730 - DNA, 20 bp, synthetic construct
  source 1..20: mol_type = other DNA
gggccagggagtggttggat

SEQ ID NO: 23731 - DNA, 20 bp, synthetic construct
  source 1..20: mol_type = other DNA
tgacggtatggtggagaggt

SEQ ID NO: 23732 - DNA, 20 bp, synthetic construct
  source 1..20: mol_type = other DNA
tttaccattactggaagcgc

SEQ ID NO: 23733 - DNA, 20 bp, synthetic construct
  source 1..20: mol_type = other DNA
gcagcaggccgtggtagtta

SEQ ID NO: 23734 - DNA, 20 bp, synthetic construct
  source 1..20: mol_type = other DNA
taagaaacatgggtttccag

SEQ ID NO: 23735 - DNA, 20 bp, synthetic construct
  source 1..20: mol_type = other DNA
cattgagatgccagaggaaa

SEQ ID NO: 23736 - DNA, 20 bp, synthetic construct
  source 1..20: mol_type = other DNA
gcagagctcttcacttacca

SEQ ID NO: 23737 - DNA, 20 bp, synthetic construct
  source 1..20: mol_type = other DNA
caccccttctcttacgggag

SEQ ID NO: 23738 - DNA, 20 bp, synthetic construct
  source 1..20: mol_type = other DNA
tgacttgatatgaccaagag

SEQ ID NO: 23739 - DNA, 20 bp, synthetic construct
  source 1..20: mol_type = other DNA
cgtatggcgcatgctcatgg

SEQ ID NO: 23740 - DNA, 20 bp, synthetic construct
  source 1..20: mol_type = other DNA
ctaagatggcaatctatgag

SEQ ID NO: 23741 - DNA, 20 bp, synthetic construct
  source 1..20: mol_type = other DNA
ataaacataaaggtgagact

SEQ ID NO: 23742 - DNA, 20 bp, synthetic construct
  source 1..20: mol_type = other DNA
gagagtggacatgccccttg

SEQ ID NO: 23743 - DNA, 20 bp, synthetic construct
  source 1..20: mol_type = other DNA
aacagcaaaacaatgacttc

SEQ ID NO: 23744 - DNA, 20 bp, synthetic construct
  source 1..20: mol_type = other DNA
ataattttgttactttagta

SEQ ID NO: 23745 - DNA, 20 bp, synthetic construct
  source 1..20: mol_type = other DNA
cagactcaattccatctgct

SEQ ID NO: 23746 - DNA, 20 bp, synthetic construct
  source 1..20: mol_type = other DNA
ttataacctcatatcatgct

SEQ ID NO: 23747 - DNA, 20 bp, synthetic construct
  source 1..20: mol_type = other DNA
ttagagatcaccaacagaga

SEQ ID NO: 23748 - DNA, 20 bp, synthetic construct
  source 1..20: mol_type = other DNA
tgttttccattcttgttaag

SEQ ID NO: 23749 - DNA, 20 bp, synthetic construct
  source 1..20: mol_type = other DNA
tccctgtttgtacatccact

SEQ ID NO: 23750 - DNA, 20 bp, synthetic construct
  source 1..20: mol_type = other DNA
caatggggataaggaagaga

SEQ ID NO: 23751 - DNA, 20 bp, synthetic construct
  source 1..20: mol_type = other DNA
ccatttttaattctatcatt

SEQ ID NO: 23752 - DNA, 20 bp, synthetic construct
  source 1..20: mol_type = other DNA
tcacaatgaccccagctgat

SEQ ID NO: 23753 - DNA, 20 bp, synthetic construct
  source 1..20: mol_type = other DNA
caacacaggaacatgtgaca

SEQ ID NO: 23754 - DNA, 20 bp, synthetic construct
  source 1..20: mol_type = other DNA
acaaattttaaagatggttt

SEQ ID NO: 23755 - DNA, 20 bp, synthetic construct
  source 1..20: mol_type = other DNA
ggccgaatttgaacaagttt

SEQ ID NO: 23756 - DNA, 20 bp, synthetic construct
  source 1..20: mol_type = other DNA
atcaggagataatatgactc

SEQ ID NO: 23757 - DNA, 20 bp, synthetic construct
  source 1..20: mol_type = other DNA
atatatattgcgacaaggat

SEQ ID NO: 23758 - DNA, 20 bp, synthetic construct
  source 1..20: mol_type = other DNA
tacatttagtaaaatagatg

SEQ ID NO: 23759 - DNA, 20 bp, synthetic construct
  source 1..20: mol_type = other DNA
gaaaggaactaaaggaaaac

SEQ ID NO: 23760 - DNA, 20 bp, synthetic construct
  source 1..20: mol_type = other DNA
tggagatgataatgtaatta

SEQ ID NO: 23761 - DNA, 20 bp, synthetic construct
  source 1..20: mol_type = other DNA
taccaatgtacataacacga

SEQ ID NO: 23762 - DNA, 20 bp, synthetic construct
  source 1..20: mol_type = other DNA
acaacgccccgttctcattg

SEQ ID NO: 23763 - DNA, 20 bp, synthetic construct
  source 1..20: mol_type = other DNA
tttccaattagacaattcag

SEQ ID NO: 23764 - DNA, 20 bp, synthetic construct
  source 1..20: mol_type = other DNA
gtggttagataacatatctc

SEQ ID NO: 23765 - DNA, 20 bp, synthetic construct
  source 1..20: mol_type = other DNA
agtgggaatgccttgctact

SEQ ID NO: 23766 - DNA, 20 bp, synthetic construct
  source 1..20: mol_type = other DNA
acagtataacaatagagaga

SEQ ID NO: 23767 - DNA, 20 bp, synthetic construct
  source 1..20: mol_type = other DNA
ggagaatttggcgtcaagcg

SEQ ID NO: 23768 - DNA, 20 bp, synthetic construct
  source 1..20: mol_type = other DNA
cagcacaaagagcaatgatg

SEQ ID NO: 23769 - DNA, 20 bp, synthetic construct
  source 1..20: mol_type = other DNA
ttgagagggaagggtactct

SEQ ID NO: 23770 - DNA, 20 bp, synthetic construct
  source 1..20: mol_type = other DNA
gtgtacagcccactttctca

SEQ ID NO: 23771 - DNA, 20 bp, synthetic construct
  source 1..20: mol_type = other DNA
tatagtggagcggattctgg

SEQ ID NO: 23772 - DNA, 20 bp, synthetic construct
  source 1..20: mol_type = other DNA
ctcaactggtgcgcttgcca

SEQ ID NO: 23773 - DNA, 20 bp, synthetic construct
  source 1..20: mol_type = other DNA
cagaatggtactagccagca

SEQ ID NO: 23774 - DNA, 20 bp, synthetic construct
  source 1..20: mol_type = other DNA
acaagcctgggacatcccct

SEQ ID NO: 23775 - DNA, 20 bp, synthetic construct
  source 1..20: mol_type = other DNA
tggccaggactagtcgctgg

SEQ ID NO: 23776 - DNA, 20 bp, synthetic construct
  source 1..20: mol_type = other DNA
tacatgtttgtgtcactggg

SEQ ID NO: 23777 - DNA, 20 bp, synthetic construct
  source 1..20: mol_type = other DNA
gaacttgctgggagcagatg

SEQ ID NO: 23778 - DNA, 20 bp, synthetic construct
  source 1..20: mol_type = other DNA
gcaaggagacgtagtgttgg

SEQ ID NO: 23779 - DNA, 20 bp, synthetic construct
  source 1..20: mol_type = other DNA
gacccaaggtcgccagactt

SEQ ID NO: 23780 - DNA, 20 bp, synthetic construct
  source 1..20: mol_type = other DNA
agagctctcctttacagtta

SEQ ID NO: 23781 - DNA, 20 bp, synthetic construct
  source 1..20: mol_type = other DNA
caagctagttggaatcaaca

SEQ ID NO: 23782 - DNA, 20 bp, synthetic construct
  source 1..20: mol_type = other DNA
ggcaggactgttggtttcag

SEQ ID NO: 23783 - DNA, 20 bp, synthetic construct
  source 1..20: mol_type = other DNA
ggtaatgccagcccatggtc

SEQ ID NO: 23784 - DNA, 20 bp, synthetic construct
  source 1..20: mol_type = other DNA
cagttcatatcggaggccag

SEQ ID NO: 23785 - DNA, 20 bp, synthetic construct
  source 1..20: mol_type = other DNA
ggcatgtgaattgaccgatt

SEQ ID NO: 23786 - DNA, 20 bp, synthetic construct
  source 1..20: mol_type = other DNA
atctcttcaacagattgaga

SEQ ID NO: 23787 - DNA, 20 bp, synthetic construct
  source 1..20: mol_type = other DNA
cgcctacttggtcgtcagcg

SEQ ID NO: 23788 - DNA, 20 bp, synthetic construct
  source 1..20: mol_type = other DNA
gagcatgacggccgtgggaa

SEQ ID NO: 23789 - DNA, 20 bp, synthetic construct
  source 1..20: mol_type = other DNA
ggacggcacggacatgtgcc

SEQ ID NO: 23790 - DNA, 20 bp, synthetic construct
  source 1..20: mol_type = other DNA
agaaccactcaacggagaat

SEQ ID NO: 23791 - DNA, 20 bp, synthetic construct
  source 1..20: mol_type = other DNA
tattagcggaggctccaacg

SEQ ID NO: 23792 - DNA, 20 bp, synthetic construct
  source 1..20: mol_type = other DNA
atcgtttggacactgtcact

SEQ ID NO: 23793 - DNA, 20 bp, synthetic construct
  source 1..20: mol_type = other DNA
acttgacacgcggcagaagt

SEQ ID NO: 23794 - DNA, 20 bp, synthetic construct
  source 1..20: mol_type = other DNA
gtgggacactggtcttaatt

SEQ ID NO: 23795 - DNA, 20 bp, synthetic construct
  source 1..20: mol_type = other DNA
ctccttcaactacggtgctg

SEQ ID NO: 23796 - DNA, 20 bp, synthetic construct
  source 1..20: mol_type = other DNA
gaagaagatctccgactcgc

SEQ ID NO: 23797 - DNA, 20 bp, synthetic construct
  source 1..20: mol_type = other DNA
taaggagtggctcgacaacg

SEQ ID NO: 23798 - DNA, 20 bp, synthetic construct
  source 1..20: mol_type = other DNA
ggaggtgattgaccgggttg

SEQ ID NO: 23799 - DNA, 20 bp, synthetic construct
  source 1..20: mol_type = other DNA
accctacgccgggccgctcg

SEQ ID NO: 23800 - DNA, 20 bp, synthetic construct
  source 1..20: mol_type = other DNA
tttgaaagtgaaagctaaga

SEQ ID NO: 23801 - DNA, 20 bp, synthetic construct
  source 1..20: mol_type = other DNA
tcttttcgctgagaagtatg

SEQ ID NO: 23802 - DNA, 20 bp, synthetic construct
  source 1..20: mol_type = other DNA
ctgtggaggagctgttctcg

SEQ ID NO: 23803 - DNA, 20 bp, synthetic construct
  source 1..20: mol_type = other DNA
agatgtggaagagcgtgtgc

SEQ ID NO: 23804 - DNA, 20 bp, synthetic construct
  source 1..20: mol_type = other DNA
ccaggggaagcgccgcggcg

SEQ ID NO: 23805 - DNA, 20 bp, synthetic construct
  source 1..20: mol_type = other DNA
gtctggctgttccgcaacta

SEQ ID NO: 23806 - DNA, 20 bp, synthetic construct
  source 1..20: mol_type = other DNA
ccacttcaaatctcttggcc

SEQ ID NO: 23807 - DNA, 20 bp, synthetic construct
  source 1..20: mol_type = other DNA
ctttgcacgccgtgggacca

SEQ ID NO: 23808 - DNA, 20 bp, synthetic construct
  source 1..20: mol_type = other DNA
ggtgctatggagtgcccaac

SEQ ID NO: 23809 - DNA, 20 bp, synthetic construct
  source 1..20: mol_type = other DNA
gcccaacggcaggagaagcc

SEQ ID NO: 23810 - DNA, 20 bp, synthetic construct
  source 1..20: mol_type = other DNA
ggaaccaagaaggatccctg

SEQ ID NO: 23811 - DNA, 20 bp, synthetic construct
  source 1..20: mol_type = other DNA
aaacattctcaaatggcgca

SEQ ID NO: 23812 - DNA, 20 bp, synthetic construct
  source 1..20: mol_type = other DNA
gggaatgtctttggcctcca

SEQ ID NO: 23813 - DNA, 20 bp, synthetic construct
  source 1..20: mol_type = other DNA
tgtcaactgtgcacccagct

SEQ ID NO: 23814 - DNA, 20 bp, synthetic construct
  source 1..20: mol_type = other DNA
ccgctcttcttaggaaatgt

SEQ ID NO: 23815 - DNA, 20 bp, synthetic construct
  source 1..20: mol_type = other DNA
caagtgatccattcccggag

SEQ ID NO: 23816 - DNA, 20 bp, synthetic construct
  source 1..20: mol_type = other DNA
ataacatggaaatccctgga

SEQ ID NO: 23817 - DNA, 20 bp, synthetic construct
  source 1..20: mol_type = other DNA
agtacgcaacaacaacacga

SEQ ID NO: 23818 - DNA, 20 bp, synthetic construct
  source 1..20: mol_type = other DNA
taacgacattgtgcttggga

SEQ ID NO: 23819 - DNA, 20 bp, synthetic construct
  source 1..20: mol_type = other DNA
gagcggctgccctttttcag

SEQ ID NO: 23820 - DNA, 20 bp, synthetic construct
  source 1..20: mol_type = other DNA
caaatcgcagaggtggcaca

SEQ ID NO: 23821 - DNA, 20 bp, synthetic construct
  source 1..20: mol_type = other DNA
caataatgagaacaactcta

SEQ ID NO: 23822 - DNA, 20 bp, synthetic construct
  source 1..20: mol_type = other DNA
gagaagagtacaagaagacc

SEQ ID NO: 23823 - DNA, 20 bp, synthetic construct
  source 1..20: mol_type = other DNA
tgactgacacaacaccattt

SEQ ID NO: 23824 - DNA, 20 bp, synthetic construct
  source 1..20: mol_type = other DNA
agaagaaaccatctgaattt

SEQ ID NO: 23825 - DNA, 20 bp, synthetic construct
  source 1..20: mol_type = other DNA
tggttagagagactgcccca

SEQ ID NO: 23826 - DNA, 20 bp, synthetic construct
  source 1..20: mol_type = other DNA
ttcctcacactgtacaaaag

SEQ ID NO: 23827 - DNA, 20 bp, synthetic construct
  source 1..20: mol_type = other DNA
ttgccacagcttggcagact

SEQ ID NO: 23828 - DNA, 20 bp, synthetic construct
  source 1..20: mol_type = other DNA
ggtggctttacatattgagc

SEQ ID NO: 23829 - DNA, 20 bp, synthetic construct
  source 1..20: mol_type = other DNA
gcatggattttgcaatatgt

SEQ ID NO: 23830 - DNA, 20 bp, synthetic construct
  source 1..20: mol_type = other DNA
atgaaacccacagtgggagg

SEQ ID NO: 23831 - DNA, 20 bp, synthetic construct
  source 1..20: mol_type = other DNA
catggcaggttcacagagat

SEQ ID NO: 23832 - DNA, 20 bp, synthetic construct
  source 1..20: mol_type = other DNA
gggaactaaaacaccagtgg

SEQ ID NO: 23833 - DNA, 20 bp, synthetic construct
  source 1..20: mol_type = other DNA
tggacactgaaagaatggaa

SEQ ID NO: 23834 - DNA, 20 bp, synthetic construct
  source 1..20: mol_type = other DNA
atggagagctgctcagcgaa

SEQ ID NO: 23835 - DNA, 20 bp, synthetic construct
  source 1..20: mol_type = other DNA
ttattgctgtgggggtgaca

SEQ ID NO: 23836 - DNA, 20 bp, synthetic construct
  source 1..20: mol_type = other DNA
ttggtctgccgagcgcaaac

SEQ ID NO: 23837 - DNA, 20 bp, synthetic construct
  source 1..20: mol_type = other DNA
gcgtcctccacacaatgtgg

SEQ ID NO: 23838 - DNA, 20 bp, synthetic construct
  source 1..20: mol_type = other DNA
gaagagctcatgaagtgcat

SEQ ID NO: 23839 - DNA, 20 bp, synthetic construct
  source 1..20: mol_type = other DNA
cctttgaaaaagactattcc

SEQ ID NO: 23840 - DNA, 20 bp, synthetic construct
  source 1..20: mol_type = other DNA
tgacaggaatgtcaggggtt

SEQ ID NO: 23841 - DNA, 20 bp, synthetic construct
  source 1..20: mol_type = other DNA
ctggcaagcagaggagcagc

SEQ ID NO: 23842 - DNA, 20 bp, synthetic construct
  source 1..20: mol_type = other DNA
gagtggctggacacgtcctg

SEQ ID NO: 23843 - DNA, 20 bp, synthetic construct
  source 1..20: mol_type = other DNA
atcccatggtggacggagat

SEQ ID NO: 23844 - DNA, 20 bp, synthetic construct
  source 1..20: mol_type = other DNA
cagggcagcttatcaggcct

SEQ ID NO: 23845 - DNA, 20 bp, synthetic construct
  source 1..20: mol_type = other DNA
gggctggaatgaatgtgttt

SEQ ID NO: 23846 - DNA, 20 bp, synthetic construct
  source 1..20: mol_type = other DNA
accgaacgtggcagtactgg

SEQ ID NO: 23847 - DNA, 20 bp, synthetic construct
  source 1..20: mol_type = other DNA
cggacgacacagccggatgg

SEQ ID NO: 23848 - DNA, 20 bp, synthetic construct
  source 1..20: mol_type = other DNA
gtgaccacggagaagaacgc

SEQ ID NO: 23849 - DNA, 20 bp, synthetic construct
  source 1..20: mol_type = other DNA
ttcccttctgctcgcaccat

SEQ ID NO: 23850 - DNA, 20 bp, synthetic construct
  source 1..20: mol_type = other DNA
ggcaacacgccagtgagagt

SEQ ID NO: 23851 - DNA, 20 bp, synthetic construct
  source 1..20: mol_type = other DNA
gtcacatggagagaggactc

SEQ ID NO: 23852 - DNA, 20 bp, synthetic construct
  source 1..20: mol_type = other DNA
caacggcatctctcggacag

SEQ ID NO: 23853 - DNA, 20 bp, synthetic construct
  source 1..20: mol_type = other DNA
accgttgtgtgccccaagtg

SEQ ID NO: 23854 - DNA, 20 bp, synthetic construct
  source 1..20: mol_type = other DNA
ttggcaccatcacgctcacg

SEQ ID NO: 23855 - DNA, 20 bp, synthetic construct
  source 1..20: mol_type = other DNA
gaattacaactgctaatgaa

SEQ ID NO: 23856 - DNA, 20 bp, synthetic construct
  source 1..20: mol_type = other DNA
tcccgagtagctggctggtc

SEQ ID NO: 23857 - DNA, 20 bp, synthetic construct
  source 1..20: mol_type = other DNA
caactctctttgggtcattt

SEQ ID NO: 23858 - DNA, 20 bp, synthetic construct
  source 1..20: mol_type = other DNA
tggaggagccaataggagat

SEQ ID NO: 23859 - DNA, 20 bp, synthetic construct
  source 1..20: mol_type = other DNA
cgaaaacacgggtttctaca

SEQ ID NO: 23860 - DNA, 20 bp, synthetic construct
  source 1..20: mol_type = other DNA
tcggggcctacaacggaata

SEQ ID NO: 23861 - DNA, 20 bp, synthetic construct
  source 1..20: mol_type = other DNA
tctttcttggagccttgtac

SEQ ID NO: 23862 - DNA, 20 bp, synthetic construct
  source 1..20: mol_type = other DNA
tcttcattaatggtgacccc

SEQ ID NO: 23863 - DNA, 20 bp, synthetic construct
  source 1..20: mol_type = other DNA
ttgtcgaggaaaccaaacag

SEQ ID NO: 23864 - DNA, 20 bp, synthetic construct
  source 1..20: mol_type = other DNA
cactgcatcgtgcaaatttc

SEQ ID NO: 23865 - DNA, 20 bp, synthetic construct
  source 1..20: mol_type = other DNA
agcccacgaagatgtcttat

SEQ ID NO: 23866 - DNA, 20 bp, synthetic construct
  source 1..20: mol_type = other DNA
ggtcattcttcacttctcgc

SEQ ID NO: 23867 - DNA, 20 bp, synthetic construct
  source 1..20: mol_type = other DNA
tcagacttgacagaattccg

SEQ ID NO: 23868 - DNA, 20 bp, synthetic construct
  source 1..20: mol_type = other DNA
gtatcgtcctgccccctccc

SEQ ID NO: 23869 - DNA, 20 bp, synthetic construct
  source 1..20: mol_type = other DNA
gatcatttgtgactgatgat

SEQ ID NO: 23870 - DNA, 20 bp, synthetic construct
  source 1..20: mol_type = other DNA
aggatgccgttcaagatcaa

SEQ ID NO: 23871 - DNA, 20 bp, synthetic construct
  source 1..20: mol_type = other DNA
gccgtttcctcgaatttgag

SEQ ID NO: 23872 - DNA, 20 bp, synthetic construct
  source 1..20: mol_type = other DNA
caaaaatcagctctgaggac

SEQ ID NO: 23873 - DNA, 20 bp, synthetic construct
  source 1..20: mol_type = other DNA
tgggacggcgagatcaacga

SEQ ID NO: 23874 - DNA, 20 bp, synthetic construct
  source 1..20: mol_type = other DNA
tggttatagcaggggatgat

SEQ ID NO: 23875 - DNA, 20 bp, synthetic construct
  source 1..20: mol_type = other DNA
taggatttgtagccattacc

SEQ ID NO: 23876 - DNA, 20 bp, synthetic construct
  source 1..20: mol_type = other DNA
cctgggaagatatcccctat

SEQ ID NO: 23877 - DNA, 20 bp, synthetic construct
  source 1..20: mol_type = other DNA
taagacagggggtatttgga

SEQ ID NO: 23878 - DNA, 20 bp, synthetic construct
  source 1..20: mol_type = other DNA
tcccctggaaacagggtggg

SEQ ID NO: 23879 - DNA, 20 bp, synthetic construct
  source 1..20: mol_type = other DNA
tctcttgttagatctttttg

SEQ ID NO: 23880 - DNA, 20 bp, synthetic construct
  source 1..20: mol_type = other DNA
tggattgtcgccgacttctt

SEQ ID NO: 23881 - DNA, 20 bp, synthetic construct
  source 1..20: mol_type = other DNA
tgagaggttgtaatcctaaa

SEQ ID NO: 23882 - DNA, 20 bp, synthetic construct
  source 1..20: mol_type = other DNA
ttatgcctgtgcaatcccgg

SEQ ID NO: 23883 - DNA, 20 bp, synthetic construct
  source 1..20: mol_type = other DNA
ttagtgcctttttacagaaa

SEQ ID NO: 23884 - DNA, 20 bp, synthetic construct
  source 1..20: mol_type = other DNA
ctgtcacaagtgctggacag

SEQ ID NO: 23885 - DNA, 20 bp, synthetic construct
  source 1..20: mol_type = other DNA
atgtttgttttgagttttat

SEQ ID NO: 23886 - DNA, 20 bp, synthetic construct
  source 1..20: mol_type = other DNA
gcttggatgctatgttcttt

SEQ ID NO: 23887 - DNA, 20 bp, synthetic construct
  source 1..20: mol_type = other DNA
agctctttagcttgtttagg

SEQ ID NO: 23888 - DNA, 20 bp, synthetic construct
  source 1..20: mol_type = other DNA
ggaattgcattgattgtgat

SEQ ID NO: 23889 - DNA, 20 bp, synthetic construct
  source 1..20: mol_type = other DNA
ttgtggcagctgatttaggt

SEQ ID NO: 23890 - DNA, 20 bp, synthetic construct
  source 1..20: mol_type = other DNA
agcttacttataataagcag

SEQ ID NO: 23891 - DNA, 20 bp, synthetic construct
  source 1..20: mol_type = other DNA
gtatcgtgcgtactcgttct

SEQ ID NO: 23892 - DNA, 20 bp, synthetic construct
  source 1..20: mol_type = other DNA
ccaatggatttagccaagtt

SEQ ID NO: 23893 - DNA, 20 bp, synthetic construct
  source 1..20: mol_type = other DNA
atcaacaactcgctggtatc

SEQ ID NO: 23894 - DNA, 20 bp, synthetic construct
  source 1..20: mol_type = other DNA
ctactgaatatgcttccaac

SEQ ID NO: 23895 - DNA, 20 bp, synthetic construct
  source 1..20: mol_type = other DNA
gattttggcgggatggaagt

SEQ ID NO: 23896 - DNA, 20 bp, synthetic construct
  source 1..20: mol_type = other DNA
cgatttctttacatttgatg

SEQ ID NO: 23897 - DNA, 20 bp, synthetic construct
  source 1..20: mol_type = other DNA
ggatggtgtgccttttgttg

SEQ ID NO: 23898 - DNA, 20 bp, synthetic construct
  source 1..20: mol_type = other DNA
tatgccaaacctactacgta

SEQ ID NO: 23899 - DNA, 20 bp, synthetic construct
  source 1..20: mol_type = other DNA
tattgttccggccaaggtca

SEQ ID NO: 23900 - DNA, 20 bp, synthetic construct
  source 1..20: mol_type = other DNA
tattcgcgctaagcattatg

SEQ ID NO: 23901 - DNA, 20 bp, synthetic construct
  source 1..20: mol_type = other DNA
agaagctgttaaacgcgtgc

SEQ ID NO: 23902 - DNA, 20 bp, synthetic construct
  source 1..20: mol_type = other DNA
ggctgtggcgaaagctcctc

SEQ ID NO: 23903 - DNA, 20 bp, synthetic construct
  source 1..20: mol_type = other DNA
ttgtctccgctactttgcaa

SEQ ID NO: 23904 - DNA, 20 bp, synthetic construct
  source 1..20: mol_type = other DNA
acataaggactcttttaaag

SEQ ID NO: 23905 - DNA, 20 bp, synthetic construct
  source 1..20: mol_type = other DNA
tatgactttctatcctcgtt

SEQ ID NO: 23906 - DNA, 20 bp, synthetic construct
  source 1..20: mol_type = other DNA
gcatgccaattatttgtttt

SEQ ID NO: 23907 - DNA, 20 bp, synthetic construct
  source 1..20: mol_type = other DNA
agttttagatgttaaaggtg

SEQ ID NO: 23908 - DNA, 20 bp, synthetic construct
  source 1..20: mol_type = other DNA
attcaattataaaatcacca

SEQ ID NO: 23909 - DNA, 20 bp, synthetic construct
  source 1..20: mol_type = other DNA
tttagatgtggtacgtaaag

SEQ ID NO: 23910 - DNA, 20 bp, synthetic construct
  source 1..20: mol_type = other DNA
gtacttcagatactagttat

SEQ ID NO: 23911 - DNA, 20 bp, synthetic construct
  source 1..20: mol_type = other DNA
gtgttgtttcctgtttatat

SEQ ID NO: 23912 - DNA, 20 bp, synthetic construct
  source 1..20: mol_type = other DNA
tagcaccacctactggtgtt

SEQ ID NO: 23913 - DNA, 20 bp, synthetic construct
  source 1..20: mol_type = other DNA
atgcacaacactgtttcaaa

SEQ ID NO: 23914 - DNA, 20 bp, synthetic construct
  source 1..20: mol_type = other DNA
aaagttataaaggcatcaaa

SEQ ID NO: 23915 - DNA, 20 bp, synthetic construct
  source 1..20: mol_type = other DNA
catatgaatattatgtaaaa

SEQ ID NO: 23916 - DNA, 20 bp, synthetic construct
  source 1..20: mol_type = other DNA
ggaatgttgtaccctactat

SEQ ID NO: 23917 - DNA, 20 bp, synthetic construct
  source 1..20: mol_type = other DNA
cgactaggtttccgcctggc

SEQ ID NO: 23918 - DNA, 20 bp, synthetic construct
  source 1..20: mol_type = other DNA
aaaatgataatataagtgtt

SEQ ID NO: 23919 - DNA, 20 bp, synthetic construct
  source 1..20: mol_type = other DNA
cagaaaagtcgagataaggc

SEQ ID NO: 23920 - DNA, 20 bp, synthetic construct
  source 1..20: mol_type = other DNA
gctgcacaaggttttcaggc

SEQ ID NO: 23921 - DNA, 20 bp, synthetic construct
  source 1..20: mol_type = other DNA
aacagcaattatgttcttca

SEQ ID NO: 23922 - DNA, 20 bp, synthetic construct
  source 1..20: mol_type = other DNA
atgtttgtggcatcatcttc

SEQ ID NO: 23923 - DNA, 20 bp, synthetic construct
  source 1..20: mol_type = other DNA
cttgttcgtttgactactga

SEQ ID NO: 23924 - DNA, 20 bp, synthetic construct
  source 1..20: mol_type = other DNA
aagattgttgttattgctgg

SEQ ID NO: 23925 - DNA, 20 bp, synthetic construct
  source 1..20: mol_type = other DNA
tctgctacagatgccattat

SEQ ID NO: 23926 - DNA, 20 bp, synthetic construct
  source 1..20: mol_type = other DNA
gttgaaaagtttaattttgt

SEQ ID NO: 23927 - DNA, 20 bp, synthetic construct
  source 1..20: mol_type = other DNA
tgcatcaaatattatgctgt

SEQ ID NO: 23928 - DNA, 20 bp, synthetic construct
  source 1..20: mol_type = other DNA
gaggttgatataattgaaca

SEQ ID NO: 23929 - DNA, 20 bp, synthetic construct
  source 1..20: mol_type = other DNA
gaagctggtgaagttaaacc

SEQ ID NO: 23930 - DNA, 20 bp, synthetic construct
  source 1..20: mol_type = other DNA
attccacttatgcctcttct

SEQ ID NO: 23931 - DNA, 20 bp, synthetic construct
  source 1..20: mol_type = other DNA
ggttaccctaatgattttgt

SEQ ID NO: 23932 - DNA, 20 bp, synthetic construct
  source 1..20: mol_type = other DNA
gataacggtcactatgtagt

SEQ ID NO: 23933 - DNA, 20 bp, synthetic construct
  source 1..20: mol_type = other DNA
cttgatactggtgcacaaaa

SEQ ID NO: 23934 - DNA, 20 bp, synthetic construct
  source 1..20: mol_type = other DNA
tttgttagacatattattgt

SEQ ID NO: 23935 - DNA, 20 bp, synthetic construct
  source 1..20: mol_type = other DNA
gatggtcttatagaccttct

SEQ ID NO: 23936 - DNA, 20 bp, synthetic construct
  source 1..20: mol_type = other DNA
ggtgctcatgttggttctga

SEQ ID NO: 23937 - DNA, 20 bp, synthetic construct
  source 1..20: mol_type = other DNA
gatggttttaatgaatgggc

SEQ ID NO: 23938 - DNA, 20 bp, synthetic construct
  source 1..20: mol_type = other DNA
agtgctatgcactctttact

SEQ ID NO: 23939 - DNA, 20 bp, synthetic construct
  source 1..20: mol_type = other DNA
tgtgatggttctgttcatta

SEQ ID NO: 23940 - DNA, 20 bp, synthetic construct
  source 1..20: mol_type = other DNA
cttttaactgcttgtgcttt

SEQ ID NO: 23941 - DNA, 20 bp, synthetic construct
  source 1..20: mol_type = other DNA
gcgtctatttgtttgtattg

SEQ ID NO: 23942 - DNA, 20 bp, synthetic construct
  source 1..20: mol_type = other DNA
tgtgaccgtacaactattca

SEQ ID NO: 23943 - DNA, 20 bp, synthetic construct
  source 1..20: mol_type = other DNA
ttcgttttaaaaatgctgat

SEQ ID NO: 23944 - DNA, 20 bp, synthetic construct
  source 1..20: mol_type = other DNA
gacataatcttactaaatat

SEQ ID NO: 23945 - DNA, 20 bp, synthetic construct
  source 1..20: mol_type = other DNA
tttatgcatctcttggcaaa

SEQ ID NO: 23946 - DNA, 20 bp, synthetic construct
  source 1..20: mol_type = other DNA
ttttagatatttgtcaagct

SEQ ID NO: 23947 - DNA, 20 bp, synthetic construct
  source 1..20: mol_type = other DNA
tgttgggctctaagcatgtt

SEQ ID NO: 23948 - DNA, 20 bp, synthetic construct
  source 1..20: mol_type = other DNA
tttcaatgatgattctctct

SEQ ID NO: 23949 - DNA, 20 bp, synthetic construct
  source 1..20: mol_type = other DNA
ctggtagtggtaagtcacat

SEQ ID NO: 23950 - DNA, 20 bp, synthetic construct
  source 1..20: mol_type = other DNA
gtgatccacaacaacttcct

SEQ ID NO: 23951 - DNA, 20 bp, synthetic construct
  source 1..20: mol_type = other DNA
atgcctctggtgatgctgtt

SEQ ID NO: 23952 - DNA, 20 bp, synthetic construct
  source 1..20: mol_type = other DNA
gtgttattcatgacattggt

SEQ ID NO: 23953 - DNA, 20 bp, synthetic construct
  source 1..20: mol_type = other DNA
acagtgattgtgatgttgtg

SEQ ID NO: 23954 - DNA, 20 bp, synthetic construct
  source 1..20: mol_type = other DNA
cttttatagctggtaacact

SEQ ID NO: 23955 - DNA, 20 bp, synthetic construct
  source 1..20: mol_type = other DNA
caattcttcaactattgtta

SEQ ID NO: 23956 - DNA, 20 bp, synthetic construct
  source 1..20: mol_type = other DNA
tgattgtaatggttatactg

SEQ ID NO: 23957 - DNA, 20 bp, synthetic construct
  source 1..20: mol_type = other DNA
ccagttttatattaatggtt

SEQ ID NO: 23958 - DNA, 20 bp, synthetic construct
  source 1..20: mol_type = other DNA
tggtattcgtgagtttagta

SEQ ID NO: 23959 - DNA, 20 bp, synthetic construct
  source 1..20: mol_type = other DNA
ccttgcttgtgctcagtact

SEQ ID NO: 23960 - DNA, 20 bp, synthetic construct
  source 1..20: mol_type = other DNA
gttgcttgttttgttttaaa

SEQ ID NO: 23961 - DNA, 20 bp, synthetic construct
  source 1..20: mol_type = other DNA
ctacaacttatgcgtaaggt

SEQ ID NO: 23962 - DNA, 20 bp, synthetic construct
  source 1..20: mol_type = other DNA
accacaattgtttgtgaccg

SEQ ID NO: 23963 - DNA, 20 bp, synthetic construct
  source 1..20: mol_type = other DNA
tgtaaattgggccgatgaca

SEQ ID NO: 23964 - DNA, 20 bp, synthetic construct
  source 1..20: mol_type = other DNA
ttggaagcgtgttcctacca

SEQ ID NO: 23965 - DNA, 20 bp, synthetic construct
  source 1..20: mol_type = other DNA
taggccagtgatagtaaagt

SEQ ID NO: 23966 - DNA, 20 bp, synthetic construct
  source 1..20: mol_type = other DNA
acaattatggtctagtcaaa

SEQ ID NO: 23967 - DNA, 20 bp, synthetic construct
  source 1..20: mol_type = other DNA
tgtttgaaggaaggcttttc

SEQ ID NO: 23968 - DNA, 20 bp, synthetic construct
  source 1..20: mol_type = other DNA
taactggagacaatagtaaa

SEQ ID NO: 23969 - DNA, 20 bp, synthetic construct
  source 1..20: mol_type = other DNA
atggtgggaaactgatgaac

SEQ ID NO: 23970 - DNA, 20 bp, synthetic construct
  source 1..20: mol_type = other DNA
aaaatgaagcagtagtttca

SEQ ID NO: 23971 - DNA, 20 bp, synthetic construct
  source 1..20: mol_type = other DNA
cagtgtctttacaaaatgag

SEQ ID NO: 23972 - DNA, 20 bp, synthetic construct
  source 1..20: mol_type = other DNA
ttcgacaaatacgtctacca

SEQ ID NO: 23973 - DNA, 20 bp, synthetic construct
  source 1..20: mol_type = other DNA
aaggagagtcagttattgga

SEQ ID NO: 23974 - DNA, 20 bp, synthetic construct
  source 1..20: mol_type = other DNA
ttggagaagctgatgatcac

SEQ ID NO: 23975 - DNA, 20 bp, synthetic construct
  source 1..20: mol_type = other DNA
gttgtcaaaactttattttc

SEQ ID NO: 23976 - DNA, 20 bp, synthetic construct
  source 1..20: mol_type = other DNA
cccctcttgacacaaaaatt

SEQ ID NO: 23977 - DNA, 20 bp, synthetic construct
  source 1..20: mol_type = other DNA
agatgagtttgccaatttct

SEQ ID NO: 23978 - DNA, 20 bp, synthetic construct
  source 1..20: mol_type = other DNA
ttcaagagaaggcgctcaaa

SEQ ID NO: 23979 - DNA, 20 bp, synthetic construct
  source 1..20: mol_type = other DNA
tagtaaaaatcataattgaa

SEQ ID NO: 23980 - DNA, 20 bp, synthetic construct
  source 1..20: mol_type = other DNA
ccatcagccacaatgctcaa

SEQ ID NO: 23981 - DNA, 20 bp, synthetic construct
  source 1..20: mol_type = other DNA
ctgcaaaaatatcgtcagca

SEQ ID NO: 23982 - DNA, 20 bp, synthetic construct
  source 1..20: mol_type = other DNA
tatttggccctattggagtc

SEQ ID NO: 23983 - DNA, 20 bp, synthetic construct
  source 1..20: mol_type = other DNA
gctgcagcaacaggtgacac

SEQ ID NO: 23984 - DNA, 20 bp, synthetic construct
  source 1..20: mol_type = other DNA
cctatcgcaaccagttcccc

SEQ ID NO: 23985 - DNA, 20 bp, synthetic construct
  source 1..20: mol_type = other DNA
cagtgtccagtcacttgctc

SEQ ID NO: 23986 - DNA, 20 bp, synthetic construct
  source 1..20: mol_type = other DNA
aggaatgattacaactgtga

SEQ ID NO: 23987 - DNA, 20 bp, synthetic construct
  source 1..20: mol_type = other DNA
gaaagcaatcatccgcagtg

SEQ ID NO: 23988 - DNA, 20 bp, synthetic construct
  source 1..20: mol_type = other DNA
caatccacgtcaatcaataa

SEQ ID NO: 23989 - DNA, 20 bp, synthetic construct
  source 1..20: mol_type = other DNA
aattgttaagtatccgagaa

SEQ ID NO: 23990 - DNA, 20 bp, synthetic construct
  source 1..20: mol_type = other DNA
tctattggcaggagcaggca

SEQ ID NO: 23991 - DNA, 20 bp, synthetic construct
  source 1..20: mol_type = other DNA
ggcccaattaccaacacgtg

SEQ ID NO: 23992 - DNA, 20 bp, synthetic construct
  source 1..20: mol_type = other DNA
agtggttgggagctttctca

SEQ ID NO: 23993 - DNA, 20 bp, synthetic construct
  source 1..20: mol_type = other DNA
ctcacgatctgatctcagtg

SEQ ID NO: 23994 - DNA, 20 bp, synthetic construct
  source 1..20: mol_type = other DNA
ctgacacttggcccacttct

SEQ ID NO: 23995 - DNA, 20 bp, synthetic construct
  source 1..20: mol_type = other DNA
cctccagaacaacgaattat

SEQ ID NO: 23996 - DNA, 20 bp, synthetic construct
  source 1..20: mol_type = other DNA
accaatgagtgtttagttct

SEQ ID NO: 23997 - DNA, 20 bp, synthetic construct
  source 1..20: mol_type = other DNA
tatctcaacacagcaactca

SEQ ID NO: 23998 - DNA, 20 bp, synthetic construct
  source 1..20: mol_type = other DNA
tcctcatctctcttaggaca

SEQ ID NO: 23999 - DNA, 20 bp, synthetic construct
  source 1..20: mol_type = other DNA
tggcatgactcagactggaa

SEQ ID NO: 24000 - DNA, 20 bp, synthetic construct
  source 1..20: mol_type = other DNA
gagaatcatacactaacata

SEQ ID NO: 24001 - DNA, 20 bp, synthetic construct
  source 1..20: mol_type = other DNA
actaatttgatatccccatt

SEQ ID NO: 24002 - DNA, 20 bp, synthetic construct
  source 1..20: mol_type = other DNA
ttcaagaaatgttttgatgc

SEQ ID NO: 24003 - DNA, 20 bp, synthetic construct
  source 1..20: mol_type = other DNA
aacttattagggagaaaacc

SEQ ID NO: 24004 - DNA, 20 bp, synthetic construct
  source 1..20: mol_type = other DNA
tccaataggaagcttaatga

SEQ ID NO: 24005 - DNA, 20 bp, synthetic construct
  source 1..20: mol_type = other DNA
atccgtgtaccgtacattgg

SEQ ID NO: 24006 - DNA, 20 bp, synthetic construct
  source 1..20: mol_type = other DNA
agagttaacatcacacttga

SEQ ID NO: 24007 - DNA, 20 bp, synthetic construct
  source 1..20: mol_type = other DNA
caaatgtattatctgagggt

SEQ ID NO: 24008 - DNA, 20 bp, synthetic construct
  source 1..20: mol_type = other DNA
tttgcatctctggactacat

SEQ ID NO: 24009 - DNA, 20 bp, synthetic construct
  source 1..20: mol_type = other DNA
aggtaccttgagcgattaaa

SEQ ID NO: 24010 - DNA, 20 bp, synthetic construct
  source 1..20: mol_type = other DNA
gtacatgtagatttggaatc

SEQ ID NO: 24011 - DNA, 20 bp, synthetic construct
  source 1..20: mol_type = other DNA
atagaatttgaacaattgat

SEQ ID NO: 24012 - DNA, 20 bp, synthetic construct
  source 1..20: mol_type = other DNA
taacctggctcctcctacaa

SEQ ID NO: 24013 - DNA, 20 bp, synthetic construct
  source 1..20: mol_type = other DNA
tcctttgccagtttgtttct

SEQ ID NO: 24014 - DNA, 20 bp, synthetic construct
  source 1..20: mol_type = other DNA
atcaagttcctactaataca

SEQ ID NO: 24015 - DNA, 20 bp, synthetic construct
  source 1..20: mol_type = other DNA
gcccacgggagcacgctggc

SEQ ID NO: 24016 - DNA, 20 bp, synthetic construct
  source 1..20: mol_type = other DNA
tctgatgataatcctgatga

SEQ ID NO: 24017 - DNA, 20 bp, synthetic construct
  source 1..20: mol_type = other DNA
ccagacagggggcagagcaa

SEQ ID NO: 24018 - DNA, 20 bp, synthetic construct
  source 1..20: mol_type = other DNA
actctccagagtatgacccc

SEQ ID NO: 24019 - DNA, 20 bp, synthetic construct
  source 1..20: mol_type = other DNA
gagcccattgcttttagcac

SEQ ID NO: 24020 - DNA, 20 bp, synthetic construct
  source 1..20: mol_type = other DNA
cctagacataattcatgcag

SEQ ID NO: 24021 - DNA, 20 bp, synthetic construct
  source 1..20: mol_type = other DNA
aaccagcccaaagggcctcc

SEQ ID NO: 24022 - DNA, 20 bp, synthetic construct
  source 1..20: mol_type = other DNA
gggtacacttgccaatacgc

SEQ ID NO: 24023 - DNA, 20 bp, synthetic construct
  source 1..20: mol_type = other DNA
aatgggctgaaaattgctac

SEQ ID NO: 24024 - DNA, 20 bp, synthetic construct
  source 1..20: mol_type = other DNA
caccaggaagtattcggacc

SEQ ID NO: 24025 - DNA, 20 bp, synthetic construct
  source 1..20: mol_type = other DNA
caaccatatgcagatctcca

SEQ ID NO: 24026 - DNA, 20 bp, synthetic construct
  source 1..20: mol_type = other DNA
aacaacagaagcacccactc

SEQ ID NO: 24027 - DNA, 20 bp, synthetic construct
  source 1..20: mol_type = other DNA
taagtgcaatcccaacttac

SEQ ID NO: 24028 - DNA, 20 bp, synthetic construct
  source 1..20: mol_type = other DNA
atattgatgaagattaagaa

SEQ ID NO: 24029 - DNA, 20 bp, synthetic construct
  source 1..20: mol_type = other DNA
cctgcaccaggggaatatac

SEQ ID NO: 24030 - DNA, 20 bp, synthetic construct
  source 1..20: mol_type = other DNA
attatacagtctaaacttgt

SEQ ID NO: 24031 - DNA, 20 bp, synthetic construct
  source 1..20: mol_type = other DNA
agccacaggccggtacaact

SEQ ID NO: 24032 - DNA, 20 bp, synthetic construct
  source 1..20: mol_type = other DNA
cctctattttatgatggcta

SEQ ID NO: 24033 - DNA, 20 bp, synthetic construct
  source 1..20: mol_type = other DNA
aaaatacaatctggccttca

SEQ ID NO: 24034 - DNA, 20 bp, synthetic construct
  source 1..20: mol_type = other DNA
tttctctgttcggatcttac

SEQ ID NO: 24035 - DNA, 20 bp, synthetic construct
  source 1..20: mol_type = other DNA
tttccttcgtcagattgtca

SEQ ID NO: 24036 - DNA, 20 bp, synthetic construct
  source 1..20: mol_type = other DNA
agcaattcaaccaattaagt

SEQ ID NO: 24037 - DNA, 20 bp, synthetic construct
  source 1..20: mol_type = other DNA
aaacaattctagtccatatg

SEQ ID NO: 24038 - DNA, 20 bp, synthetic construct
  source 1..20: mol_type = other DNA
caactgcaacttatcgattg

SEQ ID NO: 24039 - DNA, 20 bp, synthetic construct
  source 1..20: mol_type = other DNA
tcaacagcaagtacaaagag

SEQ ID NO: 24040 - DNA, 20 bp, synthetic construct
  source 1..20: mol_type = other DNA
ttcaaggtttctaagacgcc

SEQ ID NO: 24041 - DNA, 20 bp, synthetic construct
  source 1..20: mol_type = other DNA
gaagaggaccagtgcgattc

SEQ ID NO: 24042 - DNA, 20 bp, synthetic construct
  source 1..20: mol_type = other DNA
ggggcacaaaaaagaagaga

SEQ ID NO: 24043 - DNA, 20 bp, synthetic construct
  source 1..20: mol_type = other DNA
gaagcaacaatggacaaagg

SEQ ID NO: 24044 - DNA, 20 bp, synthetic construct
  source 1..20: mol_type = other DNA
acaagccgaccattgacatt

SEQ ID NO: 24045 - DNA, 20 bp, synthetic construct
  source 1..20: mol_type = other DNA
tccttgtccatagagaatgg

SEQ ID NO: 24046 - DNA, 20 bp, synthetic construct
  source 1..20: mol_type = other DNA
ctgttccagtgtctttctcg

SEQ ID NO: 24047 - DNA, 20 bp, synthetic construct
  source 1..20: mol_type = other DNA
agtacacgggatctgacgga

SEQ ID NO: 24048 - DNA, 20 bp, synthetic construct
  source 1..20: mol_type = other DNA
aggtctttggaggagccttc

SEQ ID NO: 24049 - DNA, 20 bp, synthetic construct
  source 1..20: mol_type = other DNA
ccgtctcacgtctggaacac

SEQ ID NO: 24050 - DNA, 20 bp, synthetic construct
  source 1..20: mol_type = other DNA
acactactgactgcgacagc

SEQ ID NO: 24051 - DNA, 20 bp, synthetic construct
  source 1..20: mol_type = other DNA
gcgtcagtgcccatcggagt

SEQ ID NO: 24052 - DNA, 20 bp, synthetic construct
  source 1..20: mol_type = other DNA
tctttcagatggcggccacc

SEQ ID NO: 24053 - DNA, 20 bp, synthetic construct
  source 1..20: mol_type = other DNA
gaatcactctcatcatcatc

SEQ ID NO: 24054 - DNA, 20 bp, synthetic construct
  source 1..20: mol_type = other DNA
ttcttcacaccctgtggcac

SEQ ID NO: 24055 - DNA, 20 bp, synthetic construct
  source 1..20: mol_type = other DNA
gaaaggcagccataaacatc

SEQ ID NO: 24056 - DNA, 20 bp, synthetic construct
  source 1..20: mol_type = other DNA
atgtcagtgccatcgtgcaa

SEQ ID NO: 24057 - DNA, 20 bp, synthetic construct
  source 1..20: mol_type = other DNA
cagctgtgctggctccaacc

SEQ ID NO: 24058 - DNA, 20 bp, synthetic construct
  source 1..20: mol_type = other DNA
caaactacaacctctttgtg

SEQ ID NO: 24059 - DNA, 20 bp, synthetic construct
  source 1..20: mol_type = other DNA
ctagtgctagtgctgcccag

SEQ ID NO: 24060 - DNA, 20 bp, synthetic construct
  source 1..20: mol_type = other DNA
gaccaaggtcaaacatcatt

SEQ ID NO: 24061 - DNA, 20 bp, synthetic construct
  source 1..20: mol_type = other DNA
ttgaagtcctggggagaatg

SEQ ID NO: 24062 - DNA, 20 bp, synthetic construct
  source 1..20: mol_type = other DNA
cagcaggagttttcttgctc

SEQ ID NO: 24063 - DNA, 20 bp, synthetic construct
  source 1..20: mol_type = other DNA
ccatgaacgctttggcattg

SEQ ID NO: 24064 - DNA, 20 bp, synthetic construct
  source 1..20: mol_type = other DNA
gaatcatgaaaaatgctgtg

SEQ ID NO: 24065 - DNA, 20 bp, synthetic construct
  source 1..20: mol_type = other DNA
tatcagcggcactcctgact

SEQ ID NO: 24066 - DNA, 20 bp, synthetic construct
  source 1..20: mol_type = other DNA
ggaaccttgtcactatgaag

SEQ ID NO: 24067 - DNA, 20 bp, synthetic construct
  source 1..20: mol_type = other DNA
accatgacaaggaccaccca

SEQ ID NO: 24068 - DNA, 20 bp, synthetic construct
  source 1..20: mol_type = other DNA
ctggcacagatgggaagacc

SEQ ID NO: 24069 - DNA, 20 bp, synthetic construct
  source 1..20: mol_type = other DNA
tgagagccattattggccag

SEQ ID NO: 24070 - DNA, 20 bp, synthetic construct
  source 1..20: mol_type = other DNA
tcagaaccgtttcggagagg

SEQ ID NO: 24071 - DNA, 20 bp, synthetic construct
  source 1..20: mol_type = other DNA
aaggactagaggttagagga

SEQ ID NO: 24072 - DNA, 20 bp, synthetic construct
  source 1..20: mol_type = other DNA
tacaagaggacttcatttga

SEQ ID NO: 24073 - DNA, 20 bp, synthetic construct
  source 1..20: mol_type = other DNA
tcaagtgcaatccaatcaaa

SEQ ID NO: 24074 - DNA, 20 bp, synthetic construct
  source 1..20: mol_type = other DNA
agctggtgttccaaccacca

SEQ ID NO: 24075 - DNA, 20 bp, synthetic construct
  source 1..20: mol_type = other DNA
tgatgtagagtttttcttct

SEQ ID NO: 24076 - DNA, 20 bp, synthetic construct
  source 1..20: mol_type = other DNA
tctggagccgctagaagaga

SEQ ID NO: 24077 - DNA, 20 bp, synthetic construct
  source 1..20: mol_type = other DNA
gaaaatacttgagtcaaaga

SEQ ID NO: 24078 - DNA, 20 bp, synthetic construct
  source 1..20: mol_type = other DNA
gttgactggttacagaaggg

SEQ ID NO: 24079 - DNA, 20 bp, synthetic construct
  source 1..20: mol_type = other DNA
gcatgaccaacgcatcattg

SEQ ID NO: 24080 - DNA, 20 bp, synthetic construct
  source 1..20: mol_type = other DNA
actctggccaacatctgagc

SEQ ID NO: 24081 - DNA, 20 bp, synthetic construct
  source 1..20: mol_type = other DNA
aacttcacttcaaccatcgg

SEQ ID NO: 24082 - DNA, 20 bp, synthetic construct
  source 1..20: mol_type = other DNA
tctggtcttggacacctaca

SEQ ID NO: 24083 - DNA, 20 bp, synthetic construct
  source 1..20: mol_type = other DNA
gccaaagaaaatctgggagg

SEQ ID NO: 24084 - DNA, 20 bp, synthetic construct
  source 1..20: mol_type = other DNA
atagcccctcctaatgaggt

SEQ ID NO: 24085 - DNA, 20 bp, synthetic construct
  source 1..20: mol_type = other DNA
atgcacaaacgcagtataga

SEQ ID NO: 24086 - DNA, 20 bp, synthetic construct
  source 1..20: mol_type = other DNA
ctgactttccatatgctcca

SEQ ID NO: 24087 - DNA, 20 bp, synthetic construct
  source 1..20: mol_type = other DNA
atcgacaatcatccccaggt

SEQ ID NO: 24088 - DNA, 20 bp, synthetic construct
  source 1..20: mol_type = other DNA
ttgacacgctcaaggatgag

SEQ ID NO: 24089 - DNA, 20 bp, synthetic construct
  source 1..20: mol_type = other DNA
aaaacgtttctcttctggtt

SEQ ID NO: 24090 - DNA, 20 bp, synthetic construct
  source 1..20: mol_type = other DNA
ctcgcgtcgctcttccaatt

SEQ ID NO: 24091 - DNA, 20 bp, synthetic construct
  source 1..20: mol_type = other DNA
ataaagtagataaggcaaga

SEQ ID NO: 24092 - DNA, 20 bp, synthetic construct
  source 1..20: mol_type = other DNA
atagtgtagctttagctttg

SEQ ID NO: 24093 - DNA, 20 bp, synthetic construct
  source 1..20: mol_type = other DNA
acgataaagtggataccgca

SEQ ID NO: 24094 - DNA, 20 bp, synthetic construct
  source 1..20: mol_type = other DNA
ccaatgaagcatcaggaaac

SEQ ID NO: 24095 - DNA, 20 bp, synthetic construct
  source 1..20: mol_type = other DNA
ggtattaaatatgttgcaca

SEQ ID NO: 24096 - DNA, 20 bp, synthetic construct
  source 1..20: mol_type = other DNA
gtaggttgtaaatctattgt

SEQ ID NO: 24097 - DNA, 20 bp, synthetic construct
  source 1..20: mol_type = other DNA
tcatcttatgagtattgtca

SEQ ID NO: 24098 - DNA, 20 bp, synthetic construct
  source 1..20: mol_type = other DNA
ttaaactcttgtaaagagca

SEQ ID NO: 24099 - DNA, 20 bp, synthetic construct
  source 1..20: mol_type = other DNA
gaagatgttgttactggtga

SEQ ID NO: 24100 - DNA, 20 bp, synthetic construct
  source 1..20: mol_type = other DNA
gtagatgatattgaaagtat

SEQ ID NO: 24101 - DNA, 20 bp, synthetic construct
  source 1..20: mol_type = other DNA
acattacatttttcattatt

SEQ ID NO: 24102 - DNA, 20 bp, synthetic construct
  source 1..20: mol_type = other DNA
ggagttgcaaaagctatagc

SEQ ID NO: 24103 - DNA, 20 bp, synthetic construct
  source 1..20: mol_type = other DNA
cttcgtcatgatatacaatt

SEQ ID NO: 24104 - DNA, 20 bp, synthetic construct
  source 1..20: mol_type = other DNA
cattttaaatttgatgaacc

SEQ ID NO: 24105 - DNA, 20 bp, synthetic construct
  source 1..20: mol_type = other DNA
gatctttttaatggttataa

SEQ ID NO: 24106 - DNA, 20 bp, synthetic construct
  source 1..20: mol_type = other DNA
ttgaaatgtggttcacctta

SEQ ID NO: 24107 - DNA, 20 bp, synthetic construct
  source 1..20: mol_type = other DNA
agaattgttatgtggataaa

SEQ ID NO: 24108 - DNA, 20 bp, synthetic construct
  source 1..20: mol_type = other DNA
gaagtagatagacgtgtttt

SEQ ID NO: 24109 - DNA, 20 bp, synthetic construct
  source 1..20: mol_type = other DNA
tttgctagtgatagtgttca

SEQ ID NO: 24110 - DNA, 20 bp, synthetic construct
  source 1..20: mol_type = other DNA
tgggttttgaataatgatta

SEQ ID NO: 24111 - DNA, 20 bp, synthetic construct
  source 1..20: mol_type = other DNA
gacaaagtttattgtcctcg

SEQ ID NO: 24112 - DNA, 20 bp, synthetic construct
  source 1..20: mol_type = other DNA
tttagttgtataatttctgc

SEQ ID NO: 24113 - DNA, 20 bp, synthetic construct
  source 1..20: mol_type = other DNA
tatgtaaattatttagttgt

SEQ ID NO: 24114 - DNA, 20 bp, synthetic construct
  source 1..20: mol_type = other DNA
gaacgtgataaagctgtagc

SEQ ID NO: 24115 - DNA, 20 bp, synthetic construct
  source 1..20: mol_type = other DNA
gataatgctgttaaaggttg

SEQ ID NO: 24116 - DNA, 20 bp, synthetic construct
  source 1..20: mol_type = other DNA
gtttgtctcttaaagattta

SEQ ID NO: 24117 - DNA, 20 bp, synthetic construct
  source 1..20: mol_type = other DNA
ctagtaagggttatatagct

SEQ ID NO: 24118 - DNA, 20 bp, synthetic construct
  source 1..20: mol_type = other DNA
ctttgcgttgtggcagttgt

SEQ ID NO: 24119 - DNA, 20 bp, synthetic construct
  source 1..20: mol_type = other DNA
gtttaaagttatttgctgca

SEQ ID NO: 24120 - DNA, 20 bp, synthetic construct
  source 1..20: mol_type = other DNA
tagtttatactgctgctagt

SEQ ID NO: 24121 - DNA, 20 bp, synthetic construct
  source 1..20: mol_type = other DNA
agagagtctctttatggaat

SEQ ID NO: 24122 - DNA, 20 bp, synthetic construct
  source 1..20: mol_type = other DNA
ttttatcgtgccttatattc

SEQ ID NO: 24123 - DNA, 20 bp, synthetic construct
  source 1..20: mol_type = other DNA
ataattttgatgaatctaag

SEQ ID NO: 24124 - DNA, 20 bp, synthetic construct
  source 1..20: mol_type = other DNA
gtcataaaccaccttctgct

SEQ ID NO: 24125 - DNA, 20 bp, synthetic construct
  source 1..20: mol_type = other DNA
attgtgcagggttcggtgtt

SEQ ID NO: 24126 - DNA, 20 bp, synthetic construct
  source 1..20: mol_type = other DNA
agtatggcactttttgtgat

SEQ ID NO: 24127 - DNA, 20 bp, synthetic construct
  source 1..20: mol_type = other DNA
ctcctattttgtctgaatct

SEQ ID NO: 24128 - DNA, 20 bp, synthetic construct
  source 1..20: mol_type = other DNA
ttaatttttgtggtaatggt

SEQ ID NO: 24129 - DNA, 20 bp, synthetic construct
  source 1..20: mol_type = other DNA
ttggtgtcgcaagtttggca

SEQ ID NO: 24130 - DNA, 20 bp, synthetic construct
  source 1..20: mol_type = other DNA
ttgtgccattacaacaggca

SEQ ID NO: 24131 - DNA, 20 bp, synthetic construct
  source 1..20: mol_type = other DNA
caacgactgggccagcaacc

SEQ ID NO: 24132 - DNA, 20 bp, synthetic construct
  source 1..20: mol_type = other DNA
acatcaccaagattgtgtac

SEQ ID NO: 24133 - DNA, 20 bp, synthetic construct
  source 1..20: mol_type = other DNA
gcattgacgttgaccaaacc

SEQ ID NO: 24134 - DNA, 20 bp, synthetic construct
  source 1..20: mol_type = other DNA
agaatgaagggggtgggtac

SEQ ID NO: 24135 - DNA, 20 bp, synthetic construct
  source 1..20: mol_type = other DNA
ttggttccgtgggcggcttc

SEQ ID NO: 24136 - DNA, 20 bp, synthetic construct
  source 1..20: mol_type = other DNA
tggccacaggtggactcatc

SEQ ID NO: 24137 - DNA, 20 bp, synthetic construct
  source 1..20: mol_type = other DNA
ctgcagcgctcgtggaggca

SEQ ID NO: 24138 - DNA, 20 bp, synthetic construct
  source 1..20: mol_type = other DNA
tgcatgtcatggacttgcgt

SEQ ID NO: 24139 - DNA, 20 bp, synthetic construct
  source 1..20: mol_type = other DNA
tgcgcgtgaaacgagaacca

SEQ ID NO: 24140 - DNA, 20 bp, synthetic construct
  source 1..20: mol_type = other DNA
gtgcctggaacctgccaacc

SEQ ID NO: 24141 - DNA, 20 bp, synthetic construct
  source 1..20: mol_type = other DNA
atccaggtgcggggaagact

SEQ ID NO: 24142 - DNA, 20 bp, synthetic construct
  source 1..20: mol_type = other DNA
ggaataacatcaagcctgag

SEQ ID NO: 24143 - DNA, 20 bp, synthetic construct
  source 1..20: mol_type = other DNA
ggaaagaagcccaaatgctg

SEQ ID NO: 24144 - DNA, 20 bp, synthetic construct
  source 1..20: mol_type = other DNA
tggcatggcatgtggctaag

SEQ ID NO: 24145 - DNA, 20 bp, synthetic construct
  source 1..20: mol_type = other DNA
aggggcgtgacatccgagag

SEQ ID NO: 24146 - DNA, 20 bp, synthetic construct
  source 1..20: mol_type = other DNA
atggacatatggcgggggtt

SEQ ID NO: 24147 - DNA, 20 bp, synthetic construct
  source 1..20: mol_type = other DNA
aggctgacttaggccagctt

SEQ ID NO: 24148 - DNA, 20 bp, synthetic construct
  source 1..20: mol_type = other DNA
tggtcaacagtgccgtggtg

SEQ ID NO: 24149 - DNA, 20 bp, synthetic construct
  source 1..20: mol_type = other DNA
ccctggctgtgtccctcaac

SEQ ID NO: 24150 - DNA, 20 bp, synthetic construct
  source 1..20: mol_type = other DNA
gtggagagacaaacatgggg

SEQ ID NO: 24151 - DNA, 20 bp, synthetic construct
  source 1..20: mol_type = other DNA
ccatcggagggaaaggacac

SEQ ID NO: 24152 - DNA, 20 bp, synthetic construct
  source 1..20: mol_type = other DNA
gcagagtgatccagctcatg

SEQ ID NO: 24153 - DNA, 20 bp, synthetic construct
  source 1..20: mol_type = other DNA
tgtactacacgacgggggtt

SEQ ID NO: 24154 - DNA, 20 bp, synthetic construct
  source 1..20: mol_type = other DNA
tggaagagaggatcaacgcc

SEQ ID NO: 24155 - DNA, 20 bp, synthetic construct
  source 1..20: mol_type = other DNA
aaggtgagggcgtcattggg

SEQ ID NO: 24156 - DNA, 20 bp, synthetic construct
  source 1..20: mol_type = other DNA
acatggcgaaagtgagaaag

SEQ ID NO: 24157 - DNA, 20 bp, synthetic construct
  source 1..20: mol_type = other DNA
ctgactgggcacggcacata

SEQ ID NO: 24158 - DNA, 20 bp, synthetic construct
  source 1..20: mol_type = other DNA
ggccgagtgggatgcgtatg

SEQ ID NO: 24159 - DNA, 20 bp, synthetic construct
  source 1..20: mol_type = other DNA
taaaacaggaagaagaccct

SEQ ID NO: 24160 - DNA, 20 bp, synthetic construct
  source 1..20: mol_type = other DNA
cattttccttataattattt

SEQ ID NO: 24161 - DNA, 20 bp, synthetic construct
  source 1..20: mol_type = other DNA
caggattggctttttcaatt

SEQ ID NO: 24162 - DNA, 20 bp, synthetic construct
  source 1..20: mol_type = other DNA
acagacggctcttccaatgg

SEQ ID NO: 24163 - DNA, 20 bp, synthetic construct
  source 1..20: mol_type = other DNA
tatggtgtcaaccctcgagg

SEQ ID NO: 24164 - DNA, 20 bp, synthetic construct
  source 1..20: mol_type = other DNA
tggaaagatccacttaccaa

SEQ ID NO: 24165 - DNA, 20 bp, synthetic construct
  source 1..20: mol_type = other DNA
tgttttggttttgcaacatg

SEQ ID NO: 24166 - DNA, 20 bp, synthetic construct
  source 1..20: mol_type = other DNA
gttttgtgaaaaattacctg

SEQ ID NO: 24167 - DNA, 20 bp, synthetic construct
  source 1..20: mol_type = other DNA
ttgtagacttgttcctgacg

SEQ ID NO: 24168 - DNA, 20 bp, synthetic construct
  source 1..20: mol_type = other DNA
agtcaagccaaccgcggagg

SEQ ID NO: 24169 - DNA, 20 bp, synthetic construct
  source 1..20: mol_type = other DNA
agggtatggtacagagtgta

SEQ ID NO: 24170 - DNA, 20 bp, synthetic construct
  source 1..20: mol_type = other DNA
gtagaaaatattgatagatt

SEQ ID NO: 24171 - DNA, 20 bp, synthetic construct
  source 1..20: mol_type = other DNA
ccttcttcggaccaacaacc

SEQ ID NO: 24172 - DNA, 20 bp, synthetic construct
  source 1..20: mol_type = other DNA
gccatttggaaacgccctga

SEQ ID NO: 24173 - DNA, 20 bp, synthetic construct
  source 1..20: mol_type = other DNA
catcaaccatggtctgtccg

SEQ ID NO: 24174 - DNA, 20 bp, synthetic construct
  source 1..20: mol_type = other DNA
atatggactaaaattcctaa

SEQ ID NO: 24175 - DNA, 20 bp, synthetic construct
  source 1..20: mol_type = other DNA
tgcgccgcgcgatcaggagg

SEQ ID NO: 24176 - DNA, 20 bp, synthetic construct
  source 1..20: mol_type = other DNA
taagtacgtagatactagcc

SEQ ID NO: 24177 - DNA, 20 bp, synthetic construct
  source 1..20: mol_type = other DNA
cgtcaacatggtggcataca

SEQ ID NO: 24178 - DNA, 20 bp, synthetic construct
  source 1..20: mol_type = other DNA
ggctgttgacagcactacca

SEQ ID NO: 24179 - DNA, 20 bp, synthetic construct
  source 1..20: mol_type = other DNA
attggaccatccttacgggt

SEQ ID NO: 24180 - DNA, 20 bp, synthetic construct
  source 1..20: mol_type = other DNA
tgcaggtctatcaaccacta

SEQ ID NO: 24181 - DNA, 20 bp, synthetic construct
  source 1..20: mol_type = other DNA
gccagagtgtagccaaagag

SEQ ID NO: 24182 - DNA, 20 bp, synthetic construct
  source 1..20: mol_type = other DNA
agacgttggtgcatagggtg

SEQ ID NO: 24183 - DNA, 20 bp, synthetic construct
  source 1..20: mol_type = other DNA
agtatgtgagcaaacaagac

SEQ ID NO: 24184 - DNA, 20 bp, synthetic construct
  source 1..20: mol_type = other DNA
atctatccatcattgagaat

SEQ ID NO: 24185 - DNA, 20 bp, synthetic construct
  source 1..20: mol_type = other DNA
ttgcagtatgatggtgatct

SEQ ID NO: 24186 - DNA, 20 bp, synthetic construct
  source 1..20: mol_type = other DNA
cccaactcaatccgattgat

SEQ ID NO: 24187 - DNA, 20 bp, synthetic construct
  source 1..20: mol_type = other DNA
ggcgggcaattgcaacaccc

SEQ ID NO: 24188 - DNA, 20 bp, synthetic construct
  source 1..20: mol_type = other DNA
tcaatatgctgagtacagtc

SEQ ID NO: 24189 - DNA, 20 bp, synthetic construct
  source 1..20: mol_type = other DNA
gcaaactagttggaatcaat

SEQ ID NO: 24190 - DNA, 20 bp, synthetic construct
  source 1..20: mol_type = other DNA
aggcaggactgttggtttca

SEQ ID NO: 24191 - DNA, 20 bp, synthetic construct
  source 1..20: mol_type = other DNA
gtcatgagggggaggggata

SEQ ID NO: 24192 - DNA, 20 bp, synthetic construct
  source 1..20: mol_type = other DNA
ctgttttcaacagtctatat

SEQ ID NO: 24193 - DNA, 20 bp, synthetic construct
  source 1..20: mol_type = other DNA
aaacagcagcacaaagagca

SEQ ID NO: 24194 - DNA, 20 bp, synthetic construct
  source 1..20: mol_type = other DNA
tggtgtttggatcgggagaa

SEQ ID NO: 24195 - DNA, 20 bp, synthetic construct
  source 1..20: mol_type = other DNA
aatttggactagtgggagca

SEQ ID NO: 24196 - DNA, 20 bp, synthetic construct
  source 1..20: mol_type = other DNA
ttatagagggaggatggcag

SEQ ID NO: 24197 - DNA, 20 bp, synthetic construct
  source 1..20: mol_type = other DNA
agcttagggataatgcaaag

SEQ ID NO: 24198 - DNA, 20 bp, synthetic construct
  source 1..20: mol_type = other DNA
ggtgcacttgccagttgtat

SEQ ID NO: 24199 - DNA, 20 bp, synthetic construct
  source 1..20: mol_type = other DNA
agagggccttctacggaagg

SEQ ID NO: 24200 - DNA, 20 bp, synthetic construct
  source 1..20: mol_type = other DNA
ctcaacaggtggaatatgcg

SEQ ID NO: 24201 - DNA, 20 bp, synthetic construct
  source 1..20: mol_type = other DNA
gggtttcatagaaaatggtt

SEQ ID NO: 24202 - DNA, 20 bp, synthetic construct
  source 1..20: mol_type = other DNA
gaagcaactgagggaaaatg

SEQ ID NO: 24203 - DNA, 20 bp, synthetic construct
  source 1..20: mol_type = other DNA
tgcgaccctgacaagtgtta

SEQ ID NO: 24204 - DNA, 20 bp, synthetic construct
  source 1..20: mol_type = other DNA
gtaatgactgatgggagtgc

SEQ ID NO: 24205 - DNA, 20 bp, synthetic construct
  source 1..20: mol_type = other DNA
cgaacggctgcattgagggc

SEQ ID NO: 24206 - DNA, 20 bp, synthetic construct
  source 1..20: mol_type = other DNA
tcccaaggactaaaaacatg

SEQ ID NO: 24207 - DNA, 20 bp, synthetic construct
  source 1..20: mol_type = other DNA
cccaactcaacccaattgat

SEQ ID NO: 24208 - DNA, 20 bp, synthetic construct
  source 1..20: mol_type = other DNA
tcaacatgctaagtacggtt

SEQ ID NO: 24209 - DNA, 20 bp, synthetic construct
  source 1..20: mol_type = other DNA
gtagttcatataggagaccg

SEQ ID NO: 24210 - DNA, 20 bp, synthetic construct
  source 1..20: mol_type = other DNA
cagaatcgcaattaacaata

SEQ ID NO: 24211 - DNA, 20 bp, synthetic construct
  source 1..20: mol_type = other DNA
caagcacagagatgtcaatg

SEQ ID NO: 24212 - DNA, 20 bp, synthetic construct
  source 1..20: mol_type = other DNA
acagaagatacggaccagca

SEQ ID NO: 24213 - DNA, 20 bp, synthetic construct
  source 1..20: mol_type = other DNA
accaaatgccaaactccttt

SEQ ID NO: 24214 - DNA, 20 bp, synthetic construct
  source 1..20: mol_type = other DNA
gtagcaggttctctgtcact

SEQ ID NO: 24215 - DNA, 20 bp, synthetic construct
  source 1..20: mol_type = other DNA
gcaaggagacgtggtgttgg

SEQ ID NO: 24216 - DNA, 20 bp, synthetic construct
  source 1..20: mol_type = other DNA
acgagagaaggaataaatat

SEQ ID NO: 24217 - DNA, 20 bp, synthetic construct
  source 1..20: mol_type = other DNA
cagctgggctgactcacatg

SEQ ID NO: 24218 - DNA, 20 bp, synthetic construct
  source 1..20: mol_type = other DNA
ggaacccaggaaatgctgag

SEQ ID NO: 24219 - DNA, 20 bp, synthetic construct
  source 1..20: mol_type = other DNA
catggttgcatgtttgtgtc

SEQ ID NO: 24220 - DNA, 20 bp, synthetic construct
  source 1..20: mol_type = other DNA
cttcaggaagagccgatact

SEQ ID NO: 24221 - DNA, 20 bp, synthetic construct
  source 1..20: mol_type = other DNA
ggtgcttttatgtggagttg

SEQ ID NO: 24222 - DNA, 20 bp, synthetic construct
  source 1..20: mol_type = other DNA
aagatatcaccattgattta

SEQ ID NO: 24223 - DNA, 20 bp, synthetic construct
  source 1..20: mol_type = other DNA
taaaagaaatggctgcacat

SEQ ID NO: 24224 - DNA, 20 bp, synthetic construct
  source 1..20: mol_type = other DNA
catatcctttagactataaa

SEQ ID NO: 24225 - DNA, 20 bp, synthetic construct
  source 1..20: mol_type = other DNA
ttcgggatactccaatcata

SEQ ID NO: 24226 - DNA, 20 bp, synthetic construct
  source 1..20: mol_type = other DNA
cgataatgtcaatatggaaa

SEQ ID NO: 24227 - DNA, 20 bp, synthetic construct
  source 1..20: mol_type = other DNA
ttttatcgctcaacattcat

SEQ ID NO: 24228 - DNA, 20 bp, synthetic construct
  source 1..20: mol_type = other DNA
agggctaaacatcttctatg

SEQ ID NO: 24229 - DNA, 20 bp, synthetic construct
  source 1..20: mol_type = other DNA
tacattctcctacaacatac

SEQ ID NO: 24230 - DNA, 20 bp, synthetic construct
  source 1..20: mol_type = other DNA
gcggccaagcaagaagagag

SEQ ID NO: 24231 - DNA, 20 bp, synthetic construct
  source 1..20: mol_type = other DNA
cattgtgagggctctagatg

SEQ ID NO: 24232 - DNA, 20 bp, synthetic construct
  source 1..20: mol_type = other DNA
ggacttcaaggtgatgaaga

SEQ ID NO: 24233 - DNA, 20 bp, synthetic construct
  source 1..20: mol_type = other DNA
cggatggggtaacggatgtg

SEQ ID NO: 24234 - DNA, 20 bp, synthetic construct
  source 1..20: mol_type = other DNA
ggactggtttcacgacttga

SEQ ID NO: 24235 - DNA, 20 bp, synthetic construct
  source 1..20: mol_type = other DNA
tgttagcagctcaaccctaa

SEQ ID NO: 24236 - DNA, 20 bp, synthetic construct
  source 1..20: mol_type = other DNA
aagcaacggaccctgccgag

SEQ ID NO: 24237 - DNA, 20 bp, synthetic construct
  source 1..20: mol_type = other DNA
caccacccagattaactacc

SEQ ID NO: 24238 - DNA, 20 bp, synthetic construct
  source 1..20: mol_type = other DNA
atgcgattcggcaatcatcg

SEQ ID NO: 24239 - DNA, 20 bp, synthetic construct
  source 1..20: mol_type = other DNA
gggagcgtcgctgcgcacaa

SEQ ID NO: 24240 - DNA, 20 bp, synthetic construct
  source 1..20: mol_type = other DNA
tggagttgcaggagggatgg

SEQ ID NO: 24241 - DNA, 20 bp, synthetic construct
  source 1..20: mol_type = other DNA
ggcggccaatgacttgaagc

SEQ ID NO: 24242 - DNA, 20 bp, synthetic construct
  source 1..20: mol_type = other DNA
gttgataattgggattgtaa

SEQ ID NO: 24243 - DNA, 20 bp, synthetic construct
  source 1..20: mol_type = other DNA
gttttggctacttggcaaac

SEQ ID NO: 24244 - DNA, 20 bp, synthetic construct
  source 1..20: mol_type = other DNA
ccaggttccggataaggcgt

SEQ ID NO: 24245 - DNA, 20 bp, synthetic construct
  source 1..20: mol_type = other DNA
agcacagcgcagaggccgca

SEQ ID NO: 24246 - DNA, 20 bp, synthetic construct
  source 1..20: mol_type = other DNA
gcgagataaggttttcacca

SEQ ID NO: 24247 - DNA, 20 bp, synthetic construct
  source 1..20: mol_type = other DNA
cacaatcctggaagacaaca

SEQ ID NO: 24248 - DNA, 20 bp, synthetic construct
  source 1..20: mol_type = other DNA
tagaatgccaaatcacttct

SEQ ID NO: 24249 - DNA, 20 bp, synthetic construct
  source 1..20: mol_type = other DNA
tatggatctatcggtgccat

SEQ ID NO: 24250 - DNA, 20 bp, synthetic construct
  source 1..20: mol_type = other DNA
agagatctggaagtcaagac

SEQ ID NO: 24251 - DNA, 20 bp, synthetic construct
  source 1..20: mol_type = other DNA
aagaggattcgtcaaaccca

SEQ ID NO: 24252 - DNA, 20 bp, synthetic construct
  source 1..20: mol_type = other DNA
taaaacctacatggatgtca

SEQ ID NO: 24253 - DNA, 20 bp, synthetic construct
  source 1..20: mol_type = other DNA
agcggtcgagtggctgagga

SEQ ID NO: 24254 - DNA, 20 bp, synthetic construct
  source 1..20: mol_type = other DNA
gcacaactggcaagaggtgc

SEQ ID NO: 24255 - DNA, 20 bp, synthetic construct
  source 1..20: mol_type = other DNA
gtatctagaccagcgcatgc

SEQ ID NO: 24256 - DNA, 20 bp, synthetic construct
  source 1..20: mol_type = other DNA
gagagcgaaggacagcgaag

SEQ ID NO: 24257 - DNA, 20 bp, synthetic construct
  source 1..20: mol_type = other DNA
gaaggagggtggggtcccta

SEQ ID NO: 24258 - DNA, 20 bp, synthetic construct
  source 1..20: mol_type = other DNA
aaagggagaagtgcacctgg

SEQ ID NO: 24259 - DNA, 20 bp, synthetic construct
  source 1..20: mol_type = other DNA
cctacagttgcaaaccctga

SEQ ID NO: 24260 - DNA, 20 bp, synthetic construct
  source 1..20: mol_type = other DNA
acagtacccccaggcttatc

SEQ ID NO: 24261 - DNA, 20 bp, synthetic construct
  source 1..20: mol_type = other DNA
tgaggtccaacgttactctg

SEQ ID NO: 24262 - DNA, 20 bp, synthetic construct
  source 1..20: mol_type = other DNA
tgggagggtgcttctcctac

SEQ ID NO: 24263 - DNA, 20 bp, synthetic construct
  source 1..20: mol_type = other DNA
ggttcactgcaccatgaacg

SEQ ID NO: 24264 - DNA, 20 bp, synthetic construct
  source 1..20: mol_type = other DNA
ggcccctgactcatcacccc

SEQ ID NO: 24265 - DNA, 20 bp, synthetic construct
  source 1..20: mol_type = other DNA
aggccaacttcctgtttacc

SEQ ID NO: 24266 - DNA, 20 bp, synthetic construct
  source 1..20: mol_type = other DNA
tcaagacttccgagctgtca

SEQ ID NO: 24267 - DNA, 20 bp, synthetic construct
  source 1..20: mol_type = other DNA
gcccaccacagtctccggac

SEQ ID NO: 24268 - DNA, 20 bp, synthetic construct
  source 1..20: mol_type = other DNA
atgtaaaggccaccaggtat

SEQ ID NO: 24269 - DNA, 20 bp, synthetic construct
  source 1..20: mol_type = other DNA
actgatggccatgaggtcct

SEQ ID NO: 24270 - DNA, 20 bp, synthetic construct
  source 1..20: mol_type = other DNA
caaaggtaaatcaggcgcac

SEQ ID NO: 24271 - DNA, 20 bp, synthetic construct
  source 1..20: mol_type = other DNA
aggatggaggaaggtcctaa

SEQ ID NO: 24272 - DNA, 20 bp, synthetic construct
  source 1..20: mol_type = other DNA
taggactctgaatggtaaaa

SEQ ID NO: 24273 - DNA, 20 bp, synthetic construct
  source 1..20: mol_type = other DNA
cctcaaggtagtctcacaca

SEQ ID NO: 24274 - DNA, 20 bp, synthetic construct
  source 1..20: mol_type = other DNA
tgatcaagtcaaagcagaga

SEQ ID NO: 24275 - DNA, 20 bp, synthetic construct
  source 1..20: mol_type = other DNA
tcgcgctgttgtctcacaac

SEQ ID NO: 24276 - DNA, 20 bp, synthetic construct
  source 1..20: mol_type = other DNA
tgaaatcattcgagcaggaa

SEQ ID NO: 24277 - DNA, 20 bp, synthetic construct
  source 1..20: mol_type = other DNA
ggctgttggggtgtataaga

SEQ ID NO: 24278 - DNA, 20 bp, synthetic construct
  source 1..20: mol_type = other DNA
tgtgaaagcgacaggacaag

SEQ ID NO: 24279 - DNA, 20 bp, synthetic construct
  source 1..20: mol_type = other DNA
ggcaggaccacctgtctatg

SEQ ID NO: 24280 - DNA, 20 bp, synthetic construct
  source 1..20: mol_type = other DNA
ttcgcaactagattctggct

SEQ ID NO: 24281 - DNA, 20 bp, synthetic construct
  source 1..20: mol_type = other DNA
tccgttccctagcacaaatc

SEQ ID NO: 24282 - DNA, 20 bp, synthetic construct
  source 1..20: mol_type = other DNA
tcattaccgactggaaaagt

SEQ ID NO: 24283 - DNA, 20 bp, synthetic construct
  source 1..20: mol_type = other DNA
tcaacgagaacatgatgata

SEQ ID NO: 24284 - DNA, 20 bp, synthetic construct
  source 1..20: mol_type = other DNA
atcttcaaaattgacttcac

SEQ ID NO: 24285 - DNA, 20 bp, synthetic construct
  source 1..20: mol_type = other DNA
gagtagcgtagagtgggctt

SEQ ID NO: 24286 - DNA, 20 bp, synthetic construct
  source 1..20: mol_type = other DNA
accgacgcagtgacagaaat

SEQ ID NO: 24287 - DNA, 20 bp, synthetic construct
  source 1..20: mol_type = other DNA
tctgtgttgacgactatgta

SEQ ID NO: 24288 - DNA, 20 bp, synthetic construct
  source 1..20: mol_type = other DNA
ctcacaagactgacctcgtt

SEQ ID NO: 24289 - DNA, 20 bp, synthetic construct
  source 1..20: mol_type = other DNA
cagacaatcaacatctcaat

SEQ ID NO: 24290 - DNA, 20 bp, synthetic construct
  source 1..20: mol_type = other DNA
cagacagccggctcgggcga

SEQ ID NO: 24291 - DNA, 20 bp, synthetic construct
  source 1..20: mol_type = other DNA
atggcgcagtccgctgctgc

SEQ ID NO: 24292 - DNA, 20 bp, synthetic construct
  source 1..20: mol_type = other DNA
acagtctcagattgcgcttt

SEQ ID NO: 24293 - DNA, 20 bp, synthetic construct
  source 1..20: mol_type = other DNA
gggggcagcccttagctaac

SEQ ID NO: 24294 - DNA, 20 bp, synthetic construct
  source 1..20: mol_type = other DNA
cgactgagcagtccacccca

SEQ ID NO: 24295 - DNA, 20 bp, synthetic construct
  source 1..20: mol_type = other DNA
cccagccagcgccggcgcag

SEQ ID NO: 24296 - DNA, 20 bp, synthetic construct
  source 1..20: mol_type = other DNA
tgcctctccgtttctgactt

SEQ ID NO: 24297 - DNA, 20 bp, synthetic construct
  source 1..20: mol_type = other DNA
accatgtcctcggaggcctt

SEQ ID NO: 24298 - DNA, 20 bp, synthetic construct
  source 1..20: mol_type = other DNA
cctataggcctggagctcct

SEQ ID NO: 24299 - DNA, 20 bp, synthetic construct
  source 1..20: mol_type = other DNA
aaaggaaattaatgagacag

SEQ ID NO: 24300 - DNA, 20 bp, synthetic construct
  source 1..20: mol_type = other DNA
cgaggtatggcagatatgct

SEQ ID NO: 24301 - DNA, 20 bp, synthetic construct
  source 1..20: mol_type = other DNA
tcaggttgcctctgtggatt

SEQ ID NO: 24302 - DNA, 20 bp, synthetic construct
  source 1..20: mol_type = other DNA
agctggtatggcatgcatgc

SEQ ID NO: 24303 - DNA, 20 bp, synthetic construct
  source 1..20: mol_type = other DNA
accatgctctggtgtaatga

SEQ ID NO: 24304 - DNA, 20 bp, synthetic construct
  source 1..20: mol_type = other DNA
cactaattcagccattgcca

SEQ ID NO: 24305 - DNA, 20 bp, synthetic construct
  source 1..20: mol_type = other DNA
gaatccaccacaggagccaa

SEQ ID NO: 24306 - DNA, 20 bp, synthetic construct
  source 1..20: mol_type = other DNA
tcggttctttgcctattttt

SEQ ID NO: 24307 - DNA, 20 bp, synthetic construct
  source 1..20: mol_type = other DNA
gacaattgacgttgagggga

SEQ ID NO: 24308 - DNA, 20 bp, synthetic construct
  source 1..20: mol_type = other DNA
tattttgattttgaaccgag

SEQ ID NO: 24309 - DNA, 20 bp, synthetic construct
  source 1..20: mol_type = other DNA
tgagtttgtctctcatttgc

SEQ ID NO: 24310 - DNA, 20 bp, synthetic construct
  source 1..20: mol_type = other DNA
taaagaaatagccaaattaa

SEQ ID NO: 24311 - DNA, 20 bp, synthetic construct
  source 1..20: mol_type = other DNA
tccaaaagcaagtgtagagg

SEQ ID NO: 24312 - DNA, 20 bp, synthetic construct
  source 1..20: mol_type = other DNA
tttggatgtggcaacagcca

SEQ ID NO: 24313 - DNA, 20 bp, synthetic construct
  source 1..20: mol_type = other DNA
cattgaaaaactagaaactg

SEQ ID NO: 24314 - DNA, 20 bp, synthetic construct
  source 1..20: mol_type = other DNA
ccagtatatggtgcaagatg

SEQ ID NO: 24315 - DNA, 20 bp, synthetic construct
  source 1..20: mol_type = other DNA
tgtgagtagtgatgttatac

SEQ ID NO: 24316 - DNA, 20 bp, synthetic construct
  source 1..20: mol_type = other DNA
aaacctccaaccttataatt

SEQ ID NO: 24317 - DNA, 20 bp, synthetic construct
  source 1..20: mol_type = other DNA
atggcaggtagaaggaggga

SEQ ID NO: 24318 - DNA, 20 bp, synthetic construct
  source 1..20: mol_type = other DNA
ggaagggaagatacagtggt

SEQ ID NO: 24319 - DNA, 20 bp, synthetic construct
  source 1..20: mol_type = other DNA
agcacatctcagccggtctc

SEQ ID NO: 24320 - DNA, 20 bp, synthetic construct
  source 1..20: mol_type = other DNA
attgatcgacgcttgcgctc

SEQ ID NO: 24321 - DNA, 20 bp, synthetic construct
  source 1..20: mol_type = other DNA
tggatgcgtgaattgctcgc

SEQ ID NO: 24322 - DNA, 20 bp, synthetic construct
  source 1..20: mol_type = other DNA
gaagttttggtgaaaaacat

SEQ ID NO: 24323 - DNA, 20 bp, synthetic construct
  source 1..20: mol_type = other DNA
ttcggatacgacggagtggt

SEQ ID NO: 24324 - DNA, 20 bp, synthetic construct
  source 1..20: mol_type = other DNA
ccgacccgggaacattcagt

SEQ ID NO: 24325 - DNA, 20 bp, synthetic construct
  source 1..20: mol_type = other DNA
ctggccggatcgtttgtgaa

SEQ ID NO: 24326 - DNA, 20 bp, synthetic construct
  source 1..20: mol_type = other DNA
atgacatcaatgttcgggac

SEQ ID NO: 24327 - DNA, 20 bp, synthetic construct
  source 1..20: mol_type = other DNA
gtactgctgaactatgttgt

SEQ ID NO: 24328 - DNA, 20 bp, synthetic construct
  source 1..20: mol_type = other DNA
gggttgtacgtgctctcaac

SEQ ID NO: 24329 - DNA, 20 bp, synthetic construct
  source 1..20: mol_type = other DNA
acaacacttccgtctggatt

SEQ ID NO: 24330 - DNA, 20 bp, synthetic construct
  source 1..20: mol_type = other DNA
aacgcgcccgagtggctacc

SEQ ID NO: 24331 - DNA, 20 bp, synthetic construct
  source 1..20: mol_type = other DNA
attgacagcattcgattctc

SEQ ID NO: 24332 - DNA, 20 bp, synthetic construct
  source 1..20: mol_type = other DNA
cgcaagcaggagacacagtt

SEQ ID NO: 24333 - DNA, 20 bp, synthetic construct
  source 1..20: mol_type = other DNA
gcgcctgaaagtcgaccccg

SEQ ID NO: 24334 - DNA, 20 bp, synthetic construct
  source 1..20: mol_type = other DNA
attgagattctccatgaaat

SEQ ID NO: 24335 - DNA, 20 bp, synthetic construct
  source 1..20: mol_type = other DNA
acaactgcacaacaaagccc

SEQ ID NO: 24336 - DNA, 20 bp, synthetic construct
  source 1..20: mol_type = other DNA
agcgctaataacgtgcaccg

SEQ ID NO: 24337 - DNA, 20 bp, synthetic construct
  source 1..20: mol_type = other DNA
atcggaggcatccagctcgc

SEQ ID NO: 24338 - DNA, 20 bp, synthetic construct
  source 1..20: mol_type = other DNA
aagacagacgcttgcggact

SEQ ID NO: 24339 - DNA, 20 bp, synthetic construct
  source 1..20: mol_type = other DNA
gtgtacgcgactgagccgcg

SEQ ID NO: 24340 - DNA, 20 bp, synthetic construct
  source 1..20: mol_type = other DNA
aatgacccggtgcagcagga

SEQ ID NO: 24341 - DNA, 20 bp, synthetic construct
  source 1..20: mol_type = other DNA
aactaccacgggtcatttgt

SEQ ID NO: 24342 - DNA, 20 bp, synthetic construct
  source 1..20: mol_type = other DNA
ttgagtggaatggtcgtggc

SEQ ID NO: 24343 - DNA, 20 bp, synthetic construct
  source 1..20: mol_type = other DNA
taccatcctctcgtgctgca

SEQ ID NO: 24344 - DNA, 20 bp, synthetic construct
  source 1..20: mol_type = other DNA
ccagtgaagacatggtcaga

SEQ ID NO: 24345 - DNA, 20 bp, synthetic construct
  source 1..20: mol_type = other DNA
ttgcggatacttgggcgata

SEQ ID NO: 24346 - DNA, 20 bp, synthetic construct
  source 1..20: mol_type = other DNA
aggttatgggagaataaccc

SEQ ID NO: 24347 - DNA, 20 bp, synthetic construct
  source 1..20: mol_type = other DNA
cccgcgacgctcgagaaggt

SEQ ID NO: 24348 - DNA, 20 bp, synthetic construct
  source 1..20: mol_type = other DNA
ttcagctgactggaagagaa

SEQ ID NO: 24349 - DNA, 20 bp, synthetic construct
  source 1..20: mol_type = other DNA
ggccactgacctgccactgc

SEQ ID NO: 24350 - DNA, 20 bp, synthetic construct
  source 1..20: mol_type = other DNA
ccgatggcaccagcctggga

SEQ ID NO: 24351 - DNA, 20 bp, synthetic construct
  source 1..20: mol_type = other DNA
attcggaggggttaattgga

SEQ ID NO: 24352 - DNA, 20 bp, synthetic construct
  source 1..20: mol_type = other DNA
gaaggagctgaaatgcggtg

SEQ ID NO: 24353 - DNA, 20 bp, synthetic construct
  source 1..20: mol_type = other DNA
aatcggattcctagactgga

SEQ ID NO: 24354 - DNA, 20 bp, synthetic construct
  source 1..20: mol_type = other DNA
cgcaattttgcaaaagcggg

SEQ ID NO: 24355 - DNA, 20 bp, synthetic construct
  source 1..20: mol_type = other DNA
cgtgacaacaacgcctggag

SEQ ID NO: 24356 - DNA, 20 bp, synthetic construct
  source 1..20: mol_type = other DNA
cgctcaggctgactcatgtg

SEQ ID NO: 24357 - DNA, 20 bp, synthetic construct
  source 1..20: mol_type = other DNA
caaggtggtgctgacagaga

SEQ ID NO: 24358 - DNA, 20 bp, synthetic construct
  source 1..20: mol_type = other DNA
agggctcatgaaggacaact

SEQ ID NO: 24359 - DNA, 20 bp, synthetic construct
  source 1..20: mol_type = other DNA
gctcgctccaaagggaacgt

SEQ ID NO: 24360 - DNA, 20 bp, synthetic construct
  source 1..20: mol_type = other DNA
ggataactacttggcatatt

SEQ ID NO: 24361 - DNA, 20 bp, synthetic construct
  source 1..20: mol_type = other DNA
atgggcagtttatgcctttg

SEQ ID NO: 24362 - DNA, 20 bp, synthetic construct
  source 1..20: mol_type = other DNA
gccggtttggaacacgcaag

SEQ ID NO: 24363 - DNA, 20 bp, synthetic construct
  source 1..20: mol_type = other DNA
taaaaaacagtttgagtcct

SEQ ID NO: 24364 - DNA, 20 bp, synthetic construct
  source 1..20: mol_type = other DNA
cctggagtttgaagccctag

SEQ ID NO: 24365 - DNA, 20 bp, synthetic construct
  source 1..20: mol_type = other DNA
cctgaggctcatggcaaacg

SEQ ID NO: 24366 - DNA, 20 bp, synthetic construct
  source 1..20: mol_type = other DNA
attgtccggacgcaggaaaa

SEQ ID NO: 24367 - DNA, 20 bp, synthetic construct
  source 1..20: mol_type = other DNA
caataccttggaagccggaa

SEQ ID NO: 24368 - DNA, 20 bp, synthetic construct
  source 1..20: mol_type = other DNA
agtagtcatcgccatactgc

SEQ ID NO: 24369 - DNA, 20 bp, synthetic construct
  source 1..20: mol_type = other DNA
gtggctcagttcaattgtgg

SEQ ID NO: 24370 - DNA, 20 bp, synthetic construct
  source 1..20: mol_type = other DNA
gggcaacggctgtggtcttt

SEQ ID NO: 24371 - DNA, 20 bp, synthetic construct
  source 1..20: mol_type = other DNA
caagtttgttcccacaacag

SEQ ID NO: 24372 - DNA, 20 bp, synthetic construct
  source 1..20: mol_type = other DNA
atcagattcgatggctggca

SEQ ID NO: 24373 - DNA, 20 bp, synthetic construct
  source 1..20: mol_type = other DNA
tggaatgtttgtcttcaaag

SEQ ID NO: 24374 - DNA, 20 bp, synthetic construct
  source 1..20: mol_type = other DNA
tataattgacggaaagagca

SEQ ID NO: 24375 - DNA, 20 bp, synthetic construct
  source 1..20: mol_type = other DNA
cgggcccgttagccgccaca

SEQ ID NO: 24376 - DNA, 20 bp, synthetic construct
  source 1..20: mol_type = other DNA
cctcatgctttttctttgta

SEQ ID NO: 24377 - DNA, 20 bp, synthetic construct
  source 1..20: mol_type = other DNA
aggagatgtgacacacctgg

SEQ ID NO: 24378 - DNA, 20 bp, synthetic construct
  source 1..20: mol_type = other DNA
gctgaatgcagctggcatgt

SEQ ID NO: 24379 - DNA, 20 bp, synthetic construct
  source 1..20: mol_type = other DNA
cagcgtctcaacaagaaagt

SEQ ID NO: 24380 - DNA, 20 bp, synthetic construct
  source 1..20: mol_type = other DNA
gaaggaagccatgcctaaaa

SEQ ID NO: 24381 - DNA, 20 bp, synthetic construct
  source 1..20: mol_type = other DNA
ggacccagctagcattgccg

SEQ ID NO: 24382 - DNA, 20 bp, synthetic construct
  source 1..20: mol_type = other DNA
cagccgcatgtcgatggcaa

SEQ ID NO: 24383 - DNA, 20 bp, synthetic construct
  source 1..20: mol_type = other DNA
tctgcttgttggagtgatga

SEQ ID NO: 24384 - DNA, 20 bp, synthetic construct
  source 1..20: mol_type = other DNA
aacactgcttcccctgtttg

SEQ ID NO: 24385 - DNA, 20 bp, synthetic construct
  source 1..20: mol_type = other DNA
tgctgtagcattcactgggc

SEQ ID NO: 24386 - DNA, 20 bp, synthetic construct
  source 1..20: mol_type = other DNA
ctggagctattattcggctg

SEQ ID NO: 24387 - DNA, 20 bp, synthetic construct
  source 1..20: mol_type = other DNA
ttgtgacataggggaatcat

SEQ ID NO: 24388 - DNA, 20 bp, synthetic construct
  source 1..20: mol_type = other DNA
ttcatccatgctgaatggca

SEQ ID NO: 24389 - DNA, 20 bp, synthetic construct
  source 1..20: mol_type = other DNA
agttgtcaactcctggctgt

SEQ ID NO: 24390 - DNA, 20 bp, synthetic construct
  source 1..20: mol_type = other DNA
gcttgtggatgaagaacgga

SEQ ID NO: 24391 - DNA, 20 bp, synthetic construct
  source 1..20: mol_type = other DNA
gtcagcccgtcataatgacg

SEQ ID NO: 24392 - DNA, 20 bp, synthetic construct
  source 1..20: mol_type = other DNA
caattgtaccggttttacat

SEQ ID NO: 24393 - DNA, 20 bp, synthetic construct
  source 1..20: mol_type = other DNA
tagtacgaacagtcgaggaa

SEQ ID NO: 24394 - DNA, 20 bp, synthetic construct
  source 1..20: mol_type = other DNA
tattgatgtctgcatagata

SEQ ID NO: 24395 - DNA, 20 bp, synthetic construct
  source 1..20: mol_type = other DNA
tgagtttacgaaggaaggat

SEQ ID NO: 24396 - DNA, 20 bp, synthetic construct
  source 1..20: mol_type = other DNA
tttagatatgtgtttggaga

SEQ ID NO: 24397 - DNA, 20 bp, synthetic construct
  source 1..20: mol_type = other DNA
tgtcataaacttcagtgatg

SEQ ID NO: 24398 - DNA, 20 bp, synthetic construct
  source 1..20: mol_type = other DNA
acacaatacggaactcgctt

SEQ ID NO: 24399 - DNA, 20 bp, synthetic construct
  source 1..20: mol_type = other DNA
cctgcgatgtgatgttcagg

SEQ ID NO: 24400 - DNA, 20 bp, synthetic construct
  source 1..20: mol_type = other DNA
gcatgtcttgactggctatg

SEQ ID NO: 24401 - DNA, 20 bp, synthetic construct
  source 1..20: mol_type = other DNA
aggtccaccccagctacaag

SEQ ID NO: 24402 - DNA, 20 bp, synthetic construct
  source 1..20: mol_type = other DNA
tgaagggaaacccacactag

SEQ ID NO: 24403 - DNA, 20 bp, synthetic construct
  source 1..20: mol_type = other DNA
catcgtcattggggtcggag

SEQ ID NO: 24404 - DNA, 20 bp, synthetic construct
  source 1..20: mol_type = other DNA
aaggtcaaaagtctccgctg

SEQ ID NO: 24405 - DNA, 20 bp, synthetic construct
  source 1..20: mol_type = other DNA
ggcttgtttcttacacctcg

SEQ ID NO: 24406 - DNA, 20 bp, synthetic construct
  source 1..20: mol_type = other DNA
aactttcagaatggcagtgg

SEQ ID NO: 24407 - DNA, 20 bp, synthetic construct
  source 1..20: mol_type = other DNA
tgaaggggtgtttcacacca

SEQ ID NO: 24408 - DNA, 20 bp, synthetic construct
  source 1..20: mol_type = other DNA
cataacagacacagaagctc

SEQ ID NO: 24409 - DNA, 20 bp, synthetic construct
  source 1..20: mol_type = other DNA
agctcaattgtatggccctg

SEQ ID NO: 24410 - DNA, 20 bp, synthetic construct
  source 1..20: mol_type = other DNA
tgatggaccagacaacaatt

SEQ ID NO: 24411 - DNA, 20 bp, synthetic construct
  source 1..20: mol_type = other DNA
aggccttctagaaggagttg

SEQ ID NO: 24412 - DNA, 20 bp, synthetic construct
  source 1..20: mol_type = other DNA
actcctgactcctccggatt

SEQ ID NO: 24413 - DNA, 20 bp, synthetic construct
  source 1..20: mol_type = other DNA
attctcaaaaatggactggg

SEQ ID NO: 24414 - DNA, 20 bp, synthetic construct
  source 1..20: mol_type = other DNA
cgctgcagccgccacgcttt

SEQ ID NO: 24415 - DNA, 20 bp, synthetic construct
  source 1..20: mol_type = other DNA
tctaggggagaaatggaaac

SEQ ID NO: 24416 - DNA, 20 bp, synthetic construct
  source 1..20: mol_type = other DNA
agtgttgtgcccgtacagac

SEQ ID NO: 24417 - DNA, 20 bp, synthetic construct
  source 1..20: mol_type = other DNA
tgaggaggagcatcaatggc

SEQ ID NO: 24418 - DNA, 20 bp, synthetic construct
  source 1..20: mol_type = other DNA
gatgtacgctgatgacacag

SEQ ID NO: 24419 - DNA, 20 bp, synthetic construct
  source 1..20: mol_type = other DNA
aaaaacatacatggacatca

SEQ ID NO: 24420 - DNA, 20 bp, synthetic construct
  source 1..20: mol_type = other DNA
agctcttctcctatggttgg

SEQ ID NO: 24421 - DNA, 20 bp, synthetic construct
  source 1..20: mol_type = other DNA
ttatgcgcaaatgtggaagt

SEQ ID NO: 24422 - DNA, 20 bp, synthetic construct
  source 1..20: mol_type = other DNA
cggaaggaataaccgcagtc

SEQ ID NO: 24423 - DNA, 20 bp, synthetic construct
  source 1..20: mol_type = other DNA
ggactagaggttagaggaga

SEQ ID NO: 24424 - DNA, 20 bp, synthetic construct
  source 1..20: mol_type = other DNA
ggacgtaggctacacttgcg

SEQ ID NO: 24425 - DNA, 20 bp, synthetic construct
  source 1..20: mol_type = other DNA
aagaatggaagccaaggacc

SEQ ID NO: 24426 - DNA, 20 bp, synthetic construct
  source 1..20: mol_type = other DNA
tctggatctaccctggactg

SEQ ID NO: 24427 - DNA, 20 bp, synthetic construct
  source 1..20: mol_type = other DNA
acgtcgtgagctgaaatgtg

SEQ ID NO: 24428 - DNA, 20 bp, synthetic construct
  source 1..20: mol_type = other DNA
aaccgaaacagccaactcca

SEQ ID NO: 24429 - DNA, 20 bp, synthetic construct
  source 1..20: mol_type = other DNA
gattggaacagccgtcaagg

SEQ ID NO: 24430 - DNA, 20 bp, synthetic construct
  source 1..20: mol_type = other DNA
gattattccaatcacgctgg

SEQ ID NO: 24431 - DNA, 20 bp, synthetic construct
  source 1..20: mol_type = other DNA
taggacaacaacagcaagtg

SEQ ID NO: 24432 - DNA, 20 bp, synthetic construct
  source 1..20: mol_type = other DNA
gaccattgagcccttccaac

SEQ ID NO: 24433 - DNA, 20 bp, synthetic construct
  source 1..20: mol_type = other DNA
agccgtgggcatgactttcg

SEQ ID NO: 24434 - DNA, 20 bp, synthetic construct
  source 1..20: mol_type = other DNA
agtcgtcgccgctgaaatgg

SEQ ID NO: 24435 - DNA, 20 bp, synthetic construct
  source 1..20: mol_type = other DNA
ggatgaagcccacttcactg

SEQ ID NO: 24436 - DNA, 20 bp, synthetic construct
  source 1..20: mol_type = other DNA
caatgactgggacttcgtca

SEQ ID NO: 24437 - DNA, 20 bp, synthetic construct
  source 1..20: mol_type = other DNA
tcaccggaggggtctgggca

SEQ ID NO: 24438 - DNA, 20 bp, synthetic construct
  source 1..20: mol_type = other DNA
taaccatttggcaatctttc

SEQ ID NO: 24439 - DNA, 20 bp, synthetic construct
  source 1..20: mol_type = other DNA
cactgcatgggcaggttatg

SEQ ID NO: 24440 - DNA, 20 bp, synthetic construct
  source 1..20: mol_type = other DNA
ccacggaagctacgaggttc

SEQ ID NO: 24441 - DNA, 20 bp, synthetic construct
  source 1..20: mol_type = other DNA
cccagacccagcggtgggag

SEQ ID NO: 24442 - DNA, 20 bp, synthetic construct
  source 1..20: mol_type = other DNA
ggctagagaagcagtggaag

SEQ ID NO: 24443 - DNA, 20 bp, synthetic construct
  source 1..20: mol_type = other DNA
ctgggataccagaatcacga

SEQ ID NO: 24444 - DNA, 20 bp, synthetic construct
  source 1..20: mol_type = other DNA
cagggaggaccagagaggga

SEQ ID NO: 24445 - DNA, 20 bp, synthetic construct
  source 1..20: mol_type = other DNA
tggaagagagaggctttcgc

SEQ ID NO: 24446 - DNA, 20 bp, synthetic construct
  source 1..20: mol_type = other DNA
catggtgtcccagcacaggt

SEQ ID NO: 24447 - DNA, 20 bp, synthetic construct
  source 1..20: mol_type = other DNA
taggcccccacggcccattt

SEQ ID NO: 24448 - DNA, 20 bp, synthetic construct
  source 1..20: mol_type = other DNA
gagtggggtttccataattg

SEQ ID NO: 24449 - DNA, 20 bp, synthetic construct
  source 1..20: mol_type = other DNA
gggcgaggattgtgaggaca

SEQ ID NO: 24450 - DNA, 20 bp, synthetic construct
  source 1..20: mol_type = other DNA
gatagccaaatcgatggcag

SEQ ID NO: 24451 - DNA, 20 bp, synthetic construct
  source 1..20: mol_type = other DNA
gctctttgggaaaggtagca

SEQ ID NO: 24452 - DNA, 20 bp, synthetic construct
  source 1..20: mol_type = other DNA
ccttccatggataggaggag

SEQ ID NO: 24453 - DNA, 20 bp, synthetic construct
  source 1..20: mol_type = other DNA
tataaatagtggacatctaa

SEQ ID NO: 24454 - DNA, 20 bp, synthetic construct
  source 1..20: mol_type = other DNA
gcccatatcaatgtctgtga

SEQ ID NO: 24455 - DNA, 20 bp, synthetic construct
  source 1..20: mol_type = other DNA
ctggaggaaatcaggaagca

SEQ ID NO: 24456 - DNA, 20 bp, synthetic construct
  source 1..20: mol_type = other DNA
agccaatgctagggagataa

SEQ ID NO: 24457 - DNA, 20 bp, synthetic construct
  source 1..20: mol_type = other DNA
ggtcaaaggagaattagccg

SEQ ID NO: 24458 - DNA, 20 bp, synthetic construct
  source 1..20: mol_type = other DNA
caagagtagagcaggcccag

SEQ ID NO: 24459 - DNA, 20 bp, synthetic construct
  source 1..20: mol_type = other DNA
cctctttggagccctggcgg

SEQ ID NO: 24460 - DNA, 20 bp, synthetic construct
  source 1..20: mol_type = other DNA
ccacgtgagcctagatgttc

SEQ ID NO: 24461 - DNA, 20 bp, synthetic construct
  source 1..20: mol_type = other DNA
agctctttgggacatccctt

SEQ ID NO: 24462 - DNA, 20 bp, synthetic construct
  source 1..20: mol_type = other DNA
cagtgagggagaaatcgggg

SEQ ID NO: 24463 - DNA, 20 bp, synthetic construct
  source 1..20: mol_type = other DNA
agccttaagaggagagccta

SEQ ID NO: 24464 - DNA, 20 bp, synthetic construct
  source 1..20: mol_type = other DNA
tggagacatctatgcttaca

SEQ ID NO: 24465 - DNA, 20 bp, synthetic construct
  source 1..20: mol_type = other DNA
gcaaggacaaaggagagtgt

SEQ ID NO: 24466 - DNA, 20 bp, synthetic construct
  source 1..20: mol_type = other DNA
tgggatggtttccatcggcg

SEQ ID NO: 24467 - DNA, 20 bp, synthetic construct
  source 1..20: mol_type = other DNA
agcgaccatcctaggagggg

SEQ ID NO: 24468 - DNA, 20 bp, synthetic construct
  source 1..20: mol_type = other DNA
tcccctttttcagcatttga

SEQ ID NO: 24469 - DNA, 20 bp, synthetic construct
  source 1..20: mol_type = other DNA
tattctcgcatgcgtgctct

SEQ ID NO: 24470 - DNA, 20 bp, synthetic construct
  source 1..20: mol_type = other DNA
catcatggaagttgaccgag

SEQ ID NO: 24471 - DNA, 20 bp, synthetic construct
  source 1..20: mol_type = other DNA
ccaggtgaacggcgtggtca

SEQ ID NO: 24472 - DNA, 20 bp, synthetic construct
  source 1..20: mol_type = other DNA
catcatggaatacatggaaa

SEQ ID NO: 24473 - DNA, 20 bp, synthetic construct
  source 1..20: mol_type = other DNA
agtggtaccatgtcgttctc

SEQ ID NO: 24474 - DNA, 20 bp, synthetic construct
  source 1..20: mol_type = other DNA
ggttgccacaccttgtaaat

SEQ ID NO: 24475 - DNA, 20 bp, synthetic construct
  source 1..20: mol_type = other DNA
ttagaggagacccgtgatta

SEQ ID NO: 24476 - DNA, 20 bp, synthetic construct
  source 1..20: mol_type = other DNA
tgggagacgtcccaggatca

SEQ ID NO: 24477 - DNA, 20 bp, synthetic construct
  source 1..20: mol_type = other DNA
ccaagatcgctgttgtctct

SEQ ID NO: 24478 - DNA, 20 bp, synthetic construct
  source 1..20: mol_type = other DNA
cggcgccgggccaggcgccc

SEQ ID NO: 24479 - DNA, 20 bp, synthetic construct
  source 1..20: mol_type = other DNA
ccccggcgtgtactgggagg

SEQ ID NO: 24480 - DNA, 20 bp, synthetic construct
  source 1..20: mol_type = other DNA
tttaaaggctttagaagttg

SEQ ID NO: 24481 - DNA, 20 bp, synthetic construct
  source 1..20: mol_type = other DNA
gcgagctggagagcttggct

SEQ ID NO: 24482 - DNA, 20 bp, synthetic construct
  source 1..20: mol_type = other DNA
ggcaggagaatatgggcagc

SEQ ID NO: 24483 - DNA, 20 bp, synthetic construct
  source 1..20: mol_type = other DNA
ccttcctctgcacctggcct

SEQ ID NO: 24484 - DNA, 20 bp, synthetic construct
  source 1..20: mol_type = other DNA
gaagaaccaaaactggtatg

SEQ ID NO: 24485 - DNA, 20 bp, synthetic construct
  source 1..20: mol_type = other DNA
aggggaagtacagctaaagg

SEQ ID NO: 24486 - DNA, 20 bp, synthetic construct
  source 1..20: mol_type = other DNA
ccggagctcacccctggcct

SEQ ID NO: 24487 - DNA, 20 bp, synthetic construct
  source 1..20: mol_type = other DNA
tccgagagactgagtcgccc

SEQ ID NO: 24488 - DNA, 20 bp, synthetic construct
  source 1..20: mol_type = other DNA
tagcatcttcgcggtaaaga

SEQ ID NO: 24489 - DNA, 20 bp, synthetic construct
  source 1..20: mol_type = other DNA
ttcacgggttctatccgtga

SEQ ID NO: 24490 - DNA, 20 bp, synthetic construct
  source 1..20: mol_type = other DNA
agtagcagcggactcccctc

SEQ ID NO: 24491 - DNA, 20 bp, synthetic construct
  source 1..20: mol_type = other DNA
ctccaactcctcggacaaaa

SEQ ID NO: 24492 - DNA, 20 bp, synthetic construct
  source 1..20: mol_type = other DNA
acagcatgcaaattggacca

SEQ ID NO: 24493 - DNA, 20 bp, synthetic construct
  source 1..20: mol_type = other DNA
gatatcgtacacaccacctg

SEQ ID NO: 24494 - DNA, 20 bp, synthetic construct
  source 1..20: mol_type = other DNA
caatattctcttgacaccat

SEQ ID NO: 24495 - DNA, 20 bp, synthetic construct
  source 1..20: mol_type = other DNA
ttcgtttgttctgccttata

SEQ ID NO: 24496 - DNA, 20 bp, synthetic construct
  source 1..20: mol_type = other DNA
tgctacgataatcactcagg

SEQ ID NO: 24497 - DNA, 20 bp, synthetic construct
  source 1..20: mol_type = other DNA
cgtcctttcacgttacgacc

SEQ ID NO: 24498 - DNA, 20 bp, synthetic construct
  source 1..20: mol_type = other DNA
tacgcggccgttctgacgtt

SEQ ID NO: 24499 - DNA, 20 bp, synthetic construct
  source 1..20: mol_type = other DNA
gctatgggaaaacccctttg

SEQ ID NO: 24500 - DNA, 20 bp, synthetic construct
  source 1..20: mol_type = other DNA
ccacggcggaggccaatcca

SEQ ID NO: 24501 - DNA, 20 bp, synthetic construct
  source 1..20: mol_type = other DNA
tcatctgtggatgatatagt

SEQ ID NO: 24502 - DNA, 20 bp, synthetic construct
  source 1..20: mol_type = other DNA
tggcgaaaaagcacacgtga

SEQ ID NO: 24503 - DNA, 20 bp, synthetic construct
  source 1..20: mol_type = other DNA
cagggtgattccaatcagct

SEQ ID NO: 24504 - DNA, 20 bp, synthetic construct
  source 1..20: mol_type = other DNA
gtgcctgaccggggtcatgc

SEQ ID NO: 24505 - DNA, 20 bp, synthetic construct
  source 1..20: mol_type = other DNA
gcgaactctgccaagaatat

SEQ ID NO: 24506 - DNA, 20 bp, synthetic construct
  source 1..20: mol_type = other DNA
gcctttgagctccatttgga

SEQ ID NO: 24507 - DNA, 20 bp, synthetic construct
  source 1..20: mol_type = other DNA
ttggttgagatggtctctgg

SEQ ID NO: 24508 - DNA, 20 bp, synthetic construct
  source 1..20: mol_type = other DNA
ggtgttgggaagagtttttt

SEQ ID NO: 24509 - DNA, 20 bp, synthetic construct
  source 1..20: mol_type = other DNA
attaggccccttcagaaata

SEQ ID NO: 24510 - DNA, 20 bp, synthetic construct
  source 1..20: mol_type = other DNA
caggttagacatgaagtggc

SEQ ID NO: 24511 - DNA, 20 bp, synthetic construct
  source 1..20: mol_type = other DNA
tttggacattctaagtttac

SEQ ID NO: 24512 - DNA, 20 bp, synthetic construct
  source 1..20: mol_type = other DNA
cgaggtaatggctggttggt

SEQ ID NO: 24513 - DNA, 20 bp, synthetic construct
  source 1..20: mol_type = other DNA
gaaatacaaccatggggtgt

SEQ ID NO: 24514 - DNA, 20 bp, synthetic construct
  source 1..20: mol_type = other DNA
tgatttagttagtatttagt

SEQ ID NO: 24515 - DNA, 20 bp, synthetic construct
  source 1..20: mol_type = other DNA
tgcccggccatttgggcgtg

SEQ ID NO: 24516 - DNA, 20 bp, synthetic construct
  source 1..20: mol_type = other DNA
cgtcgcccacaagacgttaa

SEQ ID NO: 24517 - DNA, 20 bp, synthetic construct
  source 1..20: mol_type = other DNA
ctcatggggtacatccctgt

SEQ ID NO: 24518 - DNA, 20 bp, synthetic construct
  source 1..20: mol_type = other DNA
cagcggcccggcgccctcac

SEQ ID NO: 24519 - DNA, 20 bp, synthetic construct
  source 1..20: mol_type = other DNA
tccatctaccctggtaccat

SEQ ID NO: 24520 - DNA, 20 bp, synthetic construct
  source 1..20: mol_type = other DNA
acttacctcaaatgcggctc

SEQ ID NO: 24521 - DNA, 20 bp, synthetic construct
  source 1..20: mol_type = other DNA
cgttgcaacttggaggacag

SEQ ID NO: 24522 - DNA, 20 bp, synthetic construct
  source 1..20: mol_type = other DNA
ctcacaaaatacatcgtccg

SEQ ID NO: 24523 - DNA, 20 bp, synthetic construct
  source 1..20: mol_type = other DNA
atgatcactctctttactct

SEQ ID NO: 24524 - DNA, 20 bp, synthetic construct
  source 1..20: mol_type = other DNA
ggtgtggtgtttgacataac

SEQ ID NO: 24525 - DNA, 20 bp, synthetic construct
  source 1..20: mol_type = other DNA
cctgggactaaatctttgga

SEQ ID NO: 24526 - DNA, 20 bp, synthetic construct
  source 1..20: mol_type = other DNA
aggggccacgctgtcggagt

SEQ ID NO: 24527 - DNA, 20 bp, synthetic construct
  source 1..20: mol_type = other DNA
gctacagctacgccccctgg

SEQ ID NO: 24528 - DNA, 20 bp, synthetic construct
  source 1..20: mol_type = other DNA
gcggcccttcggggtatggg

SEQ ID NO: 24529 - DNA, 20 bp, synthetic construct
  source 1..20: mol_type = other DNA
tacgacgcaggggccgcatg

SEQ ID NO: 24530 - DNA, 20 bp, synthetic construct
  source 1..20: mol_type = other DNA
tcgggggaaaatttcgcata

SEQ ID NO: 24531 - DNA, 20 bp, synthetic construct
  source 1..20: mol_type = other DNA
gcgccggacaaggaggtcct

SEQ ID NO: 24532 - DNA, 20 bp, synthetic construct
  source 1..20: mol_type = other DNA
attttggggggctggctagc

SEQ ID NO: 24533 - DNA, 20 bp, synthetic construct
  source 1..20: mol_type = other DNA
atgtctggcgagaagccctc

SEQ ID NO: 24534 - DNA, 20 bp, synthetic construct
  source 1..20: mol_type = other DNA
aatcacgtcgcccccaccca

SEQ ID NO: 24535 - DNA, 20 bp, synthetic construct
  source 1..20: mol_type = other DNA
tgcaccatcctaacagactt

SEQ ID NO: 24536 - DNA, 20 bp, synthetic construct
  source 1..20: mol_type = other DNA
tacataacaggactcaccac

SEQ ID NO: 24537 - DNA, 20 bp, synthetic construct
  source 1..20: mol_type = other DNA
acccacggcaaagcctatga

SEQ ID NO: 24538 - DNA, 20 bp, synthetic construct
  source 1..20: mol_type = other DNA
aagaggttcccaccagcttt

SEQ ID NO: 24539 - DNA, 20 bp, synthetic construct
  source 1..20: mol_type = other DNA
ctcgagggggagcttggaga

SEQ ID NO: 24540 - DNA, 20 bp, synthetic construct
  source 1..20: mol_type = other DNA
gcggtgatgggggcttctta

SEQ ID NO: 24541 - DNA, 20 bp, synthetic construct
  source 1..20: mol_type = other DNA
gcggcttgtaaagctgcagg

SEQ ID NO: 24542 - DNA, 20 bp, synthetic construct
  source 1..20: mol_type = other DNA
aagctcaaactcactccatt

SEQ ID NO: 24543 - DNA, 20 bp, synthetic construct
  source 1..20: mol_type = other DNA
acccagaaatttgggcgtgc

SEQ ID NO: 24544 - DNA, 20 bp, synthetic construct
  source 1..20: mol_type = other DNA
tcatggggtacatcccgctc

SEQ ID NO: 24545 - DNA, 20 bp, synthetic construct
  source 1..20: mol_type = other DNA
gtctagagtggcggaatacg

SEQ ID NO: 24546 - DNA, 20 bp, synthetic construct
  source 1..20: mol_type = other DNA
cgctgtacccaggccatctt

SEQ ID NO: 24547 - DNA, 20 bp, synthetic construct
  source 1..20: mol_type = other DNA
ctgatgacagaccatactgc

SEQ ID NO: 24548 - DNA, 20 bp, synthetic construct
  source 1..20: mol_type = other DNA
agaccacgtacagccggtgt

SEQ ID NO: 24549 - DNA, 20 bp, synthetic construct
  source 1..20: mol_type = other DNA
tcggctggtacctggtagct

SEQ ID NO: 24550 - DNA, 20 bp, synthetic construct
  source 1..20: mol_type = other DNA
atccatccttaatttttgac

SEQ ID NO: 24551 - DNA, 20 bp, synthetic construct
  source 1..20: mol_type = other DNA
tgagcattggcagatggttc

SEQ ID NO: 24552 - DNA, 20 bp, synthetic construct
  source 1..20: mol_type = other DNA
tttgcgggctgcccgtctct

SEQ ID NO: 24553 - DNA, 20 bp, synthetic construct
  source 1..20: mol_type = other DNA
tgaccggtgaagtgcaggtg

SEQ ID NO: 24554 - DNA, 20 bp, synthetic construct
  source 1..20: mol_type = other DNA
gcccttcggggcatgttgcg

SEQ ID NO: 24555 - DNA, 20 bp, synthetic construct
  source 1..20: mol_type = other DNA
atgccccgaccggcagcggt

SEQ ID NO: 24556 - DNA, 20 bp, synthetic construct
  source 1..20: mol_type = other DNA
acgttgacttcagcctggac

SEQ ID NO: 24557 - DNA, 20 bp, synthetic construct
  source 1..20: mol_type = other DNA
cctgcttgacacaccccatc

SEQ ID NO: 24558 - DNA, 20 bp, synthetic construct
  source 1..20: mol_type = other DNA
ttaacatactcggggggtgg

SEQ ID NO: 24559 - DNA, 20 bp, synthetic construct
  source 1..20: mol_type = other DNA
agatcatgggaggagaatgc

SEQ ID NO: 24560 - DNA, 20 bp, synthetic construct
  source 1..20: mol_type = other DNA
ggggcaaccacgtctcaccg

SEQ ID NO: 24561 - DNA, 20 bp, synthetic construct
  source 1..20: mol_type = other DNA
gggtttgctcggtgttggcc

SEQ ID NO: 24562 - DNA, 20 bp, synthetic construct
  source 1..20: mol_type = other DNA
tccattacatcacgggggcc

SEQ ID NO: 24563 - DNA, 20 bp, synthetic construct
  source 1..20: mol_type = other DNA
gccagacgcataggcctcat

SEQ ID NO: 24564 - DNA, 20 bp, synthetic construct
  source 1..20: mol_type = other DNA
ggacaattcagctggacggc

SEQ ID NO: 24565 - DNA, 20 bp, synthetic construct
  source 1..20: mol_type = other DNA
catgctcgtctatgcctcct

SEQ ID NO: 24566 - DNA, 20 bp, synthetic construct
  source 1..20: mol_type = other DNA
gcatgctcaccatcgaggaa

SEQ ID NO: 24567 - DNA, 20 bp, synthetic construct
  source 1..20: mol_type = other DNA
tggcgaagaacgaggtgttt

SEQ ID NO: 24568 - DNA, 20 bp, synthetic construct
  source 1..20: mol_type = other DNA
ttcttgtctgcggagatgat

SEQ ID NO: 24569 - DNA, 20 bp, synthetic construct
  source 1..20: mol_type = other DNA
tggatttgtccagctggttt

SEQ ID NO: 24570 - DNA, 20 bp, synthetic construct
  source 1..20: mol_type = other DNA
cgcgtgcccgaacccgccat

SEQ ID NO: 24571 - DNA, 20 bp, synthetic construct
  source 1..20: mol_type = other DNA
tgccgcgcaggggccccaga

SEQ ID NO: 24572 - DNA, 20 bp, synthetic construct
  source 1..20: mol_type = other DNA
atggtgtcagggctttggag

SEQ ID NO: 24573 - DNA, 20 bp, synthetic construct
  source 1..20: mol_type = other DNA
gcatagtgtatgaggccgac

SEQ ID NO: 24574 - DNA, 20 bp, synthetic construct
  source 1..20: mol_type = other DNA
gtccaacaaccaccttagtt

SEQ ID NO: 24575 - DNA, 20 bp, synthetic construct
  source 1..20: mol_type = other DNA
acacccacaagtttaacagc

SEQ ID NO: 24576 - DNA, 20 bp, synthetic construct
  source 1..20: mol_type = other DNA
ccagtgtgtgtggccccgtg

SEQ ID NO: 24577 - DNA, 20 bp, synthetic construct
  source 1..20: mol_type = other DNA
ccgggttcaccaaaacctgt

SEQ ID NO: 24578 - DNA, 20 bp, synthetic construct
  source 1..20: mol_type = other DNA
cctacctatggatgatgttt

SEQ ID NO: 24579 - DNA, 20 bp, synthetic construct
  source 1..20: mol_type = other DNA
gcgggctgtggccctgtttt

SEQ ID NO: 24580 - DNA, 20 bp, synthetic construct
  source 1..20: mol_type = other DNA
tctaccacggggcgggtgcc

SEQ ID NO: 24581 - DNA, 20 bp, synthetic construct
  source 1..20: mol_type = other DNA
caccaggccttcctgtgtgc

SEQ ID NO: 24582 - DNA, 20 bp, synthetic construct
  source 1..20: mol_type = other DNA
tcttggtgggcggcgtcctg

SEQ ID NO: 24583 - DNA, 20 bp, synthetic construct
  source 1..20: mol_type = other DNA
agcacgggttacaactggct

SEQ ID NO: 24584 - DNA, 20 bp, synthetic construct
  source 1..20: mol_type = other DNA
cggaatcggcgcgtcggaga

SEQ ID NO: 24585 - DNA, 20 bp, synthetic construct
  source 1..20: mol_type = other DNA
accgtgatacagaccttacc

SEQ ID NO: 24586 - DNA, 20 bp, synthetic construct
  source 1..20: mol_type = other DNA
agagagcgcttcacgacgtc

SEQ ID NO: 24587 - DNA, 20 bp, synthetic construct
  source 1..20: mol_type = other DNA
gcttcgggaacacgctgacg

SEQ ID NO: 24588 - DNA, 20 bp, synthetic construct
  source 1..20: mol_type = other DNA
tcattcaaagactccatggc

SEQ ID NO: 24589 - DNA, 20 bp, synthetic construct
  source 1..20: mol_type = other DNA
tatgtggcatatacctcttt

SEQ ID NO: 24590 - DNA, 20 bp, synthetic construct
  source 1..20: mol_type = other DNA
gtctcatgcccgaccccgct

SEQ ID NO: 24591 - DNA, 20 bp, synthetic construct
  source 1..20: mol_type = other DNA
ggtggttgctctccccccga

SEQ ID NO: 24592 - DNA, 20 bp, synthetic construct
  source 1..20: mol_type = other DNA
acggtgtgaaggttcttgaa

SEQ ID NO: 24593 - DNA, 20 bp, synthetic construct
  source 1..20: mol_type = other DNA
gggatgtctgcggtccagtc

SEQ ID NO: 24594 - DNA, 20 bp, synthetic construct
  source 1..20: mol_type = other DNA
ggcattacccgtgcaccgta

SEQ ID NO: 24595 - DNA, 20 bp, synthetic construct
  source 1..20: mol_type = other DNA
gcttgggcgtttggccacta

SEQ ID NO: 24596 - DNA, 20 bp, synthetic construct
  source 1..20: mol_type = other DNA
atttcatagcccgagtggag

SEQ ID NO: 24597 - DNA, 20 bp, synthetic construct
  source 1..20: mol_type = other DNA
tccgcgaattaacggtggcc

SEQ ID NO: 24598 - DNA, 20 bp, synthetic construct
  source 1..20: mol_type = other DNA
gttggcgactcctcgcccct

SEQ ID NO: 24599 - DNA, 20 bp, synthetic construct
  source 1..20: mol_type = other DNA
taatcatatgcgacgagtgc

SEQ ID NO: 24600 - DNA, 20 bp, synthetic construct
  source 1..20: mol_type = other DNA
agcgtaggggccgtacaggg

SEQ ID NO: 24601 - DNA, 20 bp, synthetic construct
  source 1..20: mol_type = other DNA
acacccccgggctccctgtc

SEQ ID NO: 24602 - DNA, 20 bp, synthetic construct
  source 1..20: mol_type = other DNA
tggacgaggcacgtgccatc

SEQ ID NO: 24603 - DNA, 20 bp, synthetic construct
  source 1..20: mol_type = other DNA
ctggcctttcgaccttgccg

SEQ ID NO: 24604 - DNA, 20 bp, synthetic construct
  source 1..20: mol_type = other DNA
tcttctcatgccagaagggg

SEQ ID NO: 24605 - DNA, 20 bp, synthetic construct
  source 1..20: mol_type = other DNA
caacagggcccagcgtacct

SEQ ID NO: 24606 - DNA, 20 bp, synthetic construct
  source 1..20: mol_type = other DNA
cggcggaaacggccaagcgc

SEQ ID NO: 24607 - DNA, 20 bp, synthetic construct
  source 1..20: mol_type = other DNA
gcggtgaggacaacgtggtg

SEQ ID NO: 24608 - DNA, 20 bp, synthetic construct
  source 1..20: mol_type = other DNA
gagtccgcgtctgcgagaag

SEQ ID NO: 24609 - DNA, 20 bp, synthetic construct
  source 1..20: mol_type = other DNA
ctgaggctatgaccaggtac

SEQ ID NO: 24610 - DNA, 20 bp, synthetic construct
  source 1..20: mol_type = other DNA
cgctggatcttccagctatc

SEQ ID NO: 24611 - DNA, 20 bp, synthetic construct
  source 1..20: mol_type = other DNA
cgctggcgggggggacattt

SEQ ID NO: 24612 - DNA, 20 bp, synthetic construct
  source 1..20: mol_type = other DNA
ccctgtgaggaactactgtc

SEQ ID NO: 24613 - DNA, 20 bp, synthetic construct
  source 1..20: mol_type = other DNA
aatgcctggagatttgggcg

SEQ ID NO: 24614 - DNA, 20 bp, synthetic construct
  source 1..20: mol_type = other DNA
tgtcaggcaattggttgaag

SEQ ID NO: 24615 - DNA, 20 bp, synthetic construct
  source 1..20: mol_type = other DNA
ataggaccgctctaaactgt

SEQ ID NO: 24616 - DNA, 20 bp, synthetic construct
  source 1..20: mol_type = other DNA
cgtctgaggaccggccctac

SEQ ID NO: 24617 - DNA, 20 bp, synthetic construct
  source 1..20: mol_type = other DNA
aggccacatatcagaagtgt

SEQ ID NO: 24618 - DNA, 20 bp, synthetic construct
  source 1..20: mol_type = other DNA
ttctggtgttgacaatcttt

SEQ ID NO: 24619 - DNA, 20 bp, synthetic construct
  source 1..20: mol_type = other DNA
acccacatctcgggtttgag

SEQ ID NO: 24620 - DNA, 20 bp, synthetic construct
  source 1..20: mol_type = other DNA
tgaggttgggcgcctggact

SEQ ID NO: 24621 - DNA, 20 bp, synthetic construct
  source 1..20: mol_type = other DNA
tgaggggtctccctgtgtcc

SEQ ID NO: 24622 - DNA, 20 bp, synthetic construct
  source 1..20: mol_type = other DNA
acgctccgacgggtagcggt

SEQ ID NO: 24623 - DNA, 20 bp, synthetic construct
  source 1..20: mol_type = other DNA
tgtctaaacaactaacctca

SEQ ID NO: 24624 - DNA, 20 bp, synthetic construct
  source 1..20: mol_type = other DNA
agcaggggggcgagaacttt

SEQ ID NO: 24625 - DNA, 20 bp, synthetic construct
  source 1..20: mol_type = other DNA
tagtaacaacacatccaatc

SEQ ID NO: 24626 - DNA, 20 bp, synthetic construct
  source 1..20: mol_type = other DNA
cggttgtccctgatcgggag

SEQ ID NO: 24627 - DNA, 20 bp, synthetic construct
  source 1..20: mol_type = other DNA
acgggtctatgaagatcaca

SEQ ID NO: 24628 - DNA, 20 bp, synthetic construct
  source 1..20: mol_type = other DNA
ggtctcagctcccttgtgag

SEQ ID NO: 24629 - DNA, 20 bp, synthetic construct
  source 1..20: mol_type = other DNA
gcacggcgaacggagaccac

SEQ ID NO: 24630 - DNA, 20 bp, synthetic construct
  source 1..20: mol_type = other DNA
agtgccatagaccacctagg

SEQ ID NO: 24631 - DNA, 20 bp, synthetic construct
  source 1..20: mol_type = other DNA
agaggctcatacagctggac

SEQ ID NO: 24632 - DNA, 20 bp, synthetic construct
  source 1..20: mol_type = other DNA
gatcctttagctcaatgccc

SEQ ID NO: 24633 - DNA, 20 bp, synthetic construct
  source 1..20: mol_type = other DNA
cccaacgggtagagtacttg

SEQ ID NO: 24634 - DNA, 20 bp, synthetic construct
  source 1..20: mol_type = other DNA
tcacagaacgcctctattgt

SEQ ID NO: 24635 - DNA, 20 bp, synthetic construct
  source 1..20: mol_type = other DNA
tagcccacgatggcaccgga

SEQ ID NO: 24636 - DNA, 20 bp, synthetic construct
  source 1..20: mol_type = other DNA
gcctcaggaagcttggggcg

SEQ ID NO: 24637 - DNA, 20 bp, synthetic construct
  source 1..20: mol_type = other DNA
atttgtcaggctggtttgtc

SEQ ID NO: 24638 - DNA, 20 bp, synthetic construct
  source 1..20: mol_type = other DNA
tgtttccttttattcctata

SEQ ID NO: 24639 - DNA, 20 bp, synthetic construct
  source 1..20: mol_type = other DNA
cggtaaaggatatcatgtta

SEQ ID NO: 24640 - DNA, 20 bp, synthetic construct
  source 1..20: mol_type = other DNA
gatcagggtatacaatacac

SEQ ID NO: 24641 - DNA, 20 bp, synthetic construct
  source 1..20: mol_type = other DNA
acaatgctaacacaaccaca

SEQ ID NO: 24642 - DNA, 20 bp, synthetic construct
  source 1..20: mol_type = other DNA
tggcatattccccaccaggt

SEQ ID NO: 24643 - DNA, 20 bp, synthetic construct
  source 1..20: mol_type = other DNA
tggtggataccaaagctact

SEQ ID NO: 24644 - DNA, 20 bp, synthetic construct
  source 1..20: mol_type = other DNA
gtggtgagggcgttgttggt

SEQ ID NO: 24645 - DNA, 20 bp, synthetic construct
  source 1..20: mol_type = other DNA
aacagcaggctgtcgtgatc

SEQ ID NO: 24646 - DNA, 20 bp, synthetic construct
  source 1..20: mol_type = other DNA
ttgtctctgtggcggggata

SEQ ID NO: 24647 - DNA, 20 bp, synthetic construct
  source 1..20: mol_type = other DNA
taaaaaccgagtacggcgag

SEQ ID NO: 24648 - DNA, 20 bp, synthetic construct
  source 1..20: mol_type = other DNA
actcagtggccatgaggcag

SEQ ID NO: 24649 - DNA, 20 bp, synthetic construct
  source 1..20: mol_type = other DNA
tgagagctggctctcctgcc

SEQ ID NO: 24650 - DNA, 20 bp, synthetic construct
  source 1..20: mol_type = other DNA
aagacctcctcttggctcag

SEQ ID NO: 24651 - DNA, 20 bp, synthetic construct
  source 1..20: mol_type = other DNA
tgacacacacacccctggag

SEQ ID NO: 24652 - DNA, 20 bp, synthetic construct
  source 1..20: mol_type = other DNA
ttcggcaattttagcgaatt

SEQ ID NO: 24653 - DNA, 20 bp, synthetic construct
  source 1..20: mol_type = other DNA
ttcccagagtaattgctgta

SEQ ID NO: 24654 - DNA, 20 bp, synthetic construct
  source 1..20: mol_type = other DNA
gggctactacactcccgaca

SEQ ID NO: 24655 - DNA, 20 bp, synthetic construct
  source 1..20: mol_type = other DNA
tgttaatgccctgagtcttg

SEQ ID NO: 24656 - DNA, 20 bp, synthetic construct
  source 1..20: mol_type = other DNA
cactcatgctttctcatttg

SEQ ID NO: 24657 - DNA, 20 bp, synthetic construct
  source 1..20: mol_type = other DNA
tgcttcagttatcttggaca

SEQ ID NO: 24658 - DNA, 20 bp, synthetic construct
  source 1..20: mol_type = other DNA
agcactaggctttcacgctg

SEQ ID NO: 24659 - DNA, 20 bp, synthetic construct
  source 1..20: mol_type = other DNA
ggctaggtacatttgtgctc

SEQ ID NO: 24660 - DNA, 20 bp, synthetic construct
  source 1..20: mol_type = other DNA
gcaaggggccaatacgattt

SEQ ID NO: 24661 - DNA, 20 bp, synthetic construct
  source 1..20: mol_type = other DNA
ggagctcaaaacaaaagaaa

SEQ ID NO: 24662 - DNA, 20 bp, synthetic construct
  source 1..20: mol_type = other DNA
ggaggtcactgacagtgcag

SEQ ID NO: 24663 - DNA, 20 bp, synthetic construct
  source 1..20: mol_type = other DNA
ccatcgatgtgaagatgatg

SEQ ID NO: 24664 - DNA, 20 bp, synthetic construct
  source 1..20: mol_type = other DNA
acaggggctggggcaacggc

SEQ ID NO: 24665 - DNA, 20 bp, synthetic construct
  source 1..20: mol_type = other DNA
ccacacaggttggagccact

SEQ ID NO: 24666 - DNA, 20 bp, synthetic construct
  source 1..20: mol_type = other DNA
atcgtgagtggttcatggac

SEQ ID NO: 24667 - DNA, 20 bp, synthetic construct
  source 1..20: mol_type = other DNA
tggaattttcaagcaacact

SEQ ID NO: 24668 - DNA, 20 bp, synthetic construct
  source 1..20: mol_type = other DNA
tcggaggagcattccgctca

SEQ ID NO: 24669 - DNA, 20 bp, synthetic construct
  source 1..20: mol_type = other DNA
accgtggacctgccactcgc

SEQ ID NO: 24670 - DNA, 20 bp, synthetic construct
  source 1..20: mol_type = other DNA
aaatggcttatcacgatgcc

SEQ ID NO: 24671 - DNA, 20 bp, synthetic construct
  source 1..20: mol_type = other DNA
tgtacaggatactgctgttg

SEQ ID NO: 24672 - DNA, 20 bp, synthetic construct
  source 1..20: mol_type = other DNA
gcggatggcccgcaactgaa

SEQ ID NO: 24673 - DNA, 20 bp, synthetic construct
  source 1..20: mol_type = other DNA
aaggtgttttccacaccctt

SEQ ID NO: 24674 - DNA, 20 bp, synthetic construct
  source 1..20: mol_type = other DNA
tgagaacagccgtgctagcg

SEQ ID NO: 24675 - DNA, 20 bp, synthetic construct
  source 1..20: mol_type = other DNA
gggtgccgaactacaacctg

SEQ ID NO: 24676 - DNA, 20 bp, synthetic construct
  source 1..20: mol_type = other DNA
cagtgacagcagctagtgcc

SEQ ID NO: 24677 - DNA, 20 bp, synthetic construct
  source 1..20: mol_type = other DNA
ggctcattgaggttctggga

SEQ ID NO: 24678 - DNA, 20 bp, synthetic construct
  source 1..20: mol_type = other DNA
ccttcgtcgatgttggagtg

SEQ ID NO: 24679 - DNA, 20 bp, synthetic construct
  source 1..20: mol_type = other DNA
tcatgaagaacgctgtagtg

SEQ ID NO: 24680 - DNA, 20 bp, synthetic construct
  source 1..20: mol_type = other DNA
ggctggtcgaacggaggttt

SEQ ID NO: 24681 - DNA, 20 bp, synthetic construct
  source 1..20: mol_type = other DNA
agcgagtgttcaaagagaag

SEQ ID NO: 24682 - DNA, 20 bp, synthetic construct
  source 1..20: mol_type = other DNA
ccaagggaagcagagccatt

SEQ ID NO: 24683 - DNA, 20 bp, synthetic construct
  source 1..20: mol_type = other DNA
aaggacccaaagtcaggacc

SEQ ID NO: 24684 - DNA, 20 bp, synthetic construct
  source 1..20: mol_type = other DNA
caactggatggtatgattgg

SEQ ID NO: 24685 - DNA, 20 bp, synthetic construct
  source 1..20: mol_type = other DNA
ttaaagtgcacggcccagcc

SEQ ID NO: 24686 - DNA, 20 bp, synthetic construct
  source 1..20: mol_type = other DNA
ccgtgccacaaaacaccaca

SEQ ID NO: 24687 - DNA, 20 bp, synthetic construct
  source 1..20: mol_type = other DNA
gtggcgtggtgctcttgtat

SEQ ID NO: 24688 - DNA, 20 bp, synthetic construct
  source 1..20: mol_type = other DNA
gaagccataagcatcgttat

SEQ ID NO: 24689 - DNA, 20 bp, synthetic construct
  source 1..20: mol_type = other DNA
gaagccatttaagtgacaag

SEQ ID NO: 24690 - DNA, 20 bp, synthetic construct
  source 1..20: mol_type = other DNA
gcatcttcgggcaaaatctg

SEQ ID NO: 24691 - DNA, 20 bp, synthetic construct
  source 1..20: mol_type = other DNA
ctaaagctgacaattacacc

SEQ ID NO: 24692 - DNA, 20 bp, synthetic construct
  source 1..20: mol_type = other DNA
aaaacccagttgaggactac

SEQ ID NO: 24693 - DNA, 20 bp, synthetic construct
  source 1..20: mol_type = other DNA
ctgttgtcaccaacaacaca

SEQ ID NO: 24694 - DNA, 20 bp, synthetic construct
  source 1..20: mol_type = other DNA
atgcgcacttaaccagcttg

SEQ ID NO: 24695 - DNA, 20 bp, synthetic construct
  source 1..20: mol_type = other DNA
taagaccctattcatgttta

SEQ ID NO: 24696 - DNA, 20 bp, synthetic construct
  source 1..20: mol_type = other DNA
tcatcagtgcacttaccata

SEQ ID NO: 24697 - DNA, 20 bp, synthetic construct
  source 1..20: mol_type = other DNA
aagttgatgaaccagctcag

SEQ ID NO: 24698 - DNA, 20 bp, synthetic construct
  source 1..20: mol_type = other DNA
agaaacctgagttaagaaga

SEQ ID NO: 24699 - DNA, 20 bp, synthetic construct
  source 1..20: mol_type = other DNA
atattgatggaaggttagtt

SEQ ID NO: 24700 - DNA, 20 bp, synthetic construct
  source 1..20: mol_type = other DNA
tggaacaagcaatatatggt

SEQ ID NO: 24701 - DNA, 20 bp, synthetic construct
  source 1..20: mol_type = other DNA
taactttcctaaaggatgaa

SEQ ID NO: 24702 - DNA, 20 bp, synthetic construct
  source 1..20: mol_type = other DNA
atccagatgtgttttggtca

SEQ ID NO: 24703 - DNA, 20 bp, synthetic construct
  source 1..20: mol_type = other DNA
aactggatccgtaactggac

SEQ ID NO: 24704 - DNA, 20 bp, synthetic construct
  source 1..20: mol_type = other DNA
gacagcctaaggatgccctc

SEQ ID NO: 24705 - DNA, 20 bp, synthetic construct
  source 1..20: mol_type = other DNA
cggaaatgaaaagatcatac

SEQ ID NO: 24706 - DNA, 20 bp, synthetic construct
  source 1..20: mol_type = other DNA
cacccacgggtacgcacact

SEQ ID NO: 24707 - DNA, 20 bp, synthetic construct
  source 1..20: mol_type = other DNA
tcttgatgttcgggctagtt

SEQ ID NO: 24708 - DNA, 20 bp, synthetic construct
  source 1..20: mol_type = other DNA
ttctgagacagtgtttaata

SEQ ID NO: 24709 - DNA, 20 bp, synthetic construct
  source 1..20: mol_type = other DNA
gcgttgcccagttgagcctg

SEQ ID NO: 24710 - DNA, 20 bp, synthetic construct
  source 1..20: mol_type = other DNA
aagcaatacacaccagagat

SEQ ID NO: 24711 - DNA, 20 bp, synthetic construct
  source 1..20: mol_type = other DNA
tctctttgtaaaacaagaac

SEQ ID NO: 24712 - DNA, 20 bp, synthetic construct
  source 1..20: mol_type = other DNA
acgaaaacttaggctaacgg

SEQ ID NO: 24713 - DNA, 20 bp, synthetic construct
  source 1..20: mol_type = other DNA
tgtagacaggtttaaaccat

SEQ ID NO: 24714 - DNA, 20 bp, synthetic construct
  source 1..20: mol_type = other DNA
ggaaaggaaaagagaagttc

SEQ ID NO: 24715 - DNA, 20 bp, synthetic construct
  source 1..20: mol_type = other DNA
gaaccctccaactgacatgc

SEQ ID NO: 24716 - DNA, 20 bp, synthetic construct
  source 1..20: mol_type = other DNA
catccatagtgcaggaggta

SEQ ID NO: 24717 - DNA, 20 bp, synthetic construct
  source 1..20: mol_type = other DNA
tcacaatgttcttggcaaga

SEQ ID NO: 24718 - DNA, 20 bp, synthetic construct
  source 1..20: mol_type = other DNA
ggttttctcagacgcatacg

SEQ ID NO: 24719 - DNA, 20 bp, synthetic construct
  source 1..20: mol_type = other DNA
tttaggtaagaacattacag

SEQ ID NO: 24720 - DNA, 20 bp, synthetic construct
  source 1..20: mol_type = other DNA
cagtggagaagaagagtaca

SEQ ID NO: 24721 - DNA, 20 bp, synthetic construct
  source 1..20: mol_type = other DNA
aagtatgacctaccgttaac

SEQ ID NO: 24722 - DNA, 20 bp, synthetic construct
  source 1..20: mol_type = other DNA
cctagattactcagatggag

SEQ ID NO: 24723 - DNA, 20 bp, synthetic construct
  source 1..20: mol_type = other DNA
acctacagatcgaaagagtg

SEQ ID NO: 24724 - DNA, 20 bp, synthetic construct
  source 1..20: mol_type = other DNA
gattaacccttataatatac

SEQ ID NO: 24725 - DNA, 20 bp, synthetic construct
  source 1..20: mol_type = other DNA
tgtatgtttgttaatacatg

SEQ ID NO: 24726 - DNA, 20 bp, synthetic construct
  source 1..20: mol_type = other DNA
gacttcagtgcgttacacca

SEQ ID NO: 24727 - DNA, 20 bp, synthetic construct
  source 1..20: mol_type = other DNA
gccaaatgaaccaggagaaa

SEQ ID NO: 24728 - DNA, 20 bp, synthetic construct
  source 1..20: mol_type = other DNA
tggagtgctaatggcaacag

SEQ ID NO: 24729 - DNA, 20 bp, synthetic construct
  source 1..20: mol_type = other DNA
caaattggaacccagtgtgt

SEQ ID NO: 24730 - DNA, 20 bp, synthetic construct
  source 1..20: mol_type = other DNA
gttaggttacactagtgatg

SEQ ID NO: 24731 - DNA, 20 bp, synthetic construct
  source 1..20: mol_type = other DNA
gaaatgagccctaccgttaa

SEQ ID NO: 24732 - DNA, 20 bp, synthetic construct
  source 1..20: mol_type = other DNA
gtctactcaaaagactggtg

SEQ ID NO: 24733 - DNA, 20 bp, synthetic construct
  source 1..20: mol_type = other DNA
acaatgcaacgcttccaggt

SEQ ID NO: 24734 - DNA, 20 bp, synthetic construct
  source 1..20: mol_type = other DNA
agccgtttgcaacgcagcaa

SEQ ID NO: 24735 - DNA, 20 bp, synthetic construct
  source 1..20: mol_type = other DNA
tgttgagttagattactctg

SEQ ID NO: 24736 - DNA, 20 bp, synthetic construct
  source 1..20: mol_type = other DNA
tggtgccccaacaaacagga

SEQ ID NO: 24737 - DNA, 20 bp, synthetic construct
  source 1..20: mol_type = other DNA
ggcggcaaatgagtactacc

SEQ ID NO: 24738 - DNA, 20 bp, synthetic construct
  source 1..20: mol_type = other DNA
gctgttgcacggagctccag

SEQ ID NO: 24739 - DNA, 20 bp, synthetic construct
  source 1..20: mol_type = other DNA
tggaaaggatgtgtccctgt

SEQ ID NO: 24740 - DNA, 20 bp, synthetic construct
  source 1..20: mol_type = other DNA
attccattttgacatgaaca

SEQ ID NO: 24741 - DNA, 20 bp, synthetic construct
  source 1..20: mol_type = other DNA
cgtggatagtgaagaattga

SEQ ID NO: 24742 - DNA, 20 bp, synthetic construct
  source 1..20: mol_type = other DNA
aaaggaggaatctgagattg

SEQ ID NO: 24743 - DNA, 20 bp, synthetic construct
  source 1..20: mol_type = other DNA
gatactgatggccactggta

SEQ ID NO: 24744 - DNA, 20 bp, synthetic construct
  source 1..20: mol_type = other DNA
taagaacattgatcttgata

SEQ ID NO: 24745 - DNA, 20 bp, synthetic construct
  source 1..20: mol_type = other DNA
ttacgtagaaagtggcttga

SEQ ID NO: 24746 - DNA, 20 bp, synthetic construct
  source 1..20: mol_type = other DNA
gctcttatatacccacatca

SEQ ID NO: 24747 - DNA, 20 bp, synthetic construct
  source 1..20: mol_type = other DNA
cagtatatgtacataccacc

SEQ ID NO: 24748 - DNA, 20 bp, synthetic construct
  source 1..20: mol_type = other DNA
agccagccataccttctaaa

SEQ ID NO: 24749 - DNA, 20 bp, synthetic construct
  source 1..20: mol_type = other DNA
ctggtcatagtaatcaggag

SEQ ID NO: 24750 - DNA, 20 bp, synthetic construct
  source 1..20: mol_type = other DNA
cgcggcgctccaggcacagg

SEQ ID NO: 24751 - DNA, 20 bp, synthetic construct
  source 1..20: mol_type = other DNA
tcgggtatgcctaaaactgc

SEQ ID NO: 24752 - DNA, 20 bp, synthetic construct
  source 1..20: mol_type = other DNA
catgctgagccaagtggaac

SEQ ID NO: 24753 - DNA, 20 bp, synthetic construct
  source 1..20: mol_type = other DNA
aaaattattggaattcatgt

SEQ ID NO: 24754 - DNA, 20 bp, synthetic construct
  source 1..20: mol_type = other DNA
aacatagacacatccaaaat

SEQ ID NO: 24755 - DNA, 20 bp, synthetic construct
  source 1..20: mol_type = other DNA
attactggatctgctgtcgg

SEQ ID NO: 24756 - DNA, 20 bp, synthetic construct
  source 1..20: mol_type = other DNA
tgaaggggaaaacgctcgtt

SEQ ID NO: 24757 - DNA, 20 bp, synthetic construct
  source 1..20: mol_type = other DNA
atcagctgaagcgtgtgggt

SEQ ID NO: 24758 - DNA, 20 bp, synthetic construct
  source 1..20: mol_type = other DNA
tcagggtactctacttgttg

SEQ ID NO: 24759 - DNA, 20 bp, synthetic construct
  source 1..20: mol_type = other DNA
atgggaatcaacgttagtgg

SEQ ID NO: 24760 - DNA, 20 bp, synthetic construct
  source 1..20: mol_type = other DNA
aagcacacatcaagtagcga

SEQ ID NO: 24761 - DNA, 20 bp, synthetic construct
  source 1..20: mol_type = other DNA
tattagcatactgacatcaa

SEQ ID NO: 24762 - DNA, 20 bp, synthetic construct
  source 1..20: mol_type = other DNA
ccagtatatgtacatcccac

SEQ ID NO: 24763 - DNA, 20 bp, synthetic construct
  source 1..20: mol_type = other DNA
aaaccagccttatgtgctaa

SEQ ID NO: 24764 - DNA, 20 bp, synthetic construct
  source 1..20: mol_type = other DNA
agatgatgtcatggagcaag

SEQ ID NO: 24765 - DNA, 20 bp, synthetic construct
  source 1..20: mol_type = other DNA
tagaggcccaccaggcacag

SEQ ID NO: 24766 - DNA, 20 bp, synthetic construct
  source 1..20: mol_type = other DNA
ggacatctcccttttctgcc

SEQ ID NO: 24767 - DNA, 20 bp, synthetic construct
  source 1..20: mol_type = other DNA
tagcttagattctgttgttt

SEQ ID NO: 24768 - DNA, 20 bp, synthetic construct
  source 1..20: mol_type = other DNA
catatcagtgatagagggca

SEQ ID NO: 24769 - DNA, 20 bp, synthetic construct
  source 1..20: mol_type = other DNA
tgagttgaatatggtggcat

SEQ ID NO: 24770 - DNA, 20 bp, synthetic construct
  source 1..20: mol_type = other DNA
gtttaaaccagataaacagt

SEQ ID NO: 24771 - DNA, 20 bp, synthetic construct
  source 1..20: mol_type = other DNA
accagggggctttattagtg

SEQ ID NO: 24772 - DNA, 20 bp, synthetic construct
  source 1..20: mol_type = other DNA
tcaccatcgctcccatggca

SEQ ID NO: 24773 - DNA, 20 bp, synthetic construct
  source 1..20: mol_type = other DNA
ctgccaacacaccagcattg

SEQ ID NO: 24774 - DNA, 20 bp, synthetic construct
  source 1..20: mol_type = other DNA
acagcaactcacccaagttt

SEQ ID NO: 24775 - DNA, 20 bp, synthetic construct
  source 1..20: mol_type = other DNA
caccaggagcaccaataccc

SEQ ID NO: 24776 - DNA, 20 bp, synthetic construct
  source 1..20: mol_type = other DNA
cctcaccaaatggtaaagga

SEQ ID NO: 24777 - DNA, 20 bp, synthetic construct
  source 1..20: mol_type = other DNA
gggagagttatgagagagat

SEQ ID NO: 24778 - DNA, 20 bp, synthetic construct
  source 1..20: mol_type = other DNA
ttaggaatcatgaagatctc

SEQ ID NO: 24779 - DNA, 20 bp, synthetic construct
  source 1..20: mol_type = other DNA
tatgtcagatggtttccaca

SEQ ID NO: 24780 - DNA, 20 bp, synthetic construct
  source 1..20: mol_type = other DNA
aatactgtcaagagaagggt

SEQ ID NO: 24781 - DNA, 20 bp, synthetic construct
  source 1..20: mol_type = other DNA
ctttcaacaaacccaaagtt

SEQ ID NO: 24782 - DNA, 20 bp, synthetic construct
  source 1..20: mol_type = other DNA
gtattcacgttggtggtaat

SEQ ID NO: 24783 - DNA, 20 bp, synthetic construct
  source 1..20: mol_type = other DNA
ttagtgagatgtgccttgag

SEQ ID NO: 24784 - DNA, 20 bp, synthetic construct
  source 1..20: mol_type = other DNA
tttcgtacttgtgtcactca

SEQ ID NO: 24785 - DNA, 20 bp, synthetic construct
  source 1..20: mol_type = other DNA
caggcgcaagtggctcgacc

SEQ ID NO: 24786 - DNA, 20 bp, synthetic construct
  source 1..20: mol_type = other DNA
ccccagcaccctggttcgat

SEQ ID NO: 24787 - DNA, 20 bp, synthetic construct
  source 1..20: mol_type = other DNA
aactcaattgatctttcagc

SEQ ID NO: 24788 - DNA, 20 bp, synthetic construct
  source 1..20: mol_type = other DNA
gacaccgcaggcaacacggc

SEQ ID NO: 24789 - DNA, 20 bp, synthetic construct
  source 1..20: mol_type = other DNA
gcatttgatcatgtaaggat

SEQ ID NO: 24790 - DNA, 20 bp, synthetic construct
  source 1..20: mol_type = other DNA
ccacatcaaattcttaacct

SEQ ID NO: 24791 - DNA, 20 bp, synthetic construct
  source 1..20: mol_type = other DNA
tctgttcaacccgtaaagcc

SEQ ID NO: 24792 - DNA, 20 bp, synthetic construct
  source 1..20: mol_type = other DNA
aactctagctacaatttcac

SEQ ID NO: 24793 - DNA, 20 bp, synthetic construct
  source 1..20: mol_type = other DNA
ggtggggatgacttcactct

SEQ ID NO: 24794 - DNA, 20 bp, synthetic construct
  source 1..20: mol_type = other DNA
gcggtcctagcgtccgccct

SEQ ID NO: 24795 - DNA, 20 bp, synthetic construct
  source 1..20: mol_type = other DNA
actatcccctacactccatc

SEQ ID NO: 24796 - DNA, 20 bp, synthetic construct
  source 1..20: mol_type = other DNA
gttgcaccaaacgctgactt

SEQ ID NO: 24797 - DNA, 20 bp, synthetic construct
  source 1..20: mol_type = other DNA
cttcccgtctctactcccaa

SEQ ID NO: 24798 - DNA, 20 bp, synthetic construct
  source 1..20: mol_type = other DNA
ttgatggctggaatagatgt

SEQ ID NO: 24799 - DNA, 20 bp, synthetic construct
  source 1..20: mol_type = other DNA
ataaaaacaattaaaagaat

SEQ ID NO: 24800 - DNA, 20 bp, synthetic construct
  source 1..20: mol_type = other DNA
caagcagtctccaaactttt

SEQ ID NO: 24801 - DNA, 20 bp, synthetic construct
  source 1..20: mol_type = other DNA
ctcccaaacatggcccacct

SEQ ID NO: 24802 - DNA, 20 bp, synthetic construct
  source 1..20: mol_type = other DNA
gataacaaagtggaaaactt

SEQ ID NO: 24803 - DNA, 20 bp, synthetic construct
  source 1..20: mol_type = other DNA
caaattttggacgtacaagg

SEQ ID NO: 24804 - DNA, 20 bp, synthetic construct
  source 1..20: mol_type = other DNA
aaagatgatgacttcccggc

SEQ ID NO: 24805 - DNA, 20 bp, synthetic construct
  source 1..20: mol_type = other DNA
gggtcggcactcatctgtca

SEQ ID NO: 24806 - DNA, 20 bp, synthetic construct
  source 1..20: mol_type = other DNA
tgtatatggggacgtcaact

SEQ ID NO: 24807 - DNA, 20 bp, synthetic construct
  source 1..20: mol_type = other DNA
atgttgaacacaattataaa

SEQ ID NO: 24808 - DNA, 20 bp, synthetic construct
  source 1..20: mol_type = other DNA
cgtttctcccccgaccattc

SEQ ID NO: 24809 - DNA, 20 bp, synthetic construct
  source 1..20: mol_type = other DNA
actggagctcgaccctcctt

SEQ ID NO: 24810 - DNA, 20 bp, synthetic construct
  source 1..20: mol_type = other DNA
agcgagctacagcgggaact

SEQ ID NO: 24811 - DNA, 20 bp, synthetic construct
  source 1..20: mol_type = other DNA
atagacactttttgatgaag

SEQ ID NO: 24812 - DNA, 20 bp, synthetic construct
  source 1..20: mol_type = other DNA
ctgacgattacgggaccggg

SEQ ID NO: 24813 - DNA, 20 bp, synthetic construct
  source 1..20: mol_type = other DNA
tggcatttgagcgggtgcct

SEQ ID NO: 24814 - DNA, 20 bp, synthetic construct
  source 1..20: mol_type = other DNA
gtgggtgtatccaaatcact

SEQ ID NO: 24815 - DNA, 20 bp, synthetic construct
  source 1..20: mol_type = other DNA
cctacatctcgcccagtgac

SEQ ID NO: 24816 - DNA, 20 bp, synthetic construct
  source 1..20: mol_type = other DNA
aggtactggagaaggacgcc

SEQ ID NO: 24817 - DNA, 20 bp, synthetic construct
  source 1..20: mol_type = other DNA
ttactgggcgcactccccgc

SEQ ID NO: 24818 - DNA, 20 bp, synthetic construct
  source 1..20: mol_type = other DNA
caattttggagtttcttgaa

SEQ ID NO: 24819 - DNA, 20 bp, synthetic construct
  source 1..20: mol_type = other DNA
ccaaccaagcttcagtaaag

SEQ ID NO: 24820 - DNA, 20 bp, synthetic construct
  source 1..20: mol_type = other DNA
ccgctgcggtcgatgaggcg

SEQ ID NO: 24821 - DNA, 20 bp, synthetic construct
  source 1..20: mol_type = other DNA
ttcccaacagaccttctggg

SEQ ID NO: 24822 - DNA, 20 bp, synthetic construct
  source 1..20: mol_type = other DNA
gactagaccccatggatccc

SEQ ID NO: 24823 - DNA, 20 bp, synthetic construct
  source 1..20: mol_type = other DNA
aagatgagatcagaccctca

SEQ ID NO: 24824 - DNA, 20 bp, synthetic construct
  source 1..20: mol_type = other DNA
tctcggtgcacgcttacggc

SEQ ID NO: 24825 - DNA, 20 bp, synthetic construct
  source 1..20: mol_type = other DNA
cgcttgaggaggacttgtac

SEQ ID NO: 24826 - DNA, 20 bp, synthetic construct
  source 1..20: mol_type = other DNA
gcccttcaggtaccccgagg

SEQ ID NO: 24827 - DNA, 20 bp, synthetic construct
  source 1..20: mol_type = other DNA
gactgggtctataactcgcc

SEQ ID NO: 24828 - DNA, 20 bp, synthetic construct
  source 1..20: mol_type = other DNA
tcggctagcgccggcaaaga

SEQ ID NO: 24829 - DNA, 20 bp, synthetic construct
  source 1..20: mol_type = other DNA
gtgaagataaacagcctgag

SEQ ID NO: 24830 - DNA, 20 bp, synthetic construct
  source 1..20: mol_type = other DNA
gccactggggttaaagctat

SEQ ID NO: 24831 - DNA, 20 bp, synthetic construct
  source 1..20: mol_type = other DNA
ttcgtcgtgaagaaaatctc

SEQ ID NO: 24832 - DNA, 20 bp, synthetic construct
  source 1..20: mol_type = other DNA
attaacgacatcttcgccat

SEQ ID NO: 24833 - DNA, 20 bp, synthetic construct
  source 1..20: mol_type = other DNA
cctcgtcatcttttcgcaga

SEQ ID NO: 24834 - DNA, 20 bp, synthetic construct
  source 1..20: mol_type = other DNA
cactttcgtgatacagcaag

SEQ ID NO: 24835 - DNA, 20 bp, synthetic construct
  source 1..20: mol_type = other DNA
gctggctactgtggaggagc
